United States Patent 9,487,797 (GENOMIC PLANT SEQUENCES AND USES THEREOF) - sequence listing, part 14

SEQ ID NO: 31570 - DNA, 1501 bp, Oryza sativa
ccttgtcatagtggttgaattaagaatctttaacatcttaaagaaaggctatgtcgggcgcagcacacttgtttaaaaatgatagattttaatccttcatctttagtcctcgtttggaagtgatgaaatgtggatggaatcaaaatggatggtctacttgattaacacggtgaattaatatcttgagaaattaacttaacaaatagctagaaacaagtgttctaaacaatacagtagaagaaagttattttcagaaatcgtattttcggaagtgtggagcaaataaatcgatccagggtagattacagttgatcatcacttcagaaaggggccttagttttatggatgacttaattatcactgtgcgggtacagtgatattgaacgtgctaaattttatggagaactgcagttaaatataattcttttgtataaatctgatagcagatgtagatgtctaatattacgcacgttgatgtgcaggttgatgcgttgctcgaggaaatcaagaatacgccggttagcatgatttccgatgacttaattatcagaactgtgcggcagtacgtaaacctctgaattgcagcttctgttattatttgttgtgtgtcttgttaaccatcctaaattgataattactattacctgtccttgtctgcttctctagttctattttggctcgtcagcagattcttgttcaaaatgttctccgatcatgggttattgctgcagcagttctctcaggctattgctgggggtacaacagagtggccaaacgtcctgtggctggctctgaaccaccaacagaagatgaggtgtagaggacttgacagtgttttcttttggagatgggagtctagaagtctgggagaatcaagaacgtagtgaactaagcatgtgtcataatctatcctgtgtatcagtgactctgtgttaactataactaattagtcctagagctaattggtgtggggattctgtaatgagagatctcgttcggtttgacctgtacatgtttctctggttgcggattctgttgccgaaactgatatgtgtaatgggagatctctttgggttgatctctgctttattttgttgagcaaatttgcaagaagataacggtttttgcccttttttgaatatcttttgcctcctcacgaaaactgacacgtgctaggctagtttgtaaaaaactcctcgttatatacataatcttacatcgaccctctcaacacctgatgtctaagctgttttttttttaatataattgtgaagtgaaaaatctgctttcagggtagcactgtagacataaagagtataggggtgtttctgaaaacaatcttcccttgttccacctatccccactccgctagccaatcaggaggcatattcatcagccctcggtcgatcgtgcaaggtgggccgtgggctgaaggcggagtcgtggacgcggagacagaaacggcgtcgcttcagctgcaatttttagttccccccttctt

SEQ ID NO: 31571 - DNA, 1501 bp, Oryza sativa; identical to SEQ ID NO: 31401

SEQ ID NO: 31572 - DNA, 296 bp, Oryza sativa
gtcagttgtttgctgaagctccgcaagactgcaggatcgctagcgaagtggagtaatcagtgaagccagctgtgaagcaggagtgaagatcttgagaacccgtcacagaacctaagccaccctctagggtagagtcgttagtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtactatccttagt

SEQ ID NO: 31573 - DNA, 1501 bp, Oryza sativa
ctaccacctagctaagtctgaaaatatctagcataccacttagtctactttgcaccttcactaaaattagaccataactcctttagtaaaactctttgatcaacatgttaaacataatgcactctaccactatatatgaaattacttaatctaattcaaaatattaccactatatgcactctaccactatatgaaattacttaatctctatataagttaaacagtacatagagatgtaattttttatttttatttcattttttgatatttttttcacacttaggagaacataggaaccaaccgtataaaaataaactcaaacggacaaaatatgtgacatgtagaattttccaaaactctaccgaaacggacaaaatatgtcatctattaaaataggcgtaactttctcatacggacacggaatcaggcaaataatatatgcacgggcatctacagaaaaagttacatccgattctctccagctttgccgggttcggcgatattaaaacctccaaattccgcttgcaagattgtgttttcgaggagagaagtttttcggtggagctttggaaaattccacatgccacatatttcgtccgtttgagtttattttttacatggttggttcctgtgagttcctaagtgtgaaaaaaatatcaaaaaaataaaataaaaataaaaaagttgcacatctttctcctctgcactagttcggagagaggagaggagaggaaaaattctacatgtcacatattacgtccatttgagttcaatttttctatggttggttcttgtgtgtccctaagcgtgaaaaaatatcaaacaaataaaacaaaaataaaaaaattcgggggggcgccagccactctggcgcactccccctagccacctcagcatcgccccgccacgtcggcagggggacggcgccaaagaggctggcgccgtcctgttgaatgacggcgccaggcactctggcgccccaaaaaggaccatttttgggataagtttttctaggggtctacttacgaaataagtttttcaaaaggaccaaaatgtgaaaaatccaaccaccctacgagagtgtctattaaagggcgcgacgaatataccgagagcgtagcgtgaagctggagtgaatgcgaagatagagcagctggccttcacagctctatcgatcgctccaaacggttcagtgcagaggtccgtttcctgaaacctttcaccctcagccttcgtcttgtatgcatcgtccccatcgtctcaactcttttccaggttctttgaaaccgctgagaccatggaaggtgtagaatcctgcaatggccggcacgccgacgccgacgatcgccggacgtccaagaaggatcgccggaccacgtgggccagcgctttcatcctcggtaacacaaaacacatactcattatctcattatttcgagatgattttgcatctgtgattgatgtggatggatgcatcatatgctgtcacgtatgggggcag

SEQ ID NO: 31574 - DNA, 439 bp, Oryza sativa
tgtcgcatataggcaatgtgtttatccatataaggatagtcggcaacgtgtgaactgttgcgtttgccatatcacacgaatgatctggcgcctactagctactgctggaatggaagaaatagcccgccacgcgcatcactctctcctgaaaatcacggcgcatcttctaaaatgccaaaattagagcagccatttttttgccgtatgcgtcgtgctgatctgtctcgtcacgaatagcaggaaaaataagatcagtccaactttgcaatgaatctagacgcgcctgcattgcaaggaagaactaccgctcaaaagtgcaacagcgatggatgctgcctgcagggagagtccagccgtggtagtaacacacacacacaaaaacctgtggctacagtaaacgcaacaaagacacattcacacaacacgtccacgtataaga

SEQ ID NO: 31575 - DNA, 1501 bp, Oryza sativa
taccacctagctaagtctgaaaatatctagcataccacttagtctactttgcaccttcactaaaattagaccataactcctttagtaaaactctttgatcaacatgttaaacataatgcactctaccactatatatgaaattacttaatctaattcaaaatattaccactatatgcactctaccactatatgaaattacttaatctctatataagttaaacagtacatagagatgtaattttttatttttatttcattttttgatatttttttcacacttaggagaacataggaaccaaccgtataaaaataaactcaaacggacaaaatatgtgacatgtagaattttccaaaactctaccgaaacggacaaaatatgtcatctattaaaataggcgtaactttctcatacggacacggaatcaggcaaataatatatgcacgggcatctacagaaaaagttacatccgattctctccagctttgccgggttcggcgatattaaaacctccaaattccgcttgcaagattgtgttttcgaggagagaagtttttcggtggagctttggaaaattccacatgccacatatttcgtccgtttgagtttattttttacatggttggttcctgtgagttcctaagtgtgaaaaaaatatcaaaaaaataaaataaaaataaaaaagttgcacatctttctcctctgcactagttcggagagaggagaggagaggaaaaattctacatgtcacatattacgtccatttgagttcaatttttctatggttggttcttgtgtgtccctaagcgtgaaaaaatatcaaacaaataaaacaaaaataaaaaaattcgggggggcgccagccactctggcgcactccccctagccacctcagcatcgccccgccacgtcggcagggggacggcgccaaagaggctggcgccgtcctgttgaatgacggcgccaggcactctggcgccccaaaaaggaccatttttgggataagtttttctaggggtctacttacgaaataagtttttcaaaaggaccaaaatgtgaaaaatccaaccaccctacgagagtgtctattaaagggcgcgacgaatataccgagagcgtagcgtgaagctggagtgaatgcgaagatagagcagctggccttcacagctctatcgatcgctccaaacggttcagtgcagaggtccgtttcctgaaacctttcaccctcagccttcgtcttgtatgcatcgtccccatcgtctcaactcttttccaggttctttgaaaccgctgagaccatggaaggtgtagaatcctgcaatggccggcacgccgacgccgacgatcgccggacgtccaagaaggatcgccggaccacgtgggccagcgctttcatcctcggtaacacaaaacacatactcattatctcattatttcgagatgattttgcatctgtgattgatgtggatggatgcatcatatgctgtcacgtatgggggcagt

SEQ ID NO: 31576 - DNA, 309 bp, Oryza sativa
atcatttgtcctttttggcacagatggttggttgaactggaattagatatttgaatgaatcagtccccccacccttttttttttcttttgcttttgctaattggagaccaccatgccagtggttgtttctgctgcctcatggaaaaactcttgatcaaactgtgtcgttccaagtcaacattcatacaaatggactgatttgtcaatattgtctactattgccaccagttttctttatgtctgatctctacagctatggattattttcagttgttttaattcaataaaatcatgtacttgtaggtgagc

SEQ ID NO: 31577 - DNA, 1501 bp, Oryza sativa
gcatactgtctgatggagaatcagttagtagtgcctattgattgttcaaacagtgcccttggttttgttgtagaataatcgagtttccaggcattgataaaacaaaacaaatctttaccttctactaagttacaacccactaaacatttaaagttcaacataataattattagtacatcttaaaatctaacatgcaagcatatcacataactcactaaacacgtaaaacttaacattcatacataacaattatatctaccattccttacattccaaacctcaacataaaagcataaattatcatttctcacacttttttcataatttttcaacccaaaccaaatttatctataaattttatggcatttaacatatattcatttaatttaacgcatccatatatcccgcggtaaaacacaaggctccatctagtgtttttggagcttcttacaatgggtgctcacctcacaaggcaatgtagtgtcttgcagccgctgcgcctcgccacctgcgtccatttctcttgttgccgttgctgctctcgtgctcggcgtcataggcgatcatccacctcctgggctttcacagccgcttgccgttccaccttgagaccgggcaagggctccctgtaagtttcttctggagatgccaatgttaaggggaatctaatcagtaaacataggggaatcaggagtggagcaggcaatttgtttgatttatgtggcgagaatggtatgggggagaaaacgaggagagattactattggttgaattgctaaaatcaagaagaaaatgatgaaatgcttcctccactctaaattataaggcacaaccatcactaacgcaaacatcaagaaatagttattaccatattctcgtttggatcactttaataaatgtaatgtatgcacctaatgaaattagagatcttgaagttagaagatttttaaaaactaatttaggaaaatggagatgctaagttaactatatggtgtgcattacattatgaaacatcacgaaaaaagtggttgtgcttggccttatatttcagaatgacggagtagtattaaagagatacagtgaaccactataaaacaacacttattacatatctttaactcaaactgtatttatttagagagggaggaagcagtgtgtaattctaattgacacagtgaatcattacacattttattcagtcatcttacgcatgcttgtactttgaacaatataaataaaatttataattctttaataaaacgaatagtcacgctaaaactcaacaccatcttatatatattagaaaacagaggagtattttagcattcccttttaccgctggcctctcaccatgcattcattggcttgccgagagctcaataaagctataagagcactagcagagtaacagaggaagcacttgccagccacgctcctcttggatctccactcctcacgatgggttctcatcatcgccccaccgcagggcaatgcagcctcg

SEQ ID NO: 31578 - DNA, 1501 bp, Oryza sativa
atcgtcaatatatatgaacagactgtgtctttcctgatgatgtgccgccaaataaaaacttgatttaattttcttttgcagattaccgctagcaatctccctatcagttcgacacccagcggtgtggaattcgtatatacaagtatggttcacacaacaagggtgcaaatatctttgacatgctcatgtttggccacttcagtctcatatctatggatcgaatcagtacggtattagttctcacattttgtgaattccaaacgaccaaaactagggttaaattcaaaccagaaggcattcgaacaattggccaaagctaaattcatgacctttcaacagtaaacaccttgtaatttaccgttatttttttgttgtttctgcagagtttcaggcttacattgctcaccgtgaacctctgtatcggatgtgcctttgattagtatttatttaaggatgactgaacatggcattcactattctctctgtctctttgtttactaaataatgtcccctgacaatgttatactagggactgttgggcagtttgtgcttatgcacgtaacacctgaattttaatatcactagaaaaaacgcgcggctttgcacgcgtggtacagtgagcctggcccattgggcctagtgaacaggtaacaaattaatacgcatatatggaatagccagattaatagtagagataactaaagcttatattagagcttataagttggctataagattgtctctatatttctttttcctctctctttatcttacttataagaatttaatgtgtttaccttgaagcatgtgtagagttagattttactcgaaagccaacactatatatatatattttaatctctatcatacacgtaagtttatagcccactattatttttgttctaagagcaaattttatgagcaagttttatagcagaggtgattgagaccaccaatttattcacatcatcaactaattaattaagatgtagcatatgtaataaattgtctctaacataccggctccaattttcatccaatccacaccattcttttcttggagtttgtgaagagattacccctttcatgaggggtggttacttctcacatactgtcttgtagctcgtgctgcaactaactaataatatgtagtctatttttcttcactctccttcgatgttctatagctagcttattgctttatattgtacttgttctaaggttgcattcgataaagggacaaacaaaggaaacgtccatcatttttcacccatatgtcggagtgtttttacataaaaatatctgtagaaaagttacttttttaaataatcatatttctatatttttcatgtttgaaacagtcctaaatcacctgatgaagcgataatggcacacctcttttacgtatctcattttttccctcttctctcaaatatagcctaaggtatgtttgtaacttaggaaaataaaatacatggaagaaaacatttggaatataaaa

SEQ ID NO: 31579 - DNA, 201 bp, Oryza sativa
ggcgccgtgctaagaccgcgtgcaggcggcaacgctgcaggccggcgcgccgggcgttccagcgcgtcgcgtcgttcttcgtgcaggagctcctggaccggcgagcatccgccggcgctgggccctgcgagcacggcgttctgcatcccgcagtcgtcgtgcgcgaggcgtacgcggaggggttagggatgtacctcgagt

SEQ ID NO: 31580 - DNA, 290 bp, Oryza sativa
caaaattcaaaataaaaataaaataaaatccaaaattagaaaaggaaatgagagtacaagtaggaatacaatttaaaaatagctgaaattcggtattaaaaataaggaatattaaaagaagagttcatataagaacccaatacaagattaattaaaatttagaataaaaataaataaatccgaaattagcaaaagaaaataaaataagagttcaagtaggaatacaatttaaaattagttcaaattcggaattaaaaataagcaatattgaacgaagaatccatgtaaga

SEQ ID NO: 31581 - DNA, 1501 bp, Oryza sativa
atcaccagtgcggtttgggggacttcgtcttctactttcactctggctcattcgtgcacagccgccaaagttaccactatatctagggttaggcttgatttaggaatggggatcaggtgaaccaatatgagtgcaatgagaaggtataatggtcatttcaaccaatatgagtgcaatgagaaggtataatggtcatttcatatattctcagttaattttatctaatattcacaatctcttattggaggcctaccaaatggtcatccagagttggggtatatggcaacttcattttaaaaaagcagaggaaaattcacaaacctattttaggagaacatcacaattacatctaaaagtagtgtcaagaacgtaattgtccctaacttataatggtttggaccattagaaccacttcgatggttcgtcattgaaactgtaaacgatgcccaatgcatatctctactaattaaaagcggagtcgttcgccttccatcacctcttcttactatcgccgtgcattgtatctttcacaccttcatgttcgtaaccaccatctccggtgcttatcctcaatccgccttccctatccatctcaattgaccttcctagcccatcccaaattgtatgggtctggcccattgcaacacacgagtatattatatcagtgactagaatagaccactctcccatcctacctagaacaatttatcttggaggtgaaggaaaatgatgttttatttagttctgttggaaagcagccatattgtgaaaacctccctacgcttctttaccacaaactacctcctccagtcctcccccaccacaacgagggtgccaccaccccttgacaactctgaatagaggcaaccttcactggaacaggatccctgcagtactctatattgacatgtaggttctatattattgctagtgcctcctaatgcagaagaaggcctgcgcacaagttgcttccacttgtatagtcccagtacttaggattgccggttgctacacacttttattggtacattaggatgtaggtttcaatattttggaccaaaatttctagatattatattaaagattcactagttttcatatattctattatctgattctgctcaaaaatttcaaaatttctctgctttagcaaaaggattattcaaatttttatttttgaattaaatataaaatcatggtacgattttttttatggagctacctgaactatagtatcaatcgttaaccaaataaccaatctgtaccagggcgatgcagggcaatggtgccaccaccggcttagggaagaagagatggaggaggagccggccggtttcgcgggcctcgttactcgtaagcacttttaacgtacagccagcaagcccggtggtggcatgctggaacgggcgagacggtggcgctcgaggatgagtacgctcgatctgaagcgctcgtgttggggagagagacagaggggaagagaagacatcaaaataagggt

SEQ ID NO: 31582 - DNA, 1501 bp, Oryza sativa
tcttctccaaagcttctctgactgaaggggggaaagattgagcaagaatgagtacaaccaccgtactcagcaagccacaccagcagatgcatgattaatgcaagggggtacaaggggataataataggggttaggttttacagtaaacagcatttaaaagtcacttagttgcccaaagctattttgtaaacacgatccaagagctacacaatattattaatcaaggacgtgaacctacacgaacttgccttaacccaaggcctacgatgattcagaccgaattggcaacccgacctgggtcccagctcgtcccaagccaacccaggccaacctttccacattttagttgttaagcaaattttaagaattaaaccactaacttgggtacattgctaggcttgcccatatccgatggctcggctattcgaatagatttactctgatcagatgtgtacatctttacccacaagacacatctttactcccgttccatggccttggaacccatcgtaaacatgtgacataacccttcacccatcctagccgtgaacaaaagtaccgacccaaccctgcctactgccggtatcccgggacaggcaggctaggattgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgccttagagatatccatcgtcgcaacgacttcatccatctctatccgtgtccttttgttcaggactagactgagcaccgagttaagccttacccattagacatgtggttagtacggtagtgctttgcaacagaggcccgaagaccggtccttatagtggccgaggtgctactaacaaaaccctgcacctcgagctcagcctaaaaccattttgggagttttgaatagagggggaggtgtgtgttcaattccatcacaagccaaccattccacagtgtccaaatgatatgagcatccctaaagtctaaagttataaaaccacctaatgttgcctaattattcagcgagcatctacctaaattcatactagtggaaccatgaatagagtacccactagttggggttttattttcctagggtgaacaaggtaataataaacaatagcaataataataaggtcataacaaaggtaaataggcatggctaaataaaacagtgataacgcgggaatttaaataaagcgataatgcattaatttaaatcaaaataattttacaaactaggattcaatatgctaaaggatgatgtgatttaccttactcagagagaacggccttccgaaccttcggcgacaaccgcaaaccacgcttcaggaacctccggaacgacagaagctacgcgaagcacacaagcaaagctacaagcctataaagaagtaataacga

SEQ ID NO: 31583 - DNA, 1501 bp, Oryza sativa
agattggttatttggttaacgattgatactatagttcaggtagctccataaaaaaaatcgtaccatgattttatatttaattcaaaaataaaaatttgaataatccttttgctaaagcagagaaattttgaaatttttgagcagaatcagataatagaatatatgaaaactagtgaatctttaatataatatctagaaattttggtccaaaatattgaaacctacatcctaatgtaccaataaaagtgtgtagcaaccggcaatcctaagtactgggactatacaagtggaagcaacttgtgcgcaggccttcttctgcattaggaggcactagcaataatatagaacctacatgtcaatatagagtactgcagggatcctgttccagtgaaggttgcctctattcagagttgtcaaggggtggtggcaccctcgttgtggtgggggaggactggaggaggtagtttgtggtaaagaagcgtagggaggttttcacaatatggctgctttccaacagaactaaataaaacatcattttccttcacctccaagataaattgttctaggtaggatgggagagtggtctattctagtcactgatataatatactcgtgtgttgcaatgggccagacccatacaatttgggatgggctaggaaggtcaattgagatggatagggaaggcggattgaggataagcaccggagatggtggttacgaacatgaaggtgtgaaagatacaatgcacggcgatagtaagaagaggtgatggaaggcgaacgactccgcttttaattagtagagatatgcattgggcatcgtttacagtttcaatgacgaaccatcgaagtggttctaatggtccaaaccattataagttagggacaattacgttcttgacactacttttagatgtaattgtgatgttctcctaaaataggtttgtgaattttcctctgcttttttaaaatgaagttgccatataccccaactctggatgaccatttggtaggcctccaataagagattgtgaatattagataaaattaactgagaatatatgaaatgaccattataccttctcattgcactcatattggttgaaatgaccattataccttctcattgcactcatattggttcacctgatccccattcctaaatcaagcctaaccctagatatagtggtaactttggcggctgtgcacgaatgagccagagtgaaagtagaagacgaagtcccccaaaccgcactggtgattgttggcgtaggggatgtagtcatagtagtcgtgcggaagaagccgctagctttatcctaaagggttcaccggtgatcagcagcaggttagcggcgaccttccggttgccacctaccctgctctgggtcagccaaatgttctccctgtaacgcttaactgattggatagggtttagggttttcagggagaagatgatcctggagagatatgatcatcatctgtccacgacatcggtctcc

SEQ ID NO: 31584 - DNA, 1501 bp, Oryza sativa
ctctattttagaaaaaattagaaacttgaaccaactaaattcgagctaagatgaattagttatgaattttcaaagattaaatcagattaaatcatttatttagattttaattgaattatgacgcaataatgaattatttttgaaaaggaaaagggaattattgcgtcagcggctagggttcacggtgaaccgggtgcacggcggcggctcacggaaacgaacggccgatattgacccatccaaaacggacggccaagatccatcggtccacggccagaccacgagagacgacgacgatgacgtcagcggtgacgtcaccaccggcggcggctcaggcgcgcaaactcgccggcgaacgacggcacgacgacgcgaacggaggacaccaacacgtagagggcgacgcggcgaactcaccggtgaccaaaacaacggcggaagatcaacggacggcgatggcgtcgaggaagaagcggctgcaaccttcggcttgacgacggcgacggtcctccggcaacctacggcgacgacggaggggcggacgaggtcggcgacggcttggcgatcacgacggcagccttcccgagcgacgacgacgacaggatcggcggcggcgcacggctggacgaacggctacgacggcggcgctaggctacacggtgctagggctctaccggcgacgagaggcgaaggcgagggtggcgacaagtagcggaggacttggggggtccttttataggggttggaaggcggcggcgaagacccacggcgaccggcgacacgaaggaaagtctagggttcggaggagagagatcgatccgaatcgaactcgaatccacggatttccaaacgatttagccgacgattccaaaagagaaaaggtagaggagatcccgaagatcttttcccctctattgatttcaccggagaaggaaaggcacgagcgaatttggaaggagacggcggcgcggctcggctagggttccggccgggcgacggcgcgaggaggacgacgagtccgacaggtgggacccacctgtcagcggccgagcgcgcgcgcgggcggctgcgggcggactgggccagcttgggccggggagagggagagagaaggttttgggccgactttcggcccaaagccaaaagaggattttaaaaacctttttcaatttaaattattcatgaaatgcaattccatttattaaaaatacttccttagctcaaataaatcccagaaaaatctaggaattatagagttaagcaaagtatttaatgaaattttatctggccccattttatattggaatttattatttaaaattagatcttcttttctaggcttttaaaataaattctaataattccaattaaacaacaatttatatgtttaggatttttagggtgtgacagtgaggcttcccggtatcgctttagagagcaattgagttgagttttgagttagggtttcgagtttagtcgaaatttttgtaaggtgtgatgt

SEQ ID NO: 31585 - DNA, 1501 bp, Oryza sativa
gcgcacggtggagctgcggtcgctggccggcatggggaacacgtcgatgcagcgcatggcggaggagcacctcgggtgggacggggtgacgacgaagccgaggaaggtcgggacgagcaggtgggacgcgcgcaggctgagcaaggagcaggtgcagtacgcctgcgtcgacgcctacctctccttccgcctcgccgtccatgtcgtcgccgcgccggagccggacgcgacgtcgtctacctcttcttccgagtaatctgatgcattggagaagaaatacttttggtttctgaaagttttttatatggttaagacataattagggtggattaaattattgagttccaattattttctttgtgtacgtgtgcctgggttatattagcagccaactttgtgttcagtgagggaaatcagaaccagatgtcttacatctgcacaagctaagtcttatactgcagtgcacacactgtctaatgaagtataattttagtatattagagatttttgttgggtcagaaaagctttgtgacataggctggaggctcaggtttttcactgagctttctgcacaaagttaatctaatgttttcaccagattagcagccatgaaaaagccagcaaaatgctgaaactctgaacgcaaacttgccatgcatctaggttcataaaatactttctcaacttcccgtctgtttagctgtttacctttagagagcatttttttcgaacggtcaggccgttgccgacgttttgtatataagaagaagatgccccgttttaagaagaagcgagaccaaaccttacaatgctgccttgttcatcagcagtgatgactgacgggatgccaaaatttcttgtatatcctctgccaatgttcttcctgaaaacttaatggcctgatattttatatcatctgggtgactcaaattcagccatggcctgaacctgaacctgaacctgaacatgttcagtttagacttaaaaaaaaggagatttagagggagagtttttaaaaagaaattgtaagcgtgttgaggattgaacacagaaccttaggattaaaaccatacaccccaatcgtttagacttgagagctacagagcatcagcagcgatggccttggccgtctgtgcaagacgaggaggaggaggatggccatcagcagcagaaacagcaagagaggcttgatgtcgagcaggtgatgagcagtgccagctcttgaggcagagccggacatggtcactgtcgtcgtcgacgcggtcgcgaaatgtctccatgtcgtcgtcatccctcctactgatggtggacacgatcatctccctcttccaatcctcgtagcgcgggaacccgcaatacttctccccgaactcgatgtacttctgctcatccatggcgcgccaaatcaatcattcaacaaattaaacaagattaatcatcgatcaagaacaattcgagatccgttttatattagcttctgtgtacctgaggctcgatgccg

SEQ ID NO: 31586 - DNA, 546 bp, Oryza sativa
ctatgccgatttagttaataataataattggtactctagtggtaaaataagtgtaagtgtaagtgaagaataatttgatgtaattgttggtgacttggtattgtaaatttgtaatgtttagatgtgtcatgtatcaccaattgctacattatctaaaaaaaattcaacaattgttaagttgataaatgtggagtgtgatttaagtataatgtgatagatcatagtaagaccattatttgtatataactacgtttgatataaaaatcaaagtaactagagtaccagcttctaaatttatgatgtcaccataatctggaatcgtgttttgatacttacaaggttttttttttccttttgcacggggaatattgtctcccttcttccatttttgtatgacgctgatatacaactcaaaaaaatattttaatatttgacgttggtatatacactgaaaatcattttccaaaagtcatttcaaatgttctttcattttgtcaaacatgtcactgtcagaaacttcctaaacaaaaggatgcagggagtact

SEQ ID NO: 31587 - DNA, 841 bp, Oryza sativa
ggcggggctccggccgccggcgggcggctgggccgcgcccatcgttcatggcgaccggcggcggcattctttttttttaatttgtgatgattcactgagatgtatttgactgagaagttacaaatttgtgattcattgtttggatctgtgatgtatttgagtaatttcttaggatattgtgatgtatttgatttgtgagtataaataactttatgatttgtgatgtggatttggtgatgtgaatttgggatgttagttagatttggggattgatttggggatttgcctacttgattcgggagaaaatgaaaaggaaaaaagaaaaagaaaaagggaccatttgcactgccgctattgtctctttagtcccggttggtaacatcaaccgggactaaagatcccctctctttagtcccggttggtggtaccaacggggactaaaatacatctttagtcccggttatttcaaccggtccatctttagtcccggattcttactcccggttggagaaccgggattaaaggggttcccaaccgagagtaaagatggtttctccaccaatgctcattgcaacgcatggacatatcgaccctaaaaataggaaataaaaaaattctatttttcttccgtcctccgactccagtgcaagccatgagctttccgatgggaagtgcgcagccagtttcatcatccgccacgcctagctctaactcgatctgttttttctaagtacatagggaatataaatagaggctatataccctagatttttttctaaatcctgcactcctcccgcacctctcagctctctcccgcacttctcccctcccctcacctagc

SEQ ID NO: 31588 - DNA, 1501 bp, Oryza sativa
ctgattgcttcaattactagaacattagcgtgctggttggcacgctttccttatagcccgatacattgttcagtgtgtgtttgaaacatgaaaattttataagatattttagcagttagttcaactttcatgttccattaaatattgtattctcttgcatatcattctgagcataatctcctgtaatgttaatttgggattgtgtgttctctacgtttccggtggacgattaattataaatgttgagtttctaataatttcttgatataattaaatactattaagtattaaaaaagtagaaagtaggtggagttaaatattagacggactctaaaaaaaatattagaagattaataagttttcttaaaaaaggactgattgtaggaaaaaaaaagttatgggaaaattgtaagcttacaaagcttgctctcgatgatctataatactcgatccaactcctaaatgctagaagcagaatttgaaattaagttttggcctatgggcggtctttgtgttcactccacccctcatttttctaggtcactacagtctgctcctttctctttttaagtaaaagcagcaaaaactttgttgggcttgagctacagaaaagctgaaaagccctgccaaattgatcagtacgtgtcgtaacactcacctcttatttaattttcttcatgtcttacttctaaccattctgtcattttccaaccatattttatttaataaggggtattgtagttttttcactccatacttgatctccctaagaaaaagggcaggaatattttatacttttggagaaagtacaattgattcgcaagatatgatgataacaggaaacagaaaaacggaggaattgaaatggtcgattggcttggtgctacacagtgatacggtagccgaggagcatgtagctctttttttttattttccttttttaataactctaagttttcttctatcggatatttgaatgcatctaggagtgatgttgctgcaaagggctataatctagatatataaatttggatctagatactttaactggacttattttaaattatgatttttatttgattggttctagaagtctctatgtttattgcaagtgatgtacagtttagaagctaatctggaagcttgcttaactttttttttctaccgcatttatctgaatatttagctgtgacaagtggaccaataggcacacatggaatgtagattaggcgtacatgggagcttagtactcctaggatttgctctggtccaacaaaaagtatctcgaagtatcggtatctcatgttatcaaatcgtttccgatcgttagatctagctaggttggacaatcagaaacgatttgatatcgtgaggtaccggtacgttgagttacttcctgttggacggaagcaaatctcttatataagctagctactccaactccaagctcattactgtgtctcgcttgctctcgtcgacaaggagaagatggtgtccaacc

SEQ ID NO: 31589 - DNA, 1501 bp, Oryza sativa
tgagtgagcattgagcaagctactgatccaacacttaccttgtattaaggagaaataaaaggtgtaaaactgcatgtgacaaagcaagcccaagtggtagctgcagtctgcagatagtagatcacacacaaacacaggtcagcaggtaacagaagcaaaccacatgatataatgagagcagaaaaatggtgctcattaataagaaagttagctgaagcagttggagagaagaagaaagttaattacactcatggagtacacagctactggtgccatgaagaagatactgatcaacttgagtggcattgtcggaaataaaggggcaaatggagaggcatctcctcacatggccctccctacctgtcttctttcattgaccttggatctcctcctcacttccaggttaaagatatgtttttttttacaattgtatatctatcttgatttgattgtgtgagagtttaattgcttcatacagtttttagttaaactttgttctccaaatggggctactagtacaacagttagagtaaaatctggaatgcgaggaagttcttagttttttactcatgttttgtactggaaaatacgaaacgctagcacaaggtctagaattcatttttgtcaatagaaaatggttgaacatattgtttatatgcagctagctagctgtttgagcttttcaccatttctgtttattgtatgattagagctacctaaactagtatagcatttgttctaaaaaaaactagtatagtatttattaggccaactttgcagaaagctttccactgaattggattttcatatgatcatcgtgttgtcacaatcaactaacagttgtcgttttgcctatattatcaatcttgaatgcataagttgacaatatatattttcgcaaccaccacggctggcattttgccttttcttatagggagaactatgaatccttttggtagactaagaatgtttgtgaggaataagaaagggcttttgcttctaaatcacttcaaataatacagctgggcagctactactttccctggctagctccattgatatcataattattcagtatccatatatgataatcatagaatgatgatttgagtatagttcaattgcacactagcactgcttatactactgtaaaggtgcatagttcaattgcgcaagtttagtcagcaatgagtaactaatacagttacaaatgagtagcagcatcatgaaactgaagataatttatagccccctaataaagccagtgcatttgtctcactgtacatcatcaccaaacttcagttaattaccccctaatagaaaaaaaggcagtgaatttatcacattatattcttgagacagagtatggctgtttgcatatgtgtacaaaatgtacaacaacaacaaagctgtaaatctaccagctgcagctgggcatccaacctttgacagtgaagtttactgtcttttactgaagctgaggatgagatatcaagagata

SEQ ID NO: 31590 - DNA, 746 bp, Oryza sativa
  unsure (1)..(746): unsure at all n locations
ctgtcccttganaaccatcttgtgcncgcacgccngcaggtcgactctagaggatcccctttccgtgcgcactttgcatgttgggaacagctgattccaaacacagccttgattcgtttttaagatagaaaagaactaccacagagttgtagtgtgtcaagaaccggtttcctttgggtatatcatgcgtgagtttctctagttttgttgaaacatcaagcttattatccattttattggcagtaaactatcgacttgctatgttagaaaaaacttctcatagaaacgagagtgtcagcaagaacaacctccgcgtgtaggagcattccataagtaagacatgtcataattttaactttggaagaattgtacatctatatctatactaatataaaaaggatgagttgagcctagcaatgcttcaggccaaatcatcgtncctaatccctaccatccatccgcatctgcatcgcatcatcaccctaatccctaccgtccacccacatcgcatcacaaatccgcactaatccactgcaatttcaccctcccacagcgacctcatcctctctccaccgaattttttggcctgcgggctttcccccggccccaacccggnnggaagggaaatggaaacctttccttttttgggggggggttcgccctagcgcacggtgtatcgggccatcgcgcttgcgcgccatcctaaacactccccgcaaacgtcgccctccacccacccctctaga

SEQ ID NO: 31591 - DNA, 1501 bp, Oryza sativa
  unsure (1)..(1501): unsure at all n locations
atgtgggacgttggatctcctttttgtctctttatgtaactaaaagaaaaaagaaacaacggttttgctaaaaaactggcgacagttttttctttagaaaactttcgattttctagccattagatgcactccaggattcgtgcaacatatacggccatatgggtagaataaaaaaaatctcgtgtgggctagacaagcattgaacgagctaggatctatccatcaaacttgccacacgttacgctgaggtacgggcactttctgattattaatagcatttgtagttatatatcacttacaccctaggtacataacacttatactctagttacatactctagttagttacatagcacttacaccaactagagtagttacagggtaattacatggtataaaattaggatttgtaatttttttcagggacatatatatgcatattacttttgaattgaaagttattatcaatttgggcactaagactcgtggtttgtactagtgcagactgttttcctgtaatcgttgatgacaaatcctatggttgaaaaatttgacagttctggacctaaaaacntgtcgacagcacactagctagtccctttcttgggactagctattctatgagaagttcattctaacatagcaagtcgatagtttactgcaaacaaaatggataataaacatgatgtttcaacaaaactagaggaactcacgcatgatgtacccaaaggaaaccggttcttgacacactacaaatctgtggtagttcttttctatctcgaaaacgaatcaaggctgtgtttggaatcagctgttcccaacatgcaaagtgcgcacggaaaacagggcggtccattagagcttgattagttaagtattagcttttttttcaaaaaatggattaatatgattttttaagcaacttttgtatagaaactttttgcaaaaaaacacaccgtttagcagtttgaaaagcgtgcgcgcggaatacgatggagatgggttgggaaccctggattccgaacacagcccaagtctatccaaaaagtttagacaagaaaacacgtaacaagttggtttacaagaatacgaattacgtcaatcctgcactacaggtatagcaaaatggtgatttctcgtaaatctctcgaatggtgatttaagaattcagtgcaaacctaattcttgctgtaaaatcaaatgttcggtaccacaacaacggaacaataaaaagcacttggtgtaccataatttttgtcactcttgttgaaattttgtaatataaaatgcatgaggccacacgaccttaatgttcaacgtgtcatgcattagtgaaataatagctcacaaaacataacgaatatagctagataacggttgcaatccttaccaaactaacgtataaagtgagcgatgtgtcatatcattatttttctagcctgctaaccaacatgtacaccttccgatcccaaaaaatgacaacttctagggatgaacctag

SEQ ID NO: 31592 - DNA, 1501 bp, Oryza sativa
atctcccgagtacttttaccaaatatgaagactgtggagggctgaaaaataaagtcaggtgcgtcgactagatgcacctcataggtgtagcccccgactatgtggttaattgaacaaaccaagcatatagtcaaggaataaattatccaaccaaccaagtggtttcaataattatggtcaaccaagcgacttgatattaatatgtagcatatgcggtgtgaatccctaaataacatgaaccgagtgatataccgactgctttgtaaaaattgatgtgagcaacctaaagttaactacatcatagaaaattcacatagcaaaacagctataaagaaacttgaatgctgcgaataaagaaatttccaaagtattgggcatacgccatgcgcacactgctttaacagacgtgctttagtccctaaaagacacatggtttcaccacacctggaaatatatggcatatgtggtgtaaaatccaagtaaataaactcataaaggatttaccaaccgcctagaaaatgaccacaatgtataatcagcttaagccataatattggtcaataaaaatgcacacttacgtggcaaaaagcaacgatattgtatccaatcaattgcttgataaacccaaatagtgccttgactatataaaaaagtcagcggggcagctatataaagctttactgtttgacaccttttaagatgcattgtaccaactcctaaaaagttgagtaactgcgatataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatataacatgctcccgagtaataaatcttccgggtgatatagaccaagtgtagctcatatcaatagcttctgatctgagtgattatcccttatggaatactccaaaatagatataataattgaatcccgactggcgcaagtattcgtttgtaacccttatggggaataataaatagtccagtctttgagcatagaaaatagacccatgatcacgaattcatattgcatgtatccagagcaagtccaaattgaaggtataatacttgtgtttgagctagtaagcccctgagcacgtagtcacaattgttcattgatggtagctgacgcagttggcatagagataagacgaccgatatagagataatattgcctagcagaggtggcaaaaatattagtggtagtgaagatagtgataccaatcaaaagtgatgaagttgcacagccgtggaggcgaagaaaccagtcggcagcagtcaggtcagccatcaatgaagatgaaggtgcccagcgataaagttgtgtagccatggcagcgaaataatcagtcggtgacagacgaggcagatcaaaggcgatgacgaaatccaccaatca

SEQ ID NO: 31593 - DNA, 294 bp, Oryza sativa
cgagacgcccaacagttgccttcttgtttattaaccgccgaccgggggagtttaattcttgagggtgcaaaatctcccgggactctttggggttaccaaattagggggccatgttgaggccggatatgccttggacacaaaaggggggccacaaaaaagaaaaaatggtccccaaaatttatctcatcattcggtcaacaagggaatagggagccggccttttggggcgggaattccacagcaccttggggcggcgggttaaaagaatttaggttttttacccccaaccggcaa

SEQ ID NO: 31594 - DNA, 175 bp, Oryza sativa
ttcctgcagccctgtttaatttatttatatgtgacattcaattcattctattactgtgagatgtgcaatttagtttatttatacgcttcatttatttataagtgacattcaattcattgtaatagattgtagcactgaattgtgtatttttgttgttttgaaaaaaagtagacga

SEQ ID NO: 31595 - DNA, 1501 bp, Oryza sativa
  unsure (1)..(1501): unsure at all n locations
gcaaaaagtttctatacaaaagttgcttaaaaaatcatattaatccattttttgaaaaaaaagctaatacttaactaatcaagctctaatggaccgccctgttttccgtgcgcactttgcatgttgggaacagctgattccaaacacagccttgattcgttttcgagatagaaaagaactaccacagatttgtagtgtgtcaagaaccggtttcctttgggtacatcatgcgtgagttcctctagttttgttgaaacatcatgtttattatccattttgtttgcagtaaactatcgacttgctatgttagaatgaacttctcatagaatagctagtcccaagaaagggactagctagtgtgctgtcgacangtttttaggtccagaactgtcaaatttttcaaccataggatttgtcatcaacgattacaggaaaacagtctgcactagtacaaaccacgagtcttagtgcccaaattgataataactttcaattcaaaagtaatatgcatatatatgtccctgaaaaaaattacaaatcctaattttataccatgtaattaccctgtaactactctagttggtgtaagtgctatgtaactaactagagtatgtaactagagtataagtgttatgtacctagggtgtaagtgatatataactacaaatgctattaataatcagaaagtgcccgtacctcagcgtaacgtgtggcaagtttgatggatagatcctagctcgttcaatgcttgtctagcccacacgagattttttttattctacccatatggccgtatatgttgcacgaatcctggagtgcatctaatggctagaaaatcgaaagttttctaaagaaaaaactgtcgccagttttttagcaaaaccgttgtttcttttttcttttagttacataaagagacaaaaaggagatccaacgtcccacattgtttcaatccccgggacttagtatattttgcactacttgacgagctctatacatccatggttcctgatcgcctattcgaacaacggtttaaaaaaattgaacttttgcgcatttgttctaatattccccgaaatatactaattcgaaactcggggcattacacaaccttagtgtgtaggagcattccataagtaagacatctcataattttcactttggaagaagtgtacatttatttaaagtcactctttcgtgactgaataaactaagaagcatcataaatccttctttctagttttcacccttattgttgctgctgcacattttgcttctatactgaattagttatgtctaggttatacttctgtgatgcaaagtgagcgaggctcaactaaagaatgccttgtacactacatcttgtcaagaatgatggacaactgtcacgcccagaaattcacgaaccagaatttctaagctgaatgtgcattaaacccatgtccagaaccagccagggtatacaaacgacaattgttgaaatacagatccacgttttaca

SEQ ID NO: 31596 - DNA, 164 bp, Oryza sativa
cttgggtattacgtttccttttatattatggagcggcctaaagtcctgatttgataatattgtaaaatagatttaggaaaccgatatcgtattggttaaggtttctatcttgtaatcctgccccccatcctatataaggtgggcaggaggccctctagggggca

SEQ ID NO: 31597 - DNA, 850 bp, Oryza sativa
agatgttatatgagagaaacaagtgggccatatattaatggtaaatagctatctattatatatgtaggctaagagaaggctgcaacaaattttatagccaacaaatcagctgtattagccttgctcgggttaattactttaagcacgtatttgcgtgttgccgtctacgaagtctctggattgtcatgcatgcatacaggtaggcatgggcatgattaaagtcactcgcaatcttccactggtatcttcacgaaggttcaaattcctgaatgtttttagaaactcatcagatgtgaaaaacaaaatctcagattcttacgggagtgaattggttcctgcccagaaactccgatataaatcaatgaatccaaacaaagggcttattcactttgataccattttcagccataccattttttaaaaaattaattaaaaaatctacgtttagtttgttgtcaaatttagtaaatacataagaaatcatataaaaaatttgacaatattgccatcttgttaaaattttagcaataccaaaatttggtaatgtttattttggctacaatctaaacagacaaaaaaaaaaagtcctgattgtttcaaggaagaatgagcaagagcgataattaccggagaaatcaagtcttttacaaggaaacactaccataataatttagttggaacagtaacagagtgagatcagtaatttagttggaacagcaacagcgtgagatcagtaatttagttggaacagtaacagagctgtagccagtaagcgaaagggcatgtagccatggttaccagtgcctcagtagcaactgagatcctgggttcgactccccatggaagtgaa

SEQ ID NO: 31598 - DNA, 1501 bp, Oryza sativa
cttttactctgttaagcaacttttaatctaaatcattcatgagctttaatatccgtgcaggtttttttagtgagaagcatagaagcacatcccaatacaatttcttttaagttcacctgctactaaaacatgttctgcgacgtggataatgaacagaagataagataaaaccacgaagtatgaaagttaagcactcattttcccattctttcttcccaagtacatcacttatataaagtagcggatccagaaaaaaatagcaggtatcctatacctattaatagtttacttatcaagtaataatattgtaattaacatggccaaaaacaaacatcctaccaggtgtcgtgtgccccaggctctaggttctaccttctcttccacaaccacaaggtcctaaccaaccaaattggacgcatgtatgtgtctttcgctcaccttctactcacatgccgtcctcttttgcattggccacctcggtagttcaatgatcatgcactcgatcgtacagccgaaggactcgatgcaagtgcacgcatggtggacacatgcatgtctgcacagcacactgttggcagtttccactgccaccgagatgccgctccaaagttgccgatccggcgtcaggatgccgtagcgagatttgatctctgtgggcaacttggattggtgtcccggtttgccatactttctgtctgcatctcataacatgttgcagatatagccattgcgtttggataaacacttcagctgtagttactacattttctttatgctgcagctcaaggtaccttggaggcccggacatggaaatggaatctcaaaaatcatggatatgtctttttaaagatcagagcacttcttgtcgtgaacgagttgattgcaggtccgattaaaaagaggagatcccaagtccagatcctataagtcatatgcaatcaggttctccttttggtctgctcttatcggctctgcactcctcactttgtttgctggctctctttcaagtttgccttagccctagactcttgccttgctccaatgtaacagtgcagttcctgtcatcttggtgttctgtttctctctgccataagcccattatccgtctggtgatttcggcattggatggagaccttagcagtattggattatgtccgcatagcatcgttcgctatcttgctggtttggatccttgcagagcttgccaggctgaacaagagacatcgccgagaaggacatggcgacatggtttcatcacaaagaaaaggggaagtcctgctaccagcttatataattgtactttgcaatgcttcaatctccttgatgcatatttgtttttctgttcttgtgttctggaagcgccaaactgtctccctggatttgatcttcaaatcagtctcatggcttctagtgactctcttcttgctctactgcaaacatgaaggtgcaggagttgtatccaactggccttcagttcttctctcgtggtggttcttcagct

SEQ ID NO: 31599 - DNA, 183 bp, Oryza sativa
cccctctgctttagctatcttctccttcccatcgtctcggcgactgactgggtaacccttcttcacccctcgccacagtgcccatggagctctacgccgtggtgaagccgtgcaggctgtacaagaagaggagcagcagcggcggcggcggcaaggtggcgatgtgcgtgcgcagcggcggcg

SEQ ID NO: 31600 - DNA, 256 bp, Oryza sativa
tatacatgaggtaggcagcctaaagccacaaaccaaactcatactagaagtcctaatccacctaggaaaccttcccgttcaagaaacaaactttacaaactccaattataccaaatttgggctccttttaaattcgactccgcatcccatactcacacaatacctccatcgtatgccatatggaatcttcaccaccgacgtgcattgaactctagcctacgtatcccgcatgatatctgaccatctcttttccagt

SEQ ID NO: 31601 - DNA, 286 bp, Oryza sativa
gatccccgtatcattatactctacattatcaatttttttcagaatttttcacaactatttgcatcaaatttggaagaaaaagatatacaaggggatatcccctcgagggattagaatccacactcgattaatcctaacgcgcagcgaattagcgttaccgtattttttttcctttactttcctttttcctctttcctgttcctttgcacgcctttcctttttcctttttgggtaatccgaatcctctccttccgccccgctacccgctacgggcagctcctcctcc

SEQ ID NO: 31602 - DNA, 1501 bp, Oryza sativa
tagtcaaaacactcaagaatcagtatttacgtacacgcagtcttgaaaaactccatccaatccctttccaagcctatgcatttgaagcgcacgggagaaaaaaaaaagatccaatgcattggctcgattctagtcgatgtaccaagttgctcctagttgccccaaatccaaatcaaaatccccaaatcacaactcacatctcacaatcctcattagacaaaaagttcatccaaatccaaatctccaattctccaaatcacactcacatgagacggacgtcaagggcgccgcggcggacgatgacgagcggcacctctgctggtggatctccaaccataagtccacatgccagtcctgtgtgcgcaagcagtggtgcctcgacgagctctgcgcgtgccaagtgcttattagtggttttgtggcataatttgtcttataatagttatgggtgtacctattaggggttttatagtattgtgggtaacatatgaggcctagtgttggtatttctgatgccctcacaaactacacccttaagcacacaaaattcaagcaggtgcaatttgcaaatgtttttacatgtgaatgtgcttcacgtcaaatattcttgttgtttttcatatatatgaacaagcggaatcttcgtagagggtaatctcaccacctatatagcatatggtgagtgtatgcttaggcaaaaaaattagccaaacactgcctaaccctcatgtccactcaggcatgttcttaattagggcatcaaccaaacaccaccctgaatttgtgtcatgactgcacagagaaattttgtaagcaagattaagcaaccctcaggcatggaaaatactccagcaggtttctcgggatagcaaccaaacataccctattgatatctttgacaaaaagctaagtgacggcatcattgaaaaaaaaacaatatttacagatatcatctccaaaaaaaaattggtttgtaattgagtatgtatatcatgctattcgctgttattgtaaaatcaaagtgtgttttaattataattctctgatgaacaattggcatctaagattattggttttgatatctggagatttttggcgaagtggttttggagatgattggatttgcaggtgttaaacaggtgctgttgatttgtcgggttcggtcagatcgggcaggtgctgctagtcagaccggccagcccgcggtctgaccggccgactctgtgttggttttggtttcgggttgtttgtttggatatccgtgattgttttgtgtttatgacttctagatggaaactatgcatatgtaatactgttgtttgctactaatgagtcaagttggaggtagcttcgtctcgaaatatagtttctttgtttgcttcatgtgtatgtgacttgatgcctcgggagagtattgccagtgattgatcgggagtcagcatggggataaggcgatgtccgtgacggtcagatatcatgcgagatacttaggctagttcaa

SEQ ID NO: 31603 - DNA, 1501 bp, Oryza sativa
atttcgccccgcaaattgtttgctgcgtgcctctctccgcttggttttcatgcagtttgaattctgttgtgaattgaatatgaatagagaagggaaaaactgtctgaaattctgaatgctgcatttcgtttcagatgcatggactgatccatcagttctgacgccttagtatttcagtatgttgtttggctaactaaagtactaaaccaactacctgcatgtctgaattcttctacacctgaagcatttcgttcgagtctttgaaatatgcatgtggactgatacccaccagtatgttgcattcttcagcatctgaagaatttcatttcagatatgtgtggacttactgaattggtgggttaagttaaactcaattcttccttgcatgtgttctgctttcttccgcatcatgtagcggatttatagctagttgtgtttgctcactcaactagttgtctagtgcatcgtgtttgtaacttgcaatgctaggtgtttttagtttttactggttaatttggaatgcatgattttatatggtttttgtacgtgtgaattgattagtttcagttaccataaatatcctgtaagatttctgcatttcataaggggactaactactaaagattcttttggggggactatcaacaaattaattaagatcagttgccaactgaagataataatatttcctagaaagaaaattggttaagctcgggaaaaacatggtctgacatgatcacaattcacaaactcttgcggctttgcatactcttggtgcatatgacaagctctagctacagtctactggttttcatggcttctcagcgttttctgttgctggttatttatcgattccttgtaataatgtaatctcctgaacagtgcgttgtttttttctgctttctcatatatcaataaaatggcagagctcctgccccttcactcgatgaaaaaaatatggtgtcacagaatatttactaaaatatccttattactcctagtaattaggcaagttccttggttgccccagtgattccagtgtgttagttttatcaacctattcttagaaggaaattaagacggtgaaaattctcctaattatgaaccacttgttagttgttacatcgtcaattattagtccattcaatttgccggagccggagttgatttaaatcttataagtggtgatacgatcctcaacgaacatggaagagaaaaatatatactgtagtataaataaattagtagtttttagtatgagaaaaaaaaattcaaaacatgtaaacatgaagagatttaacaaccgacaaatacttctcccaggggaaaaaagggaagaaaataggacattgtcctcacaaatgggcctaatcccttacaaatcctcagcccataagccacaaccttctggcccaacacagcctgaaaaagagaaaactctcgtccatgcctagctggctcagcctcccggcgacgccgctgacccgaacccgtacgccgg

SEQ ID NO: 31604 - DNA, 236 bp, Oryza sativa
gacggactgcggaggcacgcgcatcagcggtcgggtttgcagcggcttgggcagtagcagcagcaggcgactgcaacttgggcctaggtaggcgctgaggcggtcaattatggaggtagctacaaataaaaacgacgatggcggaggcgggtgttgcggcggtcgaatatgcagtctattgcggctgagaagccgcaggcgcagcagctaactatggtgatagcagatgagcagca

SEQ ID NO: 31605 - DNA, 616 bp, Oryza sativa
acgaagttagagacccaggctcagaccccagttagtttttgcctgtgaagtgaagttaaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaccccccgagggtgccaggccacgtgggcgattgtgtctgcctcaagcctctagtcatgatactcccggtcccatgtcaccgacaactgtgatgtctctctagtcaccgatccttgcgctgctccttgccctgaccagctaggctttcatccatcatctaggtgttgctcgtgcctcacctctctctggatctcttttaggcatgctccttgcttgatggcttaggtctttgttgttagaactgatggctctcttttggctggcttagcatctgatcttaagcacttccctgctgtcgcagttgttggaattccatccgtagggtccccccatctgccacttctctcttgtctagc

SEQ ID NO: 31606 - DNA, 1501 bp, Oryza sativa
atttgtttcagaaatttggattgatcctccctaagtatgttatgggtttccggatctgaagcatttttcgtttcattgatgcatggacagatctagcagaagaatgttcttggtcgtttggttaagttaacccacttcatttccctgcatgtggtctgctttctcaagcattattaggatggtgtcctactgtgttgtttggttcataaaatttctgtacgtgttctgaattcctgagctctgctccagattagttagcaacaatccaatgcctgaacttttgccttttgttttgagacattatgagagctacagctacagcacctttgcttccttcttgtgtgtgttccatgtaaatttgctgtacaattgtaaatctgcttgagttggcgttgtctctgaacttgtgaacaggggattgcacagtttcagtcgacatgtacatttcttaaaatctggaacttaattttagagagaaaactgaagataactaattaccgtgtgattcaatgtaatccgagtttaatgctgtgtcagcagaactccaggtcactaggccttatttgggtgcctggaaggattcccagggccagatatctgtttgaatttcattaaaggtagaggacatgttcaattttgctttgattctagtgcaaaatgtactaagtggaaaaaatgcatcgtcgcagttttgtctgaatgctgcatttcgtttcagatatactcagtacgtgcgctttcaccaggagagtatggaggatgatgcagggatggattggaatcaatttcctcttgcctacagagaacgaaccagccctggcagattggtggatgaaggcgaggatggcttttcggacgggctacaggagcatcttcgacagtgttttcgcgctaacatgttggctgctgtggaaagaacgcaatgcgcgtgtctttgaacagaaatttcgaagcatagaacagcttgtgcaagatatcaaggaagaggccattgtctggaagatggcaggagtgttcaaaaaaaaaaactagaatattagggaaggacctaatatcaaataattaggaggggtgaggctttgaacccaggttgtctagcccaccaccttgtggagctagccagaagacccctgggcatttctcaatggcaggagtgttcacaacgtgcaatagcgagatcacgtaatatgcattgtaatttgtagaagttttctagcttacgggtcagggattttgccccaatctgttttcgacagcttactgtcgttgtaagctctttaattgtaatgtacccttcctttcttaatgaaattggtcgaccgaacctttcggccgacctggcaaaaaaaagatatactcagtacgttgtccgttgtttggttaattaacccaactccatgcgtatgcctgaattttcttctgcatctgaagcattttgtttcagatagcacttctgtatctgaagaatttcgtttctgagatgagattcatggacttatct

SEQ ID NO: 31607 - DNA, 1501 bp, Oryza sativa
tttctgcacaagagtgttatgcgaatctaacatagtgcacagagcatcaactatagcaggatcagccttgtcactattgctgccatcattttcaaatatatttattcgattttgtatctcattttctggatcgtagatgtagagctgtgcaaattgaggccttctcccttgcgctggtagcaggctacctattttgtgatgaacaacaccattaattttaaaaacataaggtgcacttccattgtttatcgttctatcgacagttgcacccatagaggtgaaagcaaacatagagttgtaagatcgcacctgcctaagaaatctctttgaacgtgcatctccattaaatttcaacaatggtttaagaggttctggaggttcacgtagtttcggcaactctattttaccacttttgcagcacaaattgtaaactatttttcgttttgaaatagcagaaagacttttaaccctctcctagaaccaaaacacagcaccacagtacaaacactcgtacgtcggtgcaccatagtacgacctccccgggtacgatgctgcaagatcatcaatcaataaacttctaacataacattgctaaaccagccgtcgcaattataggggatctaaataaacacaaaccctttaaagcctcaacatgatccttgtgagagcgtgaagaactacctctatcaagctcaacattagctgcagtgaatcagatattagttttaagcaaggcacctagtgtgacatagattaatatacgatttgtgccatccctcacccgaaagaaaggaagaatttcctattcgaagcagacggcgtcgttgtctattagaagctgccaatgcagggctaaaatccataagagagcgagctcttttggtcccacctggcaaagccagggcgctcctcatgcatatttcctatgtcaaagcacgcgctttatgcctttcacggctcgcacgtgctctggatactctatcgcatggccttttcaacatcagtataacatgcctatacaatcagcacagatcagcaacacaaacatcattttactgacaatacatgaaaagctgacaatacaaactgccaattccgaatagccaagagcaatacaaacacagtctaaaaccagataggaacttctaaacacctatatttcaaaagaacccatttgttccatgtcttctacgaaaaaactaaaatacagtgagctacatgtcctaagaacatcatcacaccaaggaacaaatgcaccataagaagatctgaaatgtgccacacaaccagaagcagacaatgcagcctgcacagcatcacgtgccagccgtctgtaagctagcatagagttaaaattgtagtcatgcactacaaaaccataacgatgttggagacacctcagtgctcttgcagcaaccatttcatgtgcgctctgaagtggagctaaggccgtctcccaaaagaacatagtgtccagatgactggcacaaccaatcgacgg

SEQ ID NO: 31608 - DNA, 1501 bp, Oryza sativa
accctacggtagtgtgtctgtccatcgttggacacataagagcagagtggtaggtcgagtgtcttctttccttgaatgcttggctctggcctttccccttattaaaatcttctagccgttgaacttgggatgtgcttttctgtagtctcttctctggacaaactgttctcctccacttgcctatcttatcctctcttattttttttccttctcccattggcagtggtgtagccgcgatgttcgccgtgggagtatctcatgtctcgctgctgaatgccgctgctcagcattgcatgatacctagcattgcgtacctgtgggagtttagctccgatggtacgttgttggctggtattgaagtcagtctcccgtcgattggttgtgccagtcatctggacactatgttcttttgggagacggccttagctccacttcagagcgcacatgaaatggttgctgcaagagcactgaggtgtctccaacatcgttatggttttgtagtgcatgactacaattttaactctatgctagcttacagacggctggcacgtgatgctgtgcaggctgcattgtctgcttctggttgtgtggcacatttcagatcttcttatggtgcatttgttccttggtgtgatgatgttcttaggacatgtagctcactgtattttagttttttcgtagaagacatggaacaaatgggttcttttgaaatataggtgtttagaagttcctatctggttttagactgtgtttgtattgctcttggctattcggaattggcagtttgtattgtcagcttttcatgtattgtcagtaaaatgatgtttgtgttgctgatctgtgctgattgtataggcatgttatactgatgttgaaaaggccatgcgatagagtatccagagcacgtgcgagccgtgaaaggcataaagcgcgtgctttgacataggaaatatgcatgaggagcgccctggctttgccaggtgggaccaaaagagctcgctctcttatggattttagccctgcattggcagcttctaatagacaacgacgccgtctgcttcgaataggaaattcttcctttctttcgggtgagggatggcacaaatcgtatattaatctatgtcacactaggtgccttgcttaaaactaatatctgattcactgcagctaatgttgagcttgatagaggtagttcttcacgctctcacaaggatcatgttgaggctttaaagggtttgtgtttatttagatcccctataattgcgacggctggtttagcaatgttatgttagaagtttattgattgatgatcttgcagcatcgtacccggggaggtcgtactatggtgcaccgacgtacgagtgtttgtactgtggtgctgtgttttggttctaggagagggttaaaagtctttctgctatttcaaaacgaaaaatagtttacaatttgtgctgcaaaagtggtaaaatagagttgccgaaactacgtgaacctccagaac

SEQ ID NO: 31609 - DNA, 475 bp, Oryza sativa
tatattatgggacaaagggagtacctctgtttcatattatgctttgacttttttcctagtcaaacttctttaagttggaccaagtttataaagttggtcaaacttaaagaagtttgactaagaaatagtcaaagcgacttatagtaggaaatggagggagtatgtgtaaagcttaatggagtttttttttcctattctttgcatactatttattactccattctctagctgcacgtctcaaaattaaaaccaatgtcacaactcacaacatagtaaacagtcctgtatgaagttttattcaaggaatagttttaggaattcaaggacagttttgcatttatcctgtatgagacgtggaaactgttgtttcttttgcttccaatgctttgtaggtttgttattctgacaatctcttcttttttctgaaactcagcttttgggccgatcattgttttgtcttggactgctccttagg

SEQ ID NO: 31610 - DNA, 1501 bp, Oryza sativa
attacccagatgaaagaacattacaaacccaccaaaaaacaacagaataatataaccacagtccttatgccaacaatgtgtggtcaataagaattgaattaggttctgatattgcaaaagaagtgaatcaattatgatgagtcaatgacccaattgtgtttattctcaacaaccaccgcagactattttggacaaatgagtagaaatcttaacaaagcagttatcttattcactacagaccaacaaaatggagtgatatacagcaagaaagaggaggaagaatgaaataaacatgcccaccttcacatcagttggctggaagtagatgaagagtactcaataacaatacgaattaagaatccaataccaaacagagagatatcaagcaacatgataactatgcccatctcagatttctataccaacctttaactctcccatagccaagcacgtaagtggatgaaacagaaaggcttacacaggtaaatttatcaactgatgcatgtcaccctgctaaattacaagggaacgaacctgagtaagctaacctactagaataccaaccacaggacaatttggagatattccaccaagataacttgaaacaactattaaggaacaccctaaaacaacatctaagaaagaaccgagggcataatcatgtaatagaacaagtggtatcacacagaaaaagagaagagagaatgtaattgattttttcatgatttcctgttgctttagtgctttagtatagtatttctatgccctagcaacatgcttcaagaaatattgcaaaagatataaatgcaaggactagggagcaacgtcataggtttaaacagcaaaattaatttatcaaatactcatttgagatcaagatagtgcaaaccaggccaaaggcccaatttgtggcaaagaaacagagggagtacagattagtaaagcagtagaggcatcaacaggatatcctattcacaattaagacctataaaattacaaagtaatagaaaaaggggagtatccagagtgctttcgttgttggcctatgccctatgaaggtacagaacaccaggttcattacaactgataccaaaacctaaataatttagggagtggggaaggaccatgagaactttgtattaaaggtaccaacagtaaaacacatagattaacataaacatagctaaaatatgaaaaggtctggaatataagaaaaaatgaacaacttgcatgggggcatatgtgggctgcataaattacaaactttggtgcagcatctgcggtttaaacaaagaaaatgatgctacacctacatagataagatcaggtttgacgattaacgaacgaaaatctagatcaacctcatctactttcgttcattcatggatgtctacaaagataacgatcaatcattctctgcatatttaagatatggttccacttcaccatgctaaaatgttagcatcaggcctcacagatggattgtaaatgttccatccca

SEQ ID NO: 31611 - DNA, 1501 bp, Oryza sativa
tcatagaatacaatttgctcttcttatgagattcgtagaaatccaccctgttccaaccaccaaacaagcattgttctgtactgagaagagcacaacaccccatacataaaattcactttgagaaattaatcaatttttgacaaacatgagttcatcctccagcagtccagcacacggctcgttggactttttcactgagaaataaaaaggaaatccattttactccccccaaacttttcgttgaaatgcttgaccccctaaataatttttcagctcattttacactcttaactattgaaaatagttcatcttactccctaacgatatttgtccttttcgtttttctatataggtcatattatgcaatgaaatttggtggtattgatattcattagaacttatctctcaacatcttttggaattgttttcgctgtttacataggttgaaagcaataaaactattttttttttgcggggagcaagaaaactaatttaaacatagaggttttaaatatcaagcaaatggtcgtgaaaaaaaatttaaaattattttagaattttaatattggtgttatttatggcactacaaaatctaaagctgaaaatacgactcatataaatagaaacaagaaaataacgagtaaaatgaatcgtttataatagtttagcaaggtaaaatgagaaaataactagtttacaaagttaagtgatccatcacaatagttcgagggagtaaacttgacttttcttaagatactagtgtattaagttgcgtattcgcgcagctataaactccctctctagattgcggtagtaataataagcttaaatttgtaatgatgattaatcataacctctttaaatggatgcatagctgatagttatatcagtatatcacacacatatacatatgctcatcactgttagatatactttgaatgatataaagcttagtcggatcatattaatctttattaaaagatgaggtttattcgtaaaccatgtgaattgtaaaattatatgcacaatatttgttggatctttctaaatataggttaatgatctatttgcaatttttttcctcgcaggaaagttgcatagtttttaaattaaaagtgtacattgtaaaattatatccataaccttactgttttttcttagtaggttaagaaagcttctagacaaagtgaatccaatggctcatatttcttcttactattttgtcttcatgtggattcaatggctattattttgttaattatgtagatcatcctagttaattcttgggattcatcattcacttatagatactactatttgagggtgtccaattggactttatccccgttcaaagccctattgcgtccacagatgggcctaatagcccacaagtgtcccttttttttttctttttatattttttgcgcgcgacgaggaggataaggagctcgcgaagccgcgcgggccactccgccgcctcccatgtccaccgccgccgccg

SEQ ID NO: 31612 - DNA, 1501 bp, Oryza sativa
ttaatggattcctgatgcttatcttgaactgatgcatataaacatgcattacatagcacaggttcctgaatacaaaagaaaaaaaaactccagttagcatttttattttcatagaccctgcatgttggaccttcacataaattagattaaattactttaagcataggatgtatagcttgaatgagtctgtatgaaaaaaatactttgggcattttgaattattgtaatgatgtatccacttgattggagcgttggccatttttagtgcttaaatgctacttgagggtttcagttgttccattattttgttgcgcaatgcaaattgtaccttcttgctccaaaaccagacataataaatactgcaggggagtggtgcagctcatatcttgtcatattatccctttgatagatatattcagcaatatgcatagctattttaattcctcattgaatagttaggtattttgttgtccaaaaattcatctgaaatctgcttgatgttttacagtcctttggttgtccttttccactattgatttcactaactttctgtatgcatgcatgttataatggttctttgaacgaactagattaacacagaatcatgtcacatttttgaactggctgtttccagggtttggccgcagagaaagacaacctggatataatccagcatgactgggctttaccaaagatggagcatcatgctgaggaagtgctgaggaagcttctgaagaaatgataggaaactaggctgctccaatgcattactacatcttgcaaaatttttgttttaacctgtttattgaccagacagttaaaactttgtatctgtataacttatggccaagaatttccttcagaaagtttatgtatcatttttctgttatacggaccacagccaggctcaatgcagaatgaacaaaaatcttttttcttggcaaagaggtactgactcagtaaatttgattgcaggcttagcattagtaattcctatgagctctcgttagttgcacaatacaatattatgttgtggcgatgtagttttacactggagaatgcccatgcttcccgagcttataaatggtgcaaattttataacaactcttcatatgaatttttcaagtactgttttaaatccacttttcaactttatttaattcattcatttgtagtctcgaataattatcagaaatctaaatcattacgctattcatcataaaataaaagctattcagcacaaatgaacgtggtataatgcccataggatagaaatgcacaatctgaacaaacaagtttatcatttaatggcaaaattagtcagataacaccgaaagttttcgttttggttttatagcaccaaaatgttcttgttcactttaatgaaccggaagtaactttcaatgttattaaagtgaatcggaacctttcggtgctataagaccaaaacgaaaactttcaatgctctgtaacccatttaacctaatttaattcgtcaata

SEQ ID NO: 31613 - DNA, 157 bp, Oryza sativa
tcctagatttttctgggatttatttgagctaaggaagtatttttaataaatggaattgcacttcatgaataatttaaatgaaaaagttttaaaaatctctcttttggctttgggccgaaagtcggcccaaacctctctctctcctccccggcccagg

SEQ ID NO: 31614 - DNA, 867 bp, Oryza sativa
catcatctaaaacaagagttccgccctctgtactagcttctataacagagacaaggccttcattctttgcagcaacctcagcagggccttcatcaacattttgttctgctgaagcctggaaaccagatgcatcatctaaaacaagagctccgtcttgtgtctgattctccacagggggagttccattgactgtttcttccccgccatcaataacctccccctgaagggcctcagcaagcctcttcacaagatcatccttcaaacctttaatagatagatccctcctacggagctcatccttcaattcagtaaccttccactcatcaattggtcggtcattcagcacaggacacgttgacattgtgactgccaaaaattcacacttatcacaatcaaagtggctatacaattaaataggaacaatgtgcagccttctaacatgtagaactggaaattacagttataatgaaacaagaacagactgaataactgtaatcttcagttgaaactgcacaagtatgtatatagttaagtcatgccatgtatatgcattcttgcattaggaattctgatgaagtagcagtttatatgcagacaaaatttgttcttcaaaagatccaactcccagattctggtgaaaaattcctatactgatatgctccatgtcaaaacagaattttacatttgatacgagctgtatgctaagtacaagggagaaacagctgagaacaattcctatattaagcatgaaaacattacatacgacatttccgcacacaaggaacatgcaaaacaacatgaggcagttagagacttcactttagcagcatacccgaaacacatatacacataacgcattgcagacgt

SEQ ID NO: 31615 - DNA, 628 bp, Oryza sativa
cttggccactgacgagcagttgctgctcttgttgtgcactgcacattgccttttagatgtagcagctatactttctgaaatgcaaaactggaccgaaggatggtacttccattccaatggatgatttgtatatcttttagtgtcttagcaacttcagaaacaccaaactgttgtctgatcgaaaaatatattctcttgtaaattctaaacattcagaattacccgacttctccattttcggcttatgatggaacttattatatgaactcttacctatatcaagtcagatgtggggtattggtacaaaacttttacttgaatacaatgtgtgctagtttctatacagaattcagtcctctagtaaaatgataaatcggtgtgctggaggttaaccaatttgctgagactttggaaaacttgtgcaaccattgctctttccagcacaattcacatgcatatgcaatgttatatgcttgcacaacagatcatctccaagcacactctctgcatgatgaacaggccataggatttatcactgatactccctcctacaaattatataaaccatatgttcttgcaatcattgctgcgcctcataccactcagtgttcaccattgctgaccctcc

SEQ ID NO: 31616 - DNA, 450 bp, Oryza sativa
tttgggatctgtgtgacttgccttgctggccttgaaactcttcaaaatcttcccctgtaaaatcggactctccgggaacgtcggaatctaaagagaaaagaacaaaatcaccaaaacaacacttaaacaagcatgaacagtacatgtggatatttttaacatgtagatctcaattttagaaaaatttagagacttgaaccaacaaaatccgagctaagataaattagttatgaattttcaaagattaaatcggattaaatcatttatatggattttaattgaattatgacgcaataatgaattatttttgaaaaggaaaaagagattattgcgtcagcggctagggttcacggcggcggctcacggaaacgaacggccgggatcgatctatccaaatcagacggccgagatctaaacggtctacgaccggtctacggcggatggcgtcga

SEQ ID NO: 31617 - DNA, 214 bp, Oryza sativa
tagcggccgcgaaagcgaaagccaacacgcctccgtctccgactctccgcctcctccgcgctataaaaaggcgcccccccataaccccattcggcttggaccactcaccgatcaatccgtctcgtctcgttccactgcttcaccgcgagcgaaaggggagagttggggttttgcgagcgagatcgagcgatggcgacggggagcggagcagcgg

SEQ ID NO: 31618 - DNA, 498 bp, Oryza sativa
tgtttgaaaaagatgttttaaggggcccaattgcaaattttaccactcttttaaacactattgtaaaattgccactagaaaattgcaaaaatgccactagaactgtcattcgagtggcatccttgcaatattgaaaaaaccgattggcaaatttgcaaatgccccaaattagattaacatgcaagcatattcaatcatcacttctcacattatttccacaatagttttacaaatctctctatcatttttttaatatttaatatgtacatatcaatatgttttacattaaagtgtgaatttgataaatattgataagccctaagatttgattatttttttctttttactcctagctgaattataaaaaaaatagcattaaaaaattacttagtaatttccgcagtaaatcgcagggaatcccctagttataataattggctgtgacacgtagagcagcagaggtgctcgggggtaacgatgggttcatgcacaaaaaca

SEQ ID NO: 31619 - DNA, 1501 bp, Oryza sativa; identical to SEQ ID NO: 27321

SEQ ID NO: 31620 - DNA, 159 bp, Oryza sativa
ctgcaacaatacaatttccctgcagggtcctacatatatatattacactattcgtctccacgccgacaaaacaaaatatttcagatctccatagagatcgacaacgccgacaaaccctagctaacccgtctgcattaagcctgtgaatcaaggcggcca

SEQ ID NO: 31621 - DNA, 1206 bp, Oryza sativa
ccacaacccccacatgtgatcaattaacattatctaccatttattatcatcctaattacctcaacactatctaagtcctaactacagtaattaattaggttctccaactttattggcactcaacagttgtcggccccgatcgatcaacttcatgcatgtctccaaaaggccataattaatcattatattggcatgtacattcatgtgtgtgctattttctcaagcattctgctgagagagagtagtgagattgatgatcgcttgcggaggcatcgatcgagcgatcgttgtcgattcgatcgataggattagttgtgcatgtctgcgttggtttgcaactgtgggctctagctgcttaactatcatgcaattctggggcgcgaaagctacgtatcatgctacgtatgacagcactacgtgtgctagagcgtggcaggttttgtggcctcaaaattaaggctctgttttgtttctaaaacaaaaaatttcacgctgtcacattaaatatttgaacacatatataaagtattatatataggaaaaaaaatcaattgcacagattgcgtgtaaattgcgagacgaatcttttaagcctaattgcgacatgatttgacaatatggtgctatagtaaacatttactaatgacggattaattagggttaataaattcgtctcgcagttttctggcagaatctataatttgttttgttattagactacgtttaatacttcaaatgcgtgcgtatatccgatctgacaatcaaactcaaaaattatctccaactaaacaaggcctaaatgccaatacacttggttgtaaattcaccaaattattattttttaaatgaattgacaagctgtcaattttattgaataaagcaggaaattttcaccaaattattactagtactgataaataataatttgtagtattcatgaaaaggttgggtagctatagctagtaaatttaaagttgactctagtcattagtggagtccaatacatgttgattagttaaagagaggatctgacacattacaggaatcccagcctttttcttccatgatagtgatcgaagccatatgctgagtatataccgatcgtatgggtacatatatattagttctgcattagcttatgatgcaatgcatgtacgtagttctttttttatgaaaaaatatcgctatgttcatttgtctcctagc

SEQ ID NO: 31622 - DNA, 1501 bp, Oryza sativa; identical to SEQ ID NO: 27322

SEQ ID NO: 31623 - DNA, 1501 bp, Oryza sativa
  unsure (1)..(1501): unsure at all n locations
gcttatcaactcgggggctgatagtctccggctgaattttgcgatactatgcttttgtacatggttatttctgctacggtgacattatgtgttcttagaattttgaactaaaacgaagcagcaaatggaactgtgccttacatgatgtttactagttttttttgcatacgtatcttatatagcatatccgcaacctgttacgccccaatcctaatttgggtgtggtgggggggggggggagttggaccgtaatcttcaaatcgtgctggtgctgcaaatattagttaacgccgtgtttagttccaaaatattccttaaaacttttaactttttcatcacatcaaaactttttcacacacataaacttccaactttttcatcacatcatttcaatttcatccaaacttttaattttagtgtgaactaaacacaccctaagagcaagtctaatagtacagcccactactagctccaattcatctataaccaatctaatagctaatttatacaatagttacttactatactattaatatatggtcccacctatcatacacactgtgtgtcttggagttcgtgctgcagtggctacagatctgtagctcgctgctcttctctcccatcgtttatctcattaaaatatgtttgcagctggctaataacctgctattatacctgctctaagtgccttcatataagagcaggtacaatagcaggctataagccagctgtaaatatattttaaggagataaatgatgagagagaagggcagcgggctacatatttgtagtcagctgtagcacggactccaagacgcatcgtgtgtatggcatgtgggaccaggtattaatagtatagtatgtaactatgtataaataagctattagattgactataaatgaatgaagctagtagttggctatatactattaaacttgctctaaaccatgttgcaaagctttaataagaaagtttctgggcatcggttcggagctttctccaaagtaaaatgcgcccgctagcgctgatcatgtcagtctgctcaatgccaaaaatctgaaatgggcttcttaagtcttaacatgtgcagataaagtacagctacaaaaggaaaactcgttcgtcacacgctacagcagcaaaggaaccaaattaaactttcgaaaattttccaaattttcgaatttggcaggagtcatttccaagattttttttccaaattttcgaattcggtgggagtctacccgcctcctgacacacaccacccaaataaataacagctggctttggaggaagtgggacgacgaagagaagtggattcttctcttctttttctacaagcacctcctatttgtctgcgtagctagcaccagcctcccaactctcctcgcccccctcctccggaacgtgctcctctaacgtagaggaatctacgttagagggacgtccaacattggcgaaaattcncctcgcngccgctatcattcaacatctgacggt

SEQ ID NO: 31624 - DNA, 186 bp, Oryza sativa
tcatgctaagatcctctattgatgctaagattcatgtatataaaatctagcccctacattcatccaaaacatccacagacaacaaatcacatttaattcatctatacagcagcaccaataatcgaaacaacaaatcacatttcattcatctaaacaatgcaattcatccatcgaaaaaaggaggaa

SEQ ID NO: 31625 - DNA, 1501 bp, Oryza sativa
tcggtaaatcccgggaattacgtggtgaggggttagggtttttttggcccattcgacacgacccttatacgagaacacaaacacgtagccccaaccattccgccttccgatcacgaaagcgtattcgttctggcccgtttaggacgagcctcgtaggctcgaaggcgggtttcagtttttctctgcggctaccggaggcgtattttccgcataccgtggcccacctgtcattgagagtagtggctgttccgctccgagacaaggactcgccatacgactccacaacacactgcctcctgagtcctgactccccccgagcgccagtctctctctctctctctctctctctctctctcctctcgcacgcctcggcggagcggagcggagagcaacaaaagcgcaaaaaccctcgtagagatcgaaaccgccgcggcggggtgggatcgcgtgttccgatcgtgcggaggcctcccgctcttatcgagaggctttcgatccgcttgcgattttttttctgggatttttttggtgcatttttttcggtttttttgttttccatttcaggtggcgcgtgggggatcggtggattcctggagttgctggtcggtggaaatcgtttctcttcgtgtgcgcgtttgcgtttgttctggggtttttgttttgggtggtgggttttgatccggttgctgcgggcttgtaggttggattttgcggtttgggagaaaggtggtgattcgctccgtacactgttgagatttctctgtgactctgcgttggtgttgttgctaggtgagctgcgagcttccgtccgtttgcgatgtgccgatgtttagggttttacttgagggtccatttgatattccttattatgttttagagcacaatctagggttctagactggcatcattacgctgcatgtaaatgtattatcaagttgggggttagggatttaggtggggatcacttgtgattggggttgaaacctgaaagtaatcggagacgtctgcaatgcgttatgtgtatatgtgtttcgggtatgctgctaaagtgaagtctctaactgcctcatgttgttttgcatgttccttgtgtgcggaaatgtcgtatgtaatgttttcatgcttaatataggaattgttctcagctgtttctcccttgtacttagcatacagctcgtatcaaatgtaaaattctgttttgacatggagcatatcagtataggaatttttcaccagaatctgggagttggatcttttgaagaacaaattttgtctgcatataaactgctacttcatcagaattcctaatgcaagaatgcatatacatggcatgacttaactatatacatacttgtgcagtttcaactgaagattacagttattcagtctgttcttgtttcattataactgtaatttccagttctacatgttagaaggctgcacattgttcctatttaattgtatagccactttgattgtgataagtgtgaatttttggcag

SEQ ID NO: 31626 - DNA, 1107 bp, Oryza sativa
aaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttaaccaatttttaaagcaagcaaaggggggaaaacttcagggcgtgacagcccgaagacccgcagtgcgaggatttcgaggatcaagctccagatctcgagcaaggcaagctacctttgaacatcttgagcctatatttgaaatttaattatgttgcttgaaaaatattatgcattgataggatcgcacttaatctgtttgtcccgtctgcaaggcagattggcggacctatctaatttgttgtatttgatccttcttttgttaattgttataccatgtccccttgtaaccatctagttgcgtctcgatattcgtgcaccctgtgcgagtatcgacggacgccttcaaacttaaaatctgaataacaacttgcgtaaaacttgggttttacaaaagatttggaaaacccgacacctgggtcggtgcttgcgaactaaatgaatttccaaaaccgcggaccggggaacgtaccgggtgtacggtttcccgctctcgcacttaaggaccgatttccttggaatttcatccaaacataagacaagtacgaccacatgggtggaatgggacacccttggctgagtaactagcttatcaggggagccttgatgccgagagacatgtggattcgccggggtggtgtcggggaggacccctgggcttcttggcacagtatggtctgggacctaacctgttgttggtctgggactcctctcgtcggcatatggtaaacctgtgtcggctttggaaatgccttgtcatgaaagcttggaggtctcccgacgtggctgatccccacgggctgggtgatccgggttagtaatgtcgtgtgagtaaagtgtaccccctctgcagaggttaacaaactgttcgaacagccgtgcccacggtca

SEQ ID NO: 31627 - DNA, 1501 bp, Oryza sativa
atcgatatatatatatatatattacatagcatatgtacatgtctagtgttcataatattaaaaatagatgttttttattctattgcatgttctctctcccactcccttaggtttttgaattgggggtccatagcaagttcgctgtaagggtcatagaactcccttggatggttgcggatgttgcaacgaatgaaccggcataagtccgcgcagatgttcagaagcgttttctggtcgaaccagtttgctgtatatgggatgctcggaagctatggaaaatagaagaaaaatgatatgtgttaaaagcgacttaaatgactatttcctatatgtaaggagcatgatgacttatatctgtaaactcagttatgtatctcccacggaccctgagcatctcgcacacttaatatccccataggttggtactgttgggttgcttgtaacactgcgtaagaacagtagacacgtcagtaataagaacaaacaattgcatcatatacttaacgaatatatatatttgattacataccggccagcgtccctttacgagaagtcttgtcctcttttgatcctttacgaacccgccatgttttctgtaatagtcgtgttctctacaaagatgaaatatttgattgagctaactttatctttgatcctttgctttcttcctcttgattgccttcttctataccttcccgaacacgaccttaatcttcttggccatgtcgaagacttgtgcaccagttcatgcttcaggaggaagatcgttctctacggacttgtcaaataagttggccatcttacgccacttgtgcctctgtggtaagaaccgacggtgacgcatgtacactgtcttccttgaggaggtgaggtacctgtatgacgtgttgtcgatacatataagacatccgaacttcctcttaagctatcctgggagccaaaagttaaccggcaggtcgttgatggtaatgaatataatggcacgtagagtaaaatgctccctacagtactcgtcgtacactcgtatcccttctttccaacgcttcccaattgtcaaaccctcatcttgtactagctagaacctctggttcaacgtgccacaacatatcctccagatcaaaatcaatatatgtatcatctataccagagccaccacattttgggtgaagatgcacttaaaccccctagtgggttttggtgattaatgacaatgtggttaaaggggactaacgtgtttatcaagtttattcacaggagtttagtcccaaagcaagttgtgatgactaagaatgcaaggagaccccccaattcgaatgttcctaagtgcgaaaatcgctgtaggtgattagactaggtttttcactttcgaaattgagtttaggaaaaaccgtactattaagaggggtttcaagtgtggttctatggtatacaaagtgctcttagtcatatccatgagtcaaaagatttttggaatcatttttgaaaaatgattttctcccca

SEQ ID NO: 31628 - DNA, 611 bp, Oryza sativa
gattaaacatgtttaaagaaatcaaaaaccaataacgctatttcatcgacatgacctgagtaggattgacatgacagtggatgatgagagtgagatttaccgcggctccggcggccggagcttcaggcaggccagcttcgcccaggcgcggacggcgtcgagccagctctcgtgtccggcgagcccgatggccagctccaccggctcgcggcgggggccgccgtcgccgtgacggccgatccgcgtcgccgccggcgtcggcggcgacagcaagaacacgacggccgacgcggcgacgaggaggagcacgagcgccacgacggtgttggccgtgccgctcgccgccgccgccgcctccgccgttttcccgccattgttgttccttgatccgcccatggctgccctactcgaccgatcggtgaatcggtgatggagatcgagagtagaagaggtgaactagagcatggattagctgcgagttttcttcgcggcggttgtacacgtcgggcgcacgtgtgggtctcccggaggaacggtcgccggagcagggagcgaggcagccggcgacgacgccacgtgccaggccacgtaggcagcagctgcctgattaa

SEQ ID NO: 31629 - DNA, 1501 bp, Oryza sativa
tccccgtcttctggtaagcttcgcttcgtcgccgccatctcgatcgcttgatttgatgattgattcggattcggattcggaataggaactacaactatggcgcggcgggcgacgggatacacgaggacctgctccaccacccggagtacctggagcagaacgcgacgatggcgttcatggcggcgatgtggcggtggatgacgccgatgaagaagaagcagccgtcggcgcacgacgtgttcgtgggcaactggaagcccaccaagaacgacacgctcgccaagcgcctccccgggttcggcgccaccatgaacgtgctctacggcgaccagatctgcggcaagggctacatcgacgacatgaacgtcatcatctcgcactaccagtactacctcgacctcatgggcgtcggccgcgagcactccggcgacaaccgcgactgcgccgagcaggccgccttcaacccctcctacaagaagcccgacgatcagcagcaacaaagctagaacagatcacccccaattccccccaattccacggtaaagaattcacccaatgtgttgttgtatacatcttcttgctactgcaatcgctattgccaatgcaaaccaaccattgccattgctgttgcctcgtgagctatacagattaacggattcttcatcagtgtgaggagctgtggtttgcattggtgtatttctgagtagcggattttgagggaagtgtcaactgtgtgtgtgatgcctatgggatttgggaaatttgttgtagcccttgttgtaccatagtgtacattttcattccatttgatttttgtcacatatacatgtttaaagaggaggattcaggataaacataccatgattttgatgagcttgctgtgtatctgttattgaggtgtgtgtagctgtttagcatgcatgcaatagttttcatgcatcagtgcgtgataatgctgtgtgtcataatttgggctgggtaaaaatactcagtcctcagttacttctcgctattgatctttcagctttgatcattaacaaacaattaatttacgataaatgaaagtagtatggttgtacttatggcacaacaccttgccaatatggtataccttgaagtgtacataaactttgtaaaagggacaggcggtcgaaattaaataaaagtacataatatccagtgacatacttcaatccagagggagtatttgtcaagtgaataagagaacatatgccaacaaaggaatgacaaatacttgaatccagagggagtatttgtcaagtgaataagataacatattgccaacaaagaactagtgaaaaaagacaagctgatgtattgctgcagagccagattgttgagcattgccaactttgaacttccaaaagaagctcagccaaaaatgccacagaaattatattactagctacaagggcatggatcatgctccaatttggccatgcttgactgcctgacgaactcaaccagaaatttcaccatc

SEQ ID NO: 31630 - DNA, 1029 bp, Oryza sativa
gagatagaactgtgcagccgggatggttgttcagaatggttgggcctatacaacagggtatgttgtatagcgttggattaatattgttaaattaattaactgttttgttaaattctgaaatgtttgctaaatgctgcttttgcaaatgaaaccctattatgccatcctttgttatcctgtgcacttgcatatttgctacgtggcttgctgagtatgtcatatactcaccttgcaatcattcatcagaggaagagttctacaatgaggctgatggagtggaggattaggagtagccttggtcaagctgcctgtggagtggagccgtctgcgccgtttattttattttccgctgcttagatctttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatccattactgtactaatggctcatttatcagcaaaagttttacaatgttgttttatttaatcttgctgcaataaaataaatttagcatgttgattttataactttcttttgaaacctgttgttaaaaagtacaaaatttgtaaccttgttttcaactatttcaaattatcttgcaagtttggtttactttattcacttaccttttactttgaatttctaaactttattcaaattaatccaaaaacttgtgctattaattggataaaggtcttaactccctcctttcacttgtctttaga

SEQ ID NO: 31631 - DNA, 1501 bp, Oryza sativa
tttctttttatcatgtcatctaccaatataatctaatcttttccggaggttgctttaatcttctgtctccgttataaatcatttgtaaattgtttaattaatttggaatagtcttttctttaataggtttaattggaatttaatcttgtaaaattcataataaattcatatgaaatcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgcttgcattgattactttaatccttgataccttgggttattataatttgactagttgagctttatatattagttcagctagatattagatgtgattgcttagccatgcttagaaacattagcacactattgggataacttatgattcgttattatttaatgatggtttaatggtagctcacgatggtcaaacgtgattggttaattaattacttgccaactaaaacttgataatggtgggttgtgagcacatggttttgagagtcgtgctcatgacaattaaggaccggttcgcgaggtactgttgtgaaacattaaccgtaccaaccacaagccagcgtgggcaacggctttaccttttgtatagcatggttcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgaacaatgtttttcgtgattagtctcacacctctcacaataattatggatgctataactggtaataatttgcttagctcctggtttggagttaaatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgccatcctttggtatccttgtgcacttgcatatttgctgtgtggcttgctgagtatgtcatatgctcaccttgcaataatcaatcaacctca

SEQ ID NO: 31632 - DNA, 963 bp, Oryza sativa
ttactatatttgtctataaatttagtcaaacttgaaacaatttgattttgactaaagtcaaaacgtcttatataacctaaaatggaggaagtaggaaatatgtaattctaatagatattgaggtagagtatacaagaaatacaactatagcctccttttatacggcttgaatatattagtaggggtttaggatatcattattcgaccaccggtatgaatcttatgagtatctctcaaatgacaaaagactattgggtttgttcgctgcagctaaattgcagctgctgtgcagcagctgtgctacagtgcatgatagagaaagtatataaggctggctgtacagcgcagccgttacagctgcatagcagcattgccgaatagacccattaataacctttccaaaaaaaaattaaaatcattactacatatttttaagataatcacctactccatatacaaatcattttaggaagcaatccattgttgcctatcagaagcgtgattttacaaaccgtaacctgattttacaaaccagtacaactgccattctttaccgttccctttgccccatcctcaaaaacctgcacgtgccggtgccgccattctgtagggagtcgagtcgtcgtcatcatcttctcccaaaacagccatatggccccccaccaactttaaaaacccctccacctccgcttccgcacaaaaaattccctttacccccatctcacactccaccccccctctctctcgtttcctcctctccacccaacccaacccaactcggtcgtcgtcgtcgtcttcctctcgaatccacggttcaaaaattccctccactcgcgcccatttccccaaaccctagccggccccggctcgccgccgcccgccgcccgccggctgcctacctcggcctgccgggatccgtgcgcggaacatgcgggatcccggaccatggcgaccggacccgat

SEQ ID NO: 31633 - DNA, 1258 bp, Oryza sativa
ggaatgggaggaggaagggggaggagaggatgaggggaggagttggagaagagagttagagaggatagatctgaggagagggggtgagattcgatctgtctacgttgtaactgtggaggagaggataagggataggaattatatactacgtgtttaattttagtcccggttggtactcccaaccgagactaaacatcatcttgatctttagtcccggttggtagtaccagccgtgactaaagtggtgatctttagtcccggttatttacaccaaccgggactaaagatcctcggcctcctgacacacatttgacaggggatgaactgggactaaagatcaaaatttttataaccgggactaaaaacaatctttagttccggttctttttggatccgggactattatggattttgccggaccgaccaaagatggtttctccaccagtggagttatataattttaattgtacatagtaatcacattttaattgtacatagtaatcaccgtttgcaacgcacgcgcgtttgtaattaaagtcctatacaacaacacatttcatctaacagaaaggaactttacagatggtacaaagtcaatatgaccgtaggaagttatcatgtacccaagattcactagtttgctattgcaggcttacatgaagttatcatattacccttataaagtttatgaccttaggggcatattaaaacattttagtggtccccaagtaacatttgatgctaactggtgagagcagttgacgtggttcccataacacttttctaaaatatatgctttgctggatggtacttttcctcaacttcgattgctcgagtcgaacacttgtgcctggacttgaatactctcccatcttttagctcctcgtcacttcacttgtcttagccaaagaacctgctcaaacacaatgcctttagtgatgccaattcgagcaagtaatcttgttcgaacacattttccttggaacaggccctattgggcgaatgcaaattcttggtcagaaacggctacatattagaatttgatttgagcaaagctcaaaaacactttcctcatcatgcgagtttttggccgagtataggggatggtgttcaccccctgctacaacagtaatggccagcgataactagagactgggatgcacataaacgtacagtatcagcacttaacgatggcattatcagtcttcggacacgcacatatctctaaactaattgtatggtgagaaaatcgaatgta

SEQ ID NO: 31634 - DNA, 1501 bp, Oryza sativa
cattaattacgctaactcctcacgtcgtctcgcccgcaaaatgcttctcttcctcctcttcctcctcgccgccggcgaggccgcggcggcggcggcggccaccacgctcaccgcgacgccggcgaagctcacccagtccgaccgcgagatcacgatccggtggtcgggcctcccggacccggacggcctcgactacgtcggcatctactcgccgccgacctcctccgaccgcgacttcctcggctacctcttcctcaacggctcggccacctggcgcacgggcaccggcgagctcaccctcccgcgcctccccaacctgcgcgcgccctaccagttccgcctcttccgctggcccgcgagggagtactcctaccaccacatcgaccacgacgggaacccgctcccccacggccgccaccgcgtcgccgcctccggtgaggtcgccttcgactccccctcccgccccgaccaggtgcacctctcgttcgccgacggggtcgacgagatgcgggtcatgttcgtctgcggcgacggcgggaggagggtggtgaggtacgggccggcgaaggaggagggggagggctggaaggaggtggccgcggaggtgaggacgtacgagcagaagcacatgtgcgactcgccggcgaactcctccgtcgggtggagggatccagggttcgtcttcgatggactcatgaagggattggagcccgggaggaggtacttctacaaggtcaatcacttgcctctgctttgaattgattgttaattactacactataaagatgaatttctttgtagcgacttcacttctgctaattatatgtgttcagcctgcaattgcaatttgggatttagggtagtattgtaggcacatgaaaatttaggattcgagtcttgagagtgatctaaagctccttttttatttcggatccagggattgaattttgttgatttagcgagtatgacttatagtacgttttgacctacgaattcagtttgaggtgaagatggctgaatcatcaaacttttagagatactaacttgagcatgagcacccgctttggaaattatgtttgattatcccctttttagaactgaagttggttatagtactacactaaagatgaatttttatgtagcgatttaacttctgctttatatgtgttcagcctacaattgcaatttgggatttagggtagtactgtaggcacatgaaaatttagtgctcgagcccaagagtgagctggagctgtgttttttgggctccagggattgaattttgttgatttagtgatcgtgacttgtagtaagttttggcctataaattcagtttgaggtgaagatggctgatgcatcaaacttttagaggtaattactggagcatgagcacccacctcggaaactatctttgattattccctttttagaactgaagttggttgaagtttttgtctcaacatttcatgggttattacatgactcgattggcaatactttc

SEQ ID NO: 31635 - DNA, 1501 bp, Oryza sativa
ggagggagacggcggcgtccatggcggcgagccacgcgggacacggcgacgaaatgagtggcttatcgcttggcttggctaatcctactacggcgtgatgtgtggctgtgatgcgatggaccggccggaggagtcggagacgcacacgtcacacgctacctgtatatgtgtggacaaaattttctttaaaaattttatagatgtaaaatatagtctataattataatgtaattgtattataaattgcatataacgtacttatatgtagcttttaaaaattgtacggcaaacccactattttcatgaagcgagcagccctcacccgtacgtacggacactatgatttttttttcctttctcgcttgcacgaatcttaaaatgaatctacgatttaacggattaaattatatgaaagttaccgtgtaattacaatgatgctatatatatttacatatgacgaagttttaactatagtaaaatcgaaattgcaattcaaatcgaaattgaaattggagcccaaaacatactaacccaaatctggcccaaaatgcgatcgctaccaatggtctggtctgcgatccaaatttggcccaaaatgatagccgtggcccaacttacggcccaaatctgcgaatgcatcgcgcagcgcttctcatggggcagtggaatcacatgggcctctctttgttgaattatatgggccaaaagatggatcactacatttggcccaaaaaaactgtaaatgcagcgagagatggtgatgggccctggtcgtacaaacggatgccgcatgagaacggctatatgccgtgcccatgccgcctcgctggccgatgtggtacaaaacatttttctatcgcaaggatcaaaggcagagtttataaaagcttaatttgtcgttaagcacctgcagagctcgcatgactgacccagaaaatactttaataacactgctaatcagtaatctggttccattttccacgcacaggagagtgattacttttgcattattaattgatgttgtgatatttatatgaatacatatataaatgatatttctgcaagttgggtgcagttgcagagtaggttagtcccccctaggccaaggtcactcgcacacatccagccccagccaataggttccaagggcccatttgctactccacccacggttttctctcaaaccttcggccctcgaatcagctatgtgccaaacaaaatgctcatatatacccatatatatgcacacatctttcattgcatttggcctccatctgccaacaaactcgctagctaccaggagaggaccattaacgatttaatacactgacacacacacacatatgtgcaagttcgatcgatacaagacaggaagagatcaccatgtctagctagctaaattaataagctagctagagctggttgcatggttgattagctacgacgtgcagttgattagagatggaagagatcgccggtggtggctcgccgccggcgatgg

SEQ ID NO: 31636 - DNA, 1501 bp, Oryza sativa
tttttgttgttcttttcgttcctgtccagaaaatgtatatgctgctctatcatgctacttattgctatggcagtagcatgagctttatgttcctagttctccaatgttacacgccacacagatgcagcatatgctgtacggctgattatgcttggcgtttaatgggccgttgctggctaggccggtgcagttggagatcaaacggcccaatcagcccatcgggatgtcctggagatggcgtgagcggacatgggcctctgtttattcggttgtacggccatattgggccgacgtggagcacatctgcatctttgtcgtcggccggcccagtgtcatctctgacactgtatttttttttctcccttcaaaatcgctcgaactgatgttattcctgtagaaaatctgaacttgggagcataattttcaagttttatccttgccaaatttttataagaccacaaacaaaatatactctgcacacctctattatgttacatgagagtagtattagtaaggacataatactctattctcctaaaatatatagtaaatgtacaaaaatacttgaatagactattatatatgcatataatactacgagtctaaacttttgactgtcctattcataaaatagaagtataaaataagagaaagacttcagaacggtttgtaacggaatagttgatgtcagcacgatatcgtagataccgatctaatacattcgataccaaatatgataccatatagatatcagattcaatatgatgtaagttgtctcgttgaattgtaatactccttccatccacaaaagttacacatattacttttaacaccaagactaaggagaaattaaatcaccttgaatgttacaaaattaaggagtgaatacaagcatgcaactaataagtatttagatgactccttgggttctaataaaacatttaatttatctcttcatttaagtcttgaatgcataaagactacaaataggaacaacttatttgaaaaaaaaatcaaatgtgaaataggtgtaacttttgtggatggagggagtactaccattttgttgtatttctgataaaaaaaaggatacatacaattaattaactattaatctaccacggaataagagaccaagtgtgatcttccttcgagaaaaaaaaggacaggtgtaatcgtaatccaatccaatggcccaaggcgactcgtttccgtgaaggttgaggggcggcaaacagacgagagaccagaagcatcggaggagaggcaaaggcaacacaaaccccttccccaagacgccttcccgataaaccgactaatcccccttcgtctcttcctcttccttttcctcttttcccatcccatcgattcccctcctcccgctccggctccggcggccgcagatccatccggtgtgtggggggagaacctctccctcctccctccctcgccgccggccgccgcccgcagattggattggattgggttggattggattgga

SEQ ID NO: 31637 - DNA, 1501 bp, Oryza sativa
gcgaagttggcgatggtcggccggcggtgcatcatcggagacctcgccggcgccgccgctgctgcctcggcggaagccggcgccgccgacgaacggaggcgatggcggcgcgccaccgcctgcagcgcctcgtccatgtccatctgctcctgcctgcagtcgtcgctgcagaacgctgcatcccctctacacatgcaaattaatcaagatcaattccttgttgaactttgaacacacaaaatttctgtgaaatttattaaggatatatatcaattgatttgcgaactgaattacctgtacatgaagatgtcgcggtcgccggcgatgctgctcttgcagaggaagcacgactcgaggaagtggagacggcggccgccgccgccgccgccggcaccgggcttcacgcggtagaacctcgacgccacctccacatacctctcctcctcctccatcgccggcggcgagccaccaccggcgatctcttccatctctaatcaactgcacgtcgtagctaatcaaccatgcaaccagctctagctagcttattaatttagctagctagacatggtgatctcttcctgtcttgtatcgatcgaacttgcacatatgtgtgtgtgtgtcagtgtattaaatcgttaatggtcctctcctggtagctagcgagtttgttggcagatggaggccaaatgcaatgaaagatgtgtgcatatatatgggtatatatgagcattttgtttggcacatagctgattcgagggccgaaggtttgagagaaaaccgtgggtggagtagcaaatgggcccttggaacctattggctggggctggatgtgtgcgagtgaccttggcctaggggggactaacctactctgcaactgcacccaacttgcagaaatatcatttatatatgtattcatataaatatcacaacatcaattaataatgcaaaagtaatcactctcctgtgcgtggaaaatggaaccagattactgattagcagtgttattaaagtattttctgggtcagtcatgcgagctctgcaggtgcttaacgacaaattaagcttttataaactctgcctttgatccttgcgatagaaaaatgttttgtaccacatcggccagcgaggcggcatgggcacggcatatagccgttctcatgcggcatccgtttgtacgaccagggcccatcaccatctctcgctgcatttacagtttttttgggccaaatgtagtgatccatcttttggcccatataattcaacaaagagaggcccatgtgattccactgccccatgagaagcgctgcgcgatgcattcgcagatttgggccgtaagttgggccacggctatcattttgggccaaatttggatcgcagaccagaccattggtagcgatcgcattttgggccagatttgggttagtatgttttgggctccaatttcaatttcgatttgaattgcaatttcgattttactatagttaaaacttcgtcatatgta

SEQ ID NO: 31638 - DNA, 188 bp, Oryza sativa
aatgatatgacatgaaatagtccctagttggtttaataattagcctttttttaatgaagtaacgaggctttccctaattccatcttcttttccaacaaacaaattaattagtgttaataaatcttgagcttggaagtaaagagaacactgtaaaataatgcttccctactttcatttatagatggcca

SEQ ID NO: 31639 - DNA, 1501 bp, Oryza sativa
agataaattaaactgagatgaaaaacaggtcctagcaagagaagtttaggcacacatcggaacaagatgaagatcgcagaatatcagcagattcacacaaagatcatgcacaagagagacaaagacaattttttcccgaagttcggatcacacgaatcctactctccgttgaggtgctccaaagagccgggtctcgattaaccccttggctcacttatgcaaagatcccagaagaggtccacagccttcaactcaacacttctaggttattttctagaattgagagaccaccaagatccaactcaaaatttcttctagaaaagaccacaagtgcaagttgctctacctaggacaacctctgaaaactcagcacaagaatctttactcacttacctcgtttccttgcggaggtgaggaaaaacttcacaaactttcctacgacatccacaagatctttggaagctcacgggagacacctaaccatctaggagaagatctccaagagtaataagcccaagtgacagcccacaaggtatccaaagtgctcaatcaaacctaatcttcaagccatctccaaaacactcctacactctcatctaatctctcaatctcacaagataggctctagatttgagtggagaaagcaaaggaagcttgggagtggctagaaaaccctcgaacatgaaagaactgaagtggaatggccaaagggtgacctggggatgaaatccatatttataacggctaggtgatgtcatctagccgttactcacatgtttgaactggaaacctgccatgaggttccgggcaagtgctaggaacttctgggcagcacttaggaaaatttttgcaattaaacggcgcccggaagttccggccagaaccttcgggtagccctctctgtcctggggagaaaatcatttttcaaaaatgattccaaaaatcttttgactcatggatatgactaagagcactttgtataccatagaaccacacttgaaacccctcttaatagtacggtttttcctaaactcaatttcgaaagtgaaaaacctagtctaatcacctacagcgattttcgcacttaggaacattcgaattggggggtctccttgcattcttagtcatcacaacttgctttgggactaaactcctgtgaataaacttgataaacacgttagtcccctttaaccacattgtcattaatcaccaaaacccactagggggtttaagtgcatcttcacccaaaatgtggtggctctggtatagatgatacatatattgattttgatctggaggatatgttgtggcacgttgaaccagaggttctagctagtacaagatgagggtttgacaattgggaagcgttggaaagaagggatacgagtgtacgacgagtactgtagggagcattttactctacgtgccattatattcattaccatcaacgacctgccggttaacttttggctcccaggatagcttaagaggaagttcggat

SEQ ID NO: 31640 - DNA, 1501 bp, Oryza sativa
ttttggttctttccaagactaacttgctagagatcggtacttcctcttttagtgaattgatcgtagaaacttattcaacaatctcttcactcttttagagagatatatttatactataaactactcgagctgcccttaatttgttactgtatgtatgtccgctgaaggttagctctatagcatgccaaacgaactgcattcaccatttgtctgatcctatatgatatttttgccatttgtctgattccatgtgatgtttttttgctttagtgagccccatagcctgggcagcaccatcggtacatcaggagggtgaagctggcgaacgagcttctcatgctgatgagccacctgaagcagaagaactggagctaacacgaaaaaggaaagcggaaagccctctgttcgaagaggcacattctaaccatgtttctgatgaaccaaaaaccaagttagaggatactcaaaatggaggcccttcagcttgaagactgcaacacagtgataccttaagctccccatccatggttttattgattctcttttgcgcttcataatttgggggccagtttttcctgtaatgcaaggccttactggcctttatatgtatcatgccacgttggtgccaggttggaggctgaatctgactcaaaatcaagttttcggacacgttacaattgttgtatccaaaagccatgttggaactcttttcaggagtgtgctttttctagtatgggcctaggtaggaaacctgccgtgtaagattagctcctctccttgttttctctttgtaagataaggaaatgttgtagggacatgtttttcttgtatgtgggtttgatcccttttattatctaagacatgccatttctgatggtgaaatttctggttgagttcgtcaggcagtcaagcatggccaaattggagcatgatccatgcccttgtagctagtaatataatttctgtggcatttttggctgagcttcttttggaagttcaaagttggcaatgctcaacaatctggctctgcagcaatacatcagcttgtcttttttcactagttctttgttggcaatatgttatcttattcacttgacaaatactccctctggattcaagtatttgtcattcctttgttggcatatgttctcttattcacttgacaaatactccctctggattgaagtatgtcactggatattatgtacttttatttaatttcgaccgcctgtcccttttacaaagtttatgtacacttcaaggtataccatattggcaaggtgttgtgccataagtacaaccatactactttcatttatcgtaaattaattgtttgttaatgatcaaagctgaaagatcaatagcgagaagtaactgaggactgagtatttttacccagcccaaattatgacacacagcattatcacgcactgatgcatgaaaactattgcatgcatgctaaacagctacacacacctcaataacagatacacagcaagct

SEQ ID NO: 31641 - DNA, 221 bp, Oryza sativa
gccctccccgccggcctcccccattgtcgcggcggctgattcggcgtccacggtcactgcggcggctgatccggtctccccgtcgccgcggtggtggatctggccacccccatcgtcacggcggtggatccagcctcccccgttgtcgtggcggccagcagcgaaggaaggccggtgggagaccggggggggggggggagggagaggaggcgtgggccatc

SEQ ID NO: 31642 - DNA, 1501 bp, Oryza sativa
tattggcaaggtgttgtgccataagtacaaccatactactttcatttatcgtaaattaattgtttgttaatgatcaaagctgaaagatcaatagcgagaagtaactgaggactgagtatttttacccagcccaaattatgacacacagcattatcacgcactgatgcatgaaaactattgcatgcatgctaaacagctacacacacctcaataacagatacacagcaagctcatcaaaatcatggtatgtttatcctgaatcctcctctttaaacatgtatatgtgacaaaaatcaaatggaatgaaaatgtacactatggtacaacaagggctacaacaaatttcccaaatcccataggcatcacacacacagttgacacttccctcaaaatccgctactcagaaatacaccaatgcaaaccacagctcctcacactgatgaagaatccgttaatctgtatagctcacgaggcaacagcaatggcaatggttggtttgcattggcaatagcgattgcagtagcaagaagatgtatacaacaacacattgggtgaattctttaccgtggaattggggggaattgggggtgatctgttctagctttgttgctgctgatcgtcgggcttcttgtaggaggggttgaaggcggcctgctcggcgcagtcgcggttgtcgccggagtgctcgcggccgacgcccatgaggtcgaggtagtactggtagtgcgagatgatgacgttcatgtcgtcgatgtagcccttgccgcagatctggtcgccgtagagcacgttcatggtggcgccgaacccggggaggcgcttggcgagcgtgtcgttcttggtgggcttccagttgcccacgaacacgtcgtgcgccgacggctgcttcttcttcatcggcgtcatccaccgccacatcgccgccatgaacgccatcgtcgcgttctgctccaggtactccgggtggtggagcaggtcctcgtgtatcccgtcgcccgccgcgccatagttgtagttcctattccgaatccgaatccgaatcaatcatcaaatcaagcgatcgagatggcggcgacgaagcgaagcttaccagaagacggggatggcgccgcggccgtagtactcggcgccctcgacgcagggatactgcaggttcgtcttgtcgcaataatcctccttagggctcatctcgtggttgtagcagagcccccacgccgtcggcccgccggtcgccacaccaaatccacctgcacacacacacaaatccccatcaatggcgagcttaaaacctcaaatccaaatcaaaccatagcgaaaacgaagaagctacacacatgaggtcttggagccgacatggccgaggaaggcgcagagctccatcatctgcatctgcttgccgccggtggtgcaaaagccgaggggctcgaagagggcggcggcggtgatgaaggactggtagtcccagaagccgacggcgtgggcgacggggctgttgcgcttg

SEQ ID NO: 31643 - DNA, 319 bp, Oryza sativa
ataacttatgcttcactattatttaatgatggcttaatgatagctcatgatggttaatcatgattggttaagtaattaatttgccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttgtttataag

SEQ ID NO: 31644 - DNA, 1501 bp, Oryza sativa
cttcactattatttaatgatggcttaatgatagctcatgatggttaatcatgattggttaagtaattaatttgccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttgtttataagggggtgattatgatccgggaacggtgcactgctttgaattgtgttatgcaggaggtattgtcacaatctctattcgggtacttgttaagtatcgcgacgcatggttgacatgatgttgaggttgtgtcttgtgggtacagtggtacacctctggctagagtttaaactattcgaatagccgtacccgcggttatgggcgggtctaacaatgtctttcgtgattagtttcacacctctcaccgtaataaataatgttgtaattggtaataacttgtttagctcctggtttggaatggtatattcctggtttggagatagaactgtgcagccgggattggttgttcagaatggttgggcctatgcaacacgggtgtgttgtatagtgttgatttaatattgtttaattactcaactgttttactattttctcaattgcttattaaatgctgtttatgcaaatgagactatactatgccatcctttgttatcctgtgcacttgcatatttgctgcgtggcttgctgagtatgtcatatactcaccttgcaatcattcatcagaggaggagttctacagtgatgctaatggtgtggatgattaggtgtagccctggtcaagctacctgtgaagaggagtcgcctgcgctgtttcttttattttccgctgctcagaactttattgattgagaggaactatctacctctgtaatgacattttattcgcttattaattagagtaataattgtactctattatcaatttgttattgtgtgcctcggctgattcctggacgagggtttacatacatgtaagcgtttagaattttggatagaaattccgggcgtgacaactcactggcagcacctctggccagctggccgccagcgaaaactattttttgtagtagtcacaacagttcagattggttcactagctcaggatagctcatctgtaataggcgggaagccttatctgtgtcggcgaggggtactgtcacgaaccaaaggttattaatgtgaaaagtcatatgtgtcgggtcagccaccatcacggacgaccgtcatccttatcgggcctaaataaaagacccaaactcatctatgacgggtcatagttaagacccgtcacggataagagttatccgtgatgtttcaagctcctacttccaagaactgacttttttgtccccaaga

SEQ ID NO: 31645 - DNA, 952 bp, Oryza sativa
aatttgttttgattccctggttattggagtaatgttgtggttagaccgtattaggaactagagatctatgtctcaagctatcttgacctatcattctcgatgtaaaattcccgtgatagtcaatgtggacgtaaaatgcaccttcaatttgtgtgatgcacaaccataggatcaccttcgatgtcacctaggacatcaaggtcgtcctccgccgtagcaccaactattggaactcgttggtaacgaaaatctttcttactatcatgtcttaggcagggcaaggcaatcagggcacacacttgcgcctgtgaagtgacctccattgatatcgtgcatagtaggctttggtttaattgtgtaatatccacagagcctagcccatttctccacagccctctacttgtgaatttactctcgttcctcgcgatgaggaccccatgccaatttgctcccctctagctattacactcttcaattgtccaacttgcaagttgcgagtctttctactctaaactctgaactctgaagtctggaatccccttcacactttcacactttcacagccattgcgtctagcatcctgataataagttttctagtttttttttcttttgggattcactgttacattctattttttttttctgttttaaggatctggtttagggtaagaaagggctgaaagaaaaaggaaaaaatatattgctaatttatttgattattcaaagaaacatctatatatataaaaatctttacggtgtcattaagacaagtaactgaatcaaacagggctcttagctcaatcatacttggcttagtgacatttgcagattcatctctgtttcttgagcaattgggctgtgaaatgctcgccccagaaatggaacttttaaccacagacatatgcttattcctcttcgtctttttttggcgataactattttattttagg

SEQ ID NO: 31646 - DNA, 1501 bp, Oryza sativa
ccttactaatttttgtcaatgtcaaatttttgtaagttttggcatggctaatcttggcaaggtaaagttgtgtttggactgaagccaaagcagtttcatttcattattgaaatggcctatttttttaggcatgccaaaatttggtttcaaaccaaatagacactaaacactattgaaattgtcaaatattggcaatgccaatttaggccacaaatcaaaccagcccatggttttttttactccctccgtcatataaaaaaccaacctagtaccagatgtgacacatactaatactatgaatctagacatacatatgtccagattcgtagttctagaatatgtcacatccaattctagattcgttttttataggacggagggagtacttacctactagattattgaaatgtgttctttgttatacgtttctaaaaatacatttttaccaaacaaagtttcactgtatttttcaatcagttggtttaagttatttgttaattttatctctaaaacatatctttataaccaaatcgataatccgatgcaataatccatttaataatcaaacttttcgttaccaataatttggtaaggccaggaacgcagctcattctaaatgccacctaaactaccggggctttcacacacctcacgcactcgacactttggaacagaagacaatagtgcatcgcaggtaaagaaaacgtgaacacacctcacacacacaaaatggatatcctagtctggccaaatttttggatgatctcatcgagcatttttatagatatttattttcgaatatcttatccacatctactcatcagcctaatacactcaaaagttaaatggacattatctatctagaaatatcttttccaccaaacacaccataagatgaacagatccacgtcagaaccagttgcatccaacagaagcctactcagcatccacgtcccagtgaagacagttaaaggcgtagctcccccgaaaaaacaattaaaggcatatctttatatactcatgatagacatacagcgttcaagacacttttataatattatactacctcagtcgctttgtcttatttcttagttaatttttttaagtttaattaagtttaaagaaaaatatagtaatattttcaagttaaattaacatactagtgaaactaagttggtgttatagatgttacttttttttataaacttaaataaaattaaagaagtttgaatagaaaaaaaaatcaaaacatcatataatatgaaaaaagagtaagattttaaatatttatatatttttaaaaggaaaaaaagatagcaatcaacgaaacgacgacactaccggtttaccacgccgcccacgcttcgccagggccatttcgtctttaaatacggacactagaccagaggcctacctgtaacctgttcgtccagctccaaagtctcaggcgcacgcgcactgacagcagcagacagggcgagcatggcggcggcggcgaaca

SEQ ID NO: 31647 - DNA, 1501 bp, Oryza sativa
gtagatgtacgggtcgccgtagctggcgaacgtcgggaagccggactccggcgtgagctcgtgctcgcggccgggcctcgcccgccagtagcagatgagcgtgtgcagcggctgcaccggcaggtcgacgccggcgaccgacctcaccagcttgctggcccaggcgcccaccgtgatgatgcacttggcgccatggaactcctcgccgctcgatgtcttcaccacgatcgatccgtctcctgatcaaattaagtgtttgatatgctaatggagtaaaagatttttcacttctaaatcagctaatggatttcactaacattatgtgcaagctagtatatatgattctgaagggcataaataaaaatggaatggaaattaaacccatgaaaaatgtttttttagtgcaataacggattgctggtacccaatctttataaaagacgagtttcttttttaaaatatagttttcctgatgcatgtccaaccaaatcaagaactttgttaattgacacatatataggttttgcagtttgaataaaaaaactaaaaataagttttttaagagaaaaaaatagctacttgactagaatcttgtactgacctatctgagtttatgtcatgtgggcaataggggggctataaaattaaaacagacgttcagttctaattaaaagtacaataagctgacacatgctttgtaataatgcaataacaaagatgctaaccagatttatttatttattaaataatgagacaatacatttcttgttttcacccttgtctgacttgggaatatagagccaaggccgtgcctggaagttgggtgatgcacgcttaatgttaggtttaggccctaaatttaatttttttttctttttgtactatatactagtaacatgactgaacattgcaacgggtttatatggctgagaataggttaagaatgtgatctaatggttgttccttttatgctcttatgttgtgctgggcacgagcagtgggaggagagaacgaaaggaggacgactccgtttctatagtagtagctatgaaggtatagtaaattgtaaactttaagatagacgtttttcctacggcaataaaaattacattgaatatttattcatgttaaaagagatcagtagtgttaccgtcatggtgacacactctcaatactagcacgaatattttgattctcatagtacagtattgatatgagagtagaagattggggggaaactatatgcacatgtgtaaaccattgagatgagataagaacacaagatggaaaatcacgcattaatttggatggaggaaaattagttagttgataggaggaaaattggaatgggaggaattgattttccgagtgacaaaattagaatgggaggaattttgatggagtaaacggcattaactattgcttaatttgttcaaatattaattaactaccaataatagcgatccattaggaaccccctccctctaatttttggctacct

SEQ ID NO: 31648 - DNA, 464 bp, Oryza sativa
ttcagggagagctaatgcttatgcttattgggtattttggtttgacactgcttcacgcccaaaaacaaggcagctacgtctgagctaaacttggatatggaagtcttctttcgtttagggtgaagtaagaccaagctcatgagcttattatcctaggtcggaacagataagttgatagtgataggatcccctttttgacatccccatggcccccctccccccccctcggtgtggtgtggcgccatggggatgtcaaaaggaaagggatgaagtttttctcgcttttggcgtagcaggcctcccaaagggaggcccacgcgatgggctattagctcagtggtagagcgtgcccctgataattgcgtcgttgtgcctgggctgtgagggctctcagccacatggatagttcaatgtgctcatcagcgcctgacccgaagatgtggatcatccaaggcacattagca

SEQ ID NO: 31649 - DNA, 1501 bp, Oryza sativa
tgcaggatcaataagtcggacgccgtgttcctcggagcacagatcatcgacggcgatggcggaaatgcgccgccggcttaccgcggcggcggcggcggcggcggcggcagtagaccgccgatatactacaacggcggtggaggagcacatgagcctgagacgatgacggcgtcgtcggcgagcacacgatgcacccagccatggcttctgctactgctactgctactactactgctcgtcttccttttctgatctgacagtgaagcatgaagaattgggaaatttgagcacaccattaatggaagtcatctcctagtagtaattaactgcaccaaagaagagattacgagttcacgatcaagaaggcttgtcagagatcagttgatcgagaagttcagagattagtcctattcttcgtgtatattagcagtgattaaattcattaattttctattctttgtactcaagttcagaagatctaaatatattgctagatagtagaaacattagtagtcatggacagaatttcagaaatattcacattgacgagacacatgcatgtacttcgtcaactgaatttactgaatttcagctagacatttgcgccgtgtgttgttccaaaataattcttcaaacttccaacttttccatcacattaaaactttcctatacacacaaacttccaacttttccgttacatcgtttcaatttcaacaaaactttcaattttggtgtgaactaaacacagcccaaactgatttgattacgctgaactttaacaagtccaagtccagtccctgcaaaaaaaaaaaaaacaagtccaagtccaggtcaagtcaatggtgccaagtgcccactgtgcacaggaccggcctgatttttccttctgaaaattacaccaacaatccatcactccaaatttcatcatctccactagcctgttgttcttcagtcttgaacctactgtaccagtcatcaataacagagacagctttgtactgcgaaagctaaagcatcactgtctcaccagatactccatacagatggagtgttggatagtatcaagatgacaacgcactatgcgacaatctatcaaatgataagatcaagaacatgacctgtgcaaattgaaaacagccaagtcttcagatcagatcgataggcattaattcacttgtgcgatatcgatgccacctaatgaggacaagcaaccgaagtgtggctcaattcgattgtcactactgattttttaggacttgcaccattacatcagactgaaaagatacaaagatattgtgcccatctctttgattgtttaacaaaaacaacaagtgaattgtcactttctcagcacatgacttgacgcactcatcactcatgagtcatgggaatgagacccatcagctagcatgtaacacatgttgttatagctagatgtaagtgataattcttcaccatgcaacatgcatgattaaaactaagaaatagttgcagcaagacg

SEQ ID NO: 31650 - DNA, 385 bp, Oryza sativa
caataataaaccttttgtttagataaaagttaaattaaactatgaaatgttatctaccatatgccaccatatatacatgtgttcatgtaagaaagcaatattactagagtgtactagtagtaacgaaagatattataggagttttactgcacattcactagccacgcgtagtagtacggttgttgggagagattatcgccgagtttagttccaaactatttcttcaaactttaaacttttccatcacatcaaaacttttctacacacacaaacttccaacttttccgtcacatcgttccaatttcaaccaaacttcaaattttgacgtgaactaaacacgtcctatatttgtcacctaacgtgactaaggcatgtaccagcagta

SEQ ID NO: 31651 - DNA, 1501 bp, Oryza sativa
gtaatttacataatgttattcctgaatcatcatacatcatgtaccatgaccttcaattctaaatactacctccgttccaaaataaatacagccgtggatatttgtgcccaacgtttgaccgtccgtcttatttgaaaaatttgtgaaaaaattgaaaatatttagtcacacgtaaaatattattcacgttttatcatctaatagcaataaaaatactaattataaaaaattttcaaataagacgaacggtcaaatgttgaatgtgaatagtgcataactgcacttattttgggacggagagagtatgttgtactgtggttctgcagttcttctgctgcaaaaccgctgccaacctctaaataattcagggaccttgatctttattgcacagaaaaaatttgaagctagcaagctgtttcatctgtcacagccttggggtttataaatgagttcacataataaaaaggacaatcatatattggtttggatgatgcactagccacattatgcataatgccaaactcataattctcaatagaataattgagtcataaagttgtggttgtgcaaccaactgaaacaggaaagcagaggaacgtgagacgccatgggagattgacactgccgcagcgtgatggaaggtacgtagtagcagttgagaacctgtactgtatattaattgagcagttgaatgatgttaacgcacacgtaatccatctctgcaatgtactacatattgattgagcagttgagctataagaatatatatatacagtagcgtagcatgagctgcatatccctgatttcattggattaacttttgtgcttctgtaagacttgacaaatggagtatcttttagttgtatacatacgctgctcatacactattgatcctatgaaaactgacataaggcatgattcatgaagcacattacaagcactaattgatggatatatgtatgtacgcgagtgcaagttcatgaaaggaacgatcaatcttgaaagagtaacagcagtgctccctttgcttgtgacacactactagcttagctattagcacgtactcaggtactctacaaatgaatgatgaaagggagagtacatatatacaggagcaagagagccacaacctgtctaccattagtaattagtaattaacccccatgactgacagccaacaggaactgatcttttcaatcttgttaagttaattgatttgccgcctccgatcgaatccattaagaaattaatggaaagacaatatacatccacagtaggagcaagatcaaccactctcctctacatctccaatctccatacgccagcatcttaattactctacaataatcaatcaatatcaacgcatgcataccgcatacgtgatctcagaagaaaggtacagctccatataagcacacaatacctcgctcagctgtgcatagtttgcatattttgatcaatcaatcaagctaagcaagctagtgattagtccattgataga

SEQ ID NO: 31652 - DNA, 1501 bp, Oryza sativa
ttctttcttggcttttcttaattacaagtggtatacatactcaagattagtctcaagtaagtgctccattcatggagttttataagacatatatattttaatcgtagaaagtcattctttattgattttcaccaataattcgtcgaattgtaaagtacatttactttataaaaactatgctggtagattcatatttcaaaatactttcacaaatttggctctaaagctattaggagaacattttatgaaaaattaaaaccaaatcttgatgttgaagactttttaaaaataaaatgtttcttatagttaaaaatcaagaaaccaccattgatcatgtgggcaaaggtatatatccatgcatcatatatctcgtgtatgtttgaaagtgatgatggatgatgaactatagatgaaattaagtgtttcacaattattcgagggctcaaacgaacgaatggaagattagaaagccaacaagttatttttttaaaaaaaatctaagaaatattgttaaagaaaaaaattgcaaaaaaaaatcacactgtttaattatttggagctaggaagcatgcacatgataatctagtggtataatcagaaaagaatagggtcatatatagtgttgacaaatctctttaattgtgttattgagggagttctagttcctacaaaatccatatgagaaatccaatttcagacatgcctaattaataattccatcagttgtaaatttcaacacattaggtttgtaaataatggaatagtagacaagagaagagaaagtagaatggaaaatgcatggatggtaggccggcttgggggtgggtaggtgaagatagcaattcttgtgggcagaggtccactctaactgccccaattaaaagaccattgatcccctcctccccaagcagccacagacacagccaccacactagctttggacacctctacctagctccatctgcaaccatatgcatctccaccctctccatttggaaccagaaaaccatggcttctcctgcatgctcactactcatccctacacagaaagctctagctgctgctagtttcattctagtaatgatacaaatatcaagagaaaaagtgagagtcaaatagaggtgtgaggtgaggaagatgctgcaggtagaagaagctgagagaaagatatgatcaagcaagcaagcaagcaagcaaaagttatctagctaaagagggagccttttcattttgaggggaatgttgtctggctcggggctacttttaatttctctctcttttgatatcttcttttctcgatctcctagcttgatcttttgatctctcaaatcgatcttaagaaaaagatcagtcaaagagatgagagtagatgtctgtagatctcggaccaggctctgatgaatcccctaatgatttttatcaaaatcataagttaaggtagatacacatcttgtcatatgatcaaatggtttcgccaaaaatcaataatcagacaacaaaa

SEQ ID NO: 31653 - DNA, 1501 bp, Oryza sativa
aatctcgctcacccaatgagcgatagcaacggttgaaaattgttagttactttctccgtttcacaatacaagttattctagtatttttcatattcatattaatgttaatgaatttagatagatatatatgtctagattctttaacaccaatatgatataggaaatgctagaataacttacattgcgaaacggagagagtagtgattgattatcctaattagcaattaattaatattaattaatcgctaattaggataattaatagttaattagagtaattaatcactaattaagcagcactgatggacaagacgttcggtctcgctgattccttgtgcgggaccgttcgctctcgctgttttatctcgcgataccacgcggtctcgcgcgacaccgcgtgcatcgtcacgctctcgtcactttcgcgcaacgattgcgcaagatcgacggtatatttctgctaaaaaaattacatcatgaatatttctaagaaaaaaacgaatcacagtatattttcaaatttaatttcgttgtttgcgtgattggcttccttcttactattaattgacgcgtctgatccttgcagttgtagcctaaatgcctaataactaccggcaaaacgatggacttgtcctacgtacagttgccgaggattcaatgcatccaaatacccaatatttgcattggcatggccaaaatattcgagatatatatatacaagaccatatttacattagaaaatatggcactttctcggattcaaaaatataagtgatgggtatgaatatacttatattttgatttatagcaataaatgcttatattttaaaatgaagtgacgagctaaagaacccagagaaaaagaattgtaattaaaatcatttttcaactaatcttcatcaacattgtaagcccagttatcactgcaaatactatagcaagggattttaaatgatccaacaagtttttagcatacaaaatttgagggctgaatctaaaatagtgtggattaaaattttatgtatttttaatctaaaaatatagaagggctaggtagaattgtgaaagaacccatgcattggtctttacccattagttaccaccgctaattatagttctttaattttttttctatctgaatattaaggggttgtttagttgtcagccacactttactatgaatgttttatcaataaaaataaggtggtcaaatttttagccataccattaattatagcaagtataagaaaatattggcatactttggtgaaacggaggaccgtcctttgattaattaattgcctggccaatttaggacttgagaaggagagatattagatgataattaggccgtgcttagctctatcgtacttttgccaccatgtactatcagctcccattgtcacgtaacccttgtcccttggccattatatttcattctcttaattagagatgcaccattggtgggttgacagagttgtgggtgcatgcatgacgcaaa

SEQ ID NO: 31654 - DNA, 943 bp, Oryza sativa
cacctaaccacatttattgcggtttggctgagcgtgtcacgccgcatgtaacgcagtgcagtgcactcgtttatccggtctgtgaccagtcacagaccggtcagatcgcgggttaggtggcgacaagcgatctgacgcacgcctcgccccatcccgtcaggacgagggcttctaggcgctcatccccagctggagctagcgtgttacctcccagagatggcacgttagtcctggtcagatatatgccaggcttcatcctaaccattacaggcaagatgttgtgtgaagaagggcgagcatgtaggttgctaagctgacacgtggtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccactgagatgagggacgagactggacttttccagattagaaacccagaacaagggagaggctggctcatactttgtagctcctttatacacagatctcccaaaacacaggagtagggtattacgcttctcagcggcccgaacctgtatacatcgcccgtgtcttgtgtgtttccggtctcgcgagccttccacatacagagagcttagaatctctccctgagtccccagccaaaccggcaaaggggggcctgcgcggtctcccggtgaggagccccacgctccgtcatctggcgcgccaggtagggggccctgcgagggattttctgagctctcgcactctttcgtgtgcgccaagcttttcctgttcagcccaa

SEQ ID NO: 31655 - DNA, 721 bp, Oryza sativa
ccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggtgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgctgcttgcgccctaactccttctttcctgtgccctaccttcgccacacgcgctcgctcttaatcttctcttcctccggcgcca

SEQ ID NO: 31656 - DNA, 152 bp, Oryza sativa
catatgtcgttcgatgaataccctcaaataaccgaggcggtgtgggaggaattttgctctctcaaaaacacccaagagtttagggaatcaagcgagacacatcgccaactgcaacaacgaaatgagcacccacatcggttgggcaccgcagg

SEQ ID NO: 31657 - DNA, 1501 bp, Oryza sativa
accacttgccggttgggcgttccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgagcgcgtaaatcaccgcgtgtgcagggatgcatggtatggtgttgcggacttgacagaaccgctgaatgtacgagcgaagtgactcatcatcccttcgctgtactgcgtgcaagtccgcttcctcacctgggcgcggatatgtgccttagaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgatgcgacactccggacgaggaggcgccctccgttgcgtggggagcacgtcggccattacgccggcgctcgatactgatgcgagcatccggttccccacgcagatcttcccgggtcggaggcgttgacgaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtggatgtcgaagtcgcggatccttcggccctctcgagcgccttctcccgcctaggactttggcgtggaggtggcggtggagtacgagctcgacggcgtgggtttggctccccgtcgtcaccgctcatactcggggagaggtcgtgcgcctttgctggctcggctattgggctgaacaggaaaagcttggcgcacacgaaagagtgcgagagctcagaaaatccctcgcagggccccctacctgg

SEQ ID NO: 31658 - DNA, 1501 bp, Oryza sativa
gttggatcactcgacttttgtgttaactcaaagcaaacaatcattgccacacctatgcccaaaaactcgacagtttcagagtacacagtggacgcaaaggtaagccaagatacataaataaatcagcatatatatattactttctactttatagatggattcatcaaccctcctcgagcaacaattaacgcaactagctgataagtttctgctcacaaaattatactcgtatatgcccagcaacagtactccttaaactccaatcagccaacaaactactgagccgacaatattcgcatccggacaggcatctatgtcacaccctttctaccggcggcttctgcgtcctcctcagcttgatcaactcttgtacctacattataaataaaatagttcatgatccatctgataaaatgtccttgaagcaagaattactgaccttttggatcaagggacaagggaaagagcattcatgtagtccacattgtatacaataggacaagaaaaacctaaggctatataaatattaataactgctttattcaagttggccttggtcaataccttattacttgctctattctctagttctttggaaattgacatgctgtgaatgcactttgattattacttctttatatttaaatgaatgctagcaaaatatattagatgcataatgataagaaaataagatcgatgacgcgtttactgatatgaatttttatgagaaatgcaaataattttatagtcgtcaacattttattaggtgttgtaccgtagttgtgcacatgggaatggaggtgtcgtgatcatgttaacaatgttcattttaataatcgttgcaccaaacacacagcagttcatttcaacaaagttcaagttctattttctgactacggtagaaaaccccaaagtttgtcttaaactcacacagaacagtatgctgcataatgactcttggtactactctgccataatgactctaggtactgctctgccattgcagtatatcaacctcatcaagcttattgtcctaaattaaagttcactactcctagtctcagtttgctcattcagaccatcctgaaaaaagaactataatagaagatagaggcactccgatgcaatatacttgcagtattctactacaaatagaattaatcttggccgtttatcttaaacggatagattagtaatatgttaatatagattagaggtaattttggaatggtatgatttctctgtctcatcaagtatggcggaatcggtggctcgacgcaacgcatctcgcccccgacgcatcaccacggtttctgctcctcctcccggcaggcggcggcgcggcccccgagcccccgacgcaggcaccgcatctctcccgagcccccgacggatcaccgcatcaccgcggtttccgctcgtcctcccggcaggcggcggcgcggccggcggcgctgcccctgagccccggcgcagtccttattttcccatatattttcta

SEQ ID NO: 31659 - DNA, 928 bp, Oryza sativa
tcgaacgaacgtgaacgagctagggaacgtgaacgagcgaacgaacgaggacgaacgttaacgtgaaatgcaatatatatatatatatatatatatatatatatatatatatatatatatatgttacttcgcatttatcctaatacattttttttatcttgcagaaaagacgtgttgtcggagtcgtctgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 31660 - DNA, 333 bp, Oryza sativa
acctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcatccccagctggagctagcgtgttacctcccagagatggcacgttagtcctagtcagatatatgccaggcttcatcctaaccattacaggcaagatgttgtgtgaagaagggcgagcatgtaggttgctaagctgacacgtggtggacaagaa

SEQ ID NO: 31661 - DNA, 1501 bp, Oryza sativa
ctatggctcgaaagggtggacctcgtgataggcgcccaattcatccgatgactgggcgccccttggatcttgagggtgtcacggttgttgatgactccaatgttcccgaaggtggtgctgaggaacctgtgtcagaggagtgatgctgcagtaggtctccacttgtttgttgtgcctctgataagatcatgagtactgtacaatatggaaacttcctaatcatgtaatcttccattgggttctaataatttacaaggtcgtagtgctgcactatgagttagctgttctcaaccctttctgaaatggatttttttctgagttctcatggactagcttacagttcacacatgttttgttcagtcaagggtatcttgaaaggtaggcaatatacagagagctaccataagcgtcacaattccagcttgattattcctttttgtgcaatcaaatcagaatagattctttatctggtctggttgcaaggttatttgattttatggaactgcaaaaaggtgcatcttttgtcatcttcattgatctttgtgccggttgttcatgttgatagttttcttgtatgattccttccttgcagttttcctccaaaggcatgattgcctcctgaaagaatcttgtatgaaatggatcgtacgctttttacaaaacacatgacatttttgtagacaaaatgaatttgcagtcttgcaccttgattttataaattggaattgaagagcatgtctgacgcaaaaatggatcataaattttacaagcttaccgataggttgaagtgttcagaactacatgtagcgaactaatgttctgagatagcagctactcgagcagtaaatcaaacccaaataaagactaagaaaaaagaaggataatgagaattgcaggcttgcagcgcatggatatgatagcaaattcagaatcttcatgctgttatcctgactactgattctaatactgtaatagagttcagctcaagtcttttttctgtatccaaataagaaaagtattctgtacatttccattttcccggttgctcaaactcacaaacatgtactctgtccaaatgttcagactgtgtacagactacagagtattcaaaacatagcatgtttgactagtaattaaggtatctgcattagcacaagcatcagaagattcacctctcttgatgctaagatcatgtcaccatcataagcttgcatcatcccaaaaggtatttcttctttcctaggccaccccatccgtgcaacatgctaaaccaagcacaccaagaaaaagctttctttgcatgcaaacatgcaaaaatgcaatgcatcatggcacttgcacctttaaatcttgcaagaattctctcaatgtcttcttccccttccctgctcaatcttcttcctatcaacatcaattcccaaattttgagccataggagccatgggagagccaagagcttgcaagctatggcttcttgtggtggcaatggcggcttcttggt

SEQ ID NO: 31662 - DNA, 392 bp, Oryza sativa
gatgcgccatttgaatctatattggaacctgtttgtcgactctagaggatccccggttaacctccagcacaccgatttatcattttactagaggactgaattctgtatagaaactagcacacattgtattcaagtaaaagttttgtaccaataccccacatctgacttgatataggtaagagttcatataataagttccatcataagccgaaaatggagaagtcgggtaattctgaatgtttagaatttacaagagaatatatttttcgatcagacaacagtttggtgtttctgaagttgctaagacactaaaagatatacaaatcatccattggaatggaagtaccatccttcggtccagttttgcatttcagaaagtatagctgctacat

SEQ ID NO: 31663 - DNA, 1501 bp, Oryza sativa
ccctggagtagtcataaataagttggatatcatgatatccaaaccagtgtgccggccatctctcatgtttgtttacgacactttgtatttctaataagcttataagccatgatatataatcgcattctaccatcttctattaaggatgcatgtgaggatatgcagagtgatgacacctttgctaataaataaatataatcgagtttctagttgcatcacatatcatttctaacattcgctcatcaagaaaccaaaaatataagcatatttacgagcatttcgtcctaagcccgcatgcaacaactaacgtgttaaatattttcttccaaacgagaggcattttaacatgaacaaaaagaacttcagtcttggagtcagttgcacatctaggattttagatttgattgtcctatttatatatttttttgaatgatgtaaatataacaaggtaatagaattacatgttgatcaaagatataccataatagattaataagagaaattttctcttctcaaaaaaatatttttacatacatatcttatcttctaaagccggcggaaccgccttaaattgagtggtacacgtggcgaagtttacgatcaatttagcacggctctcatgcattaatcgtcgtgcctggtttggcgtctcgaccaatccggagttctgaacagcacgcaaaaaagaaaaacaaaaagaaaaagaaagaaaggaaaatagacctttggtgcagatgctcttgtttgccacgaagctgggctgtacagcccaattacaggcgtttgggccacgaataaaaggagaaaaggaaaaaataagcaagaagaaaagtatcttcataaatcgtcagacaaattcaatatactatatactatgatcgaaacaaatatcctagccacattgatatcgtatattactataataaaatattagttagagaaaactaaatgtactcccaccaacaaaaaatacaacaaatatttaattttctttgttgggataaagctttgatattcaataactattctatgcggatataattgttgtgacacaaattgatgtcataatatccatattcactacaccacaacactaaaaagaagacagtcgtctgtcggtagaaaaaaatttagatgtcactttgtctgtcggaaaatatcctgtcacacagtctgttggtaaaaataatttttttaacgcactgtctgtcggtaaagattagtggcaagttgtctgccactaattgaactgtcccgtccaattgtctgtcgctatatctgtagatgcccaggcgaaaaaaaaggcgcggcccaaatgtatcggcgggagaaacgagcgctaaacaaaaaaggaatggcgcggaacaaaattttcagcaccaaaactccaaacaaacagacctctcttctctctcacacgctctctctcagaaacctgaaaaaatccccactccaagacctagcaggtagcagcaccgcctccgcctccgcctcatctcct

SEQ ID NO: 31664 - DNA, 1501 bp, Oryza sativa
ccgccgtgcgacccggaccgccgggactggctcgccggcgccggcgccggcctggtcgagccggtggcgcggtggatcgacgaggtcatgccgggccacgtcgacaccgccggcgggccggtcatccggcagccgtgcatgtactccatgacccccgacgaggacttcatcatcgacttcgtcggcggggagctcgggaaggacgtcgtggtcggcgccgggttctccggccatggcttcaagatggggcccgccgtcgggaggatcctcgccgagatggccttggacggcgaggccaggacggcggcggaggccggagtagagctccggcatttcaggattgggcgtttcgaggacaatccagagggaaatctcgcggaaaataaggtcaaaaattaggtcctcacaggtatggtcgcctgcgaaaattggtgcaacgtgtgaaatgtggttatcagtagggggtttgtttaccgtaaatctattgaacattgtatttcataacttctatgtgtgctttatactcttggatattggtagattgtaataatttgcatcttctctgtccttgtgtataagattcaaaataaagttgttctgttgcatttcttcatctttttgcaaaacacaaaatgttcctcattttgatcttcactttttttttcctcgggagagaatcacactagtgctgttttttttttccctcgggagagaatcacactagtgctgttcctattcccagtcctattcatggtagatatgccgttggtgaattgaaagagacttgggtgttcgccattgtcggattcaggcagtacacgccgcaaacctcacaaagttaatcctttggaaacaaagggttattttggaggaattttgaagggattcaattctatagaaaattttctcatgtgatcctttggataaaagaaatagctatctaaaaatcctatgaaattcctttgggttcactctaaacatacataggggatttgtaggaatttcaacataaggtccaacccgtctctatctttctctcttctaattcctgtatttcctatgctccgttcaaacagttacatttttatatttcaaatgctcttttaatccataggattagagatgatagctccaatactatattttttttattgttcctacattttaagaattctgcattccaaatgggccctctgagcatgaggaatatgctaggatttgaatagctccaaaacgttgagtctttctaaatacgtcacgtcttgctgcaactatttcttagttttaatcatgcatgttgcatggtgaagaattatcacttacatctagctataacaacatgtgttacatgctagctgatgggtctcattcccatgactcatgagtgatgagtgcgtcaagtcatgtgctgagaaagtgacaattcacttgttgtttttgttaaacaatcaaagagatgggcacaatatctttgtatcttttcagtctgatgtaatggtgc

SEQ ID NO: 31665 - DNA, 1501 bp, Oryza sativa
ctcgtcataagcccaccctcaagtccaactcataattgaaattgtgcaagtacagttgctgcgtacatactccctccgtccttaaaaaaatcaaatactggatttccgtgccaacgtttgactatccgtcttataaatttttttataaatagtattttcattgttgttaaatgataaaatatgattaatactttatgcgtgacttatctttttaatttttttcataattttttcaaataaaacggccggtcaaacgttggacacggaaaccagggtttgtttttttagacggagagagtatactgcaggtacatgccttagtcacgttaggtgacaaatataatctctcccaacaaccgtactgctacgcgtggctagcgaatgtgcagtaaaactcctataacatctttcgttactactagtacactctagtaatattgctttcttacatgaacacatgtatatatggtggcatctggtagataacatttcatagtttaatttaacttttatctaaacaaaaggtttattattgtccgatcgctaccatatgagagatgacctattttttttcactagagatgaatctcatacaccgaagaacataactacgacatggcacccttggatatttgccaaaccttttttgtcatggtatttgagcactactacaaaaccctcgtagctaccgacttataggagtccagacttttcattttttttagtttctaagttacagatcaggggattaattagtgtggggttgatcttgatatgttgatttgggggattgttgatcctgtatgttcttgatctgttgatgtggattcttgatccaatgttgggaaacaggttcaaactgatcaaagcatcgagctggcgtttcttttttcctaccactggcaccaataagtctagggtattgctgccagatgatatgtgccggctgtaaattcagcatgtatgccgggtttgcaactggcacctaacagatgttttgcagtagtggagcctaactaggatgatattttgtttagtgctttagtgtatttgagaggtgctacaagctacaaactttgtagtgtaaagcggggtatatattcttacacagacgtaggattacaaattttcaaacttagacgcaacacataataactgatacagagtaccgaaacaccaaccggcctatcaatcttggtccaaatggaaccggcagtacaaaaatcactgcgaattaaaataactggcagtaatattcaataccggttcttaaggtgaactaatggcaaaaattgcgagatggcggtcatagttttagaaccacattaagtgttggcctcacatccgttgatctggttaagtcctgcactaacacccgattctctcgatatctctccattccccctctctctttcatccccactcatatatggcttcccacaatgacctccaagatcgatctcccccaatgacggtatgaggcagatcatttatttcatga

SEQ ID NO: 31666 - DNA, 1501 bp, Oryza sativa
tactactgtctactgtgttcatgctgttcgtcgctacgtacgatgactactcgtcggtgtgaactccacattagctgattaattgtgtgtcatatactatgtaaattagctcgatcgatcgatagatagttttgctgcgtgcgaccagcgatcgcccacggaatcagaagcagcggattaattatctgtctcctcttgagtggtaattaacgcggtttaatggtaatatagtcgatccgtttgatggtttctatcgtttgacttcagaaatcttcagagagaacttaacgcaggcaggttgctgccgtacgtgcctgtactacatacaaatacaatgaaattatgcaaaaacactagttcaacaccgaagataacaactaagccccatatgatatataacaattactacctttcgtctcaaatatagaaacttactccttttatgattttataatatagtaatctataagtatcatatgtatatgtgtgctacaaacctgaatatgaaaagtgtccaaattcattataatagaatgtgtcacacacgatactcatagattacttatattataagagcgtaaaaggagtaagttgaaatagcacacacgatactcatagattacttatattataagagcgtaaaaggagtaagttgaaagaagagctgaagaagcacagtaaaacctactttcctggacatttagagtactgtcatcattcacacattgatcatttcttcattatatttctattctcctattctcctagtcgaatagcaactcggtcgcgttgccgtgataggcgatagcttaattttgtccacatagctgaagagaccacaccgtcaactactgttgcatgcggcgacgacgacgacgaccacgccgccgggctagctagctaggctagcaaacggccggcgaggcgaggcgagcgagcgcacgcgtacgtggaaattacaagctgacaaaaggccgatcgcttgtagctgacgacgcccggttggtacgagcgtcaccaacacatttccgagcctccccttctttgtctccctcttatatcatcatccttctccttcgcccttactttcatggaaaaaaaaaacaattaatccgatcaaaattaaagcccaaaagttgagatagctagctagctcatcaggagagagtgagagacaatatccagcttgctaggtagctagctgccgtttgcgtgttcttctttaatttcttcgtcgcataatctgtctcgtctctgataaactttttatcttctttttttgggtggtcatgcatgctgcggccaattcgttcttgaattcgttagctactccattccatatatagattcgatcttgtcctagctagatacctagctgctgctgctgcttcttcttcttccttggtgttgaatttggttcagccgctgctagctatagctttgcgcggtgttcgtagggttagggtttttgctgtgtgttcgacgatggctatgggaatgg

SEQ ID NO: 31667 - DNA, 1501 bp, Oryza sativa
cttttggaagaatcatgcggcatgcatgctttaaatgacctagtcgaaagatcatatgattcaggctttataagaaagcccgaaaggaggtccatatagaattaccagaaattgatacaatccactctcaagtcacaacttatcgagactcggtaactaaatatgcatctgctagggacatgctggtagctaacttcttcagacttactggattccctaatagcagaagcttcctcgagcattataacctagttccaagcaagggtcactcatttcacgtgcatccttttctagactgaaaattccggtacatctcacgggaaattcatgacccgttacaggccaaatcagcaaatgcaggtaacgaccacaaggcttttgctcagaattgaaaccatttaaggagatactcccagaacaacctagcattcctccaacaattccaaatcagcatcaaccccctcactctaaaccactgaaaacacctaagcccccattccaaatcaccaaatcaccgaatcgctccccacattgcccattcaatcgcgtaagctccccctagccgcccgcatctaaacgcctccaaaaccctaacaggtcaactaaaacccatcgaaccccaaatgaagcagcaaaagcggggggcgcataagcgtcacgaattcgaatcgagcgtagacattacacgcacgcacctaaggcggagatcttcgccctgagctggcccagctcggccgcgagcgccgcctcctccttggccctcgccgcggtcgtctcctccgccgccacgtccccgagccccgcgttctgcgccaccgccgccccggcgacgagcgccagcagcagcagcagcctcgcgatccgcatcgcgagatccgcgcgaacctgccttcctccccgcctcggcgcacgcggcgcggaaaagtggagaggagatgggagcgctcgccttcgcctcgcctcgcctcgctcgctgtcgctttctctctctctctcgggtggccaagccaacgactcgttttatatggagctcacgaggggagaggggagcacgtgggcatggctggcactggcactggcacagtgcggcgcggcaagtggcggtggccggcgtgaggcatggggtcactgcccggtgggccccacccaacccggccagcggcgagcggcaccggcgttgggagagacctcggccgcggcccatttagagcccatcaaagccacaccccactcgcctgtcttaggtgggcgacgcgcggcaccgcaccggcgctggaagagacctcggccgagggcccatttaaagcccatcaaagatacaccccacgcgcctatgttaggtgggccgggcccacgggtaagggagatttggcccatttaggcacgggaggtagcgaaagaggaggaggagccgtcaggccgtcagtgtctttgctcctcttttttcttcttcttcctccgccaccacccgactcggcggcctctgctcctccgctcgttc

SEQ ID NO: 31668 - DNA, 1501 bp, Oryza sativa
cgctctggctccccgcccttgtcggtcttctcatcggctgccccgcctcgccgaccaccggattcgccactgcctcctccacgcttcgcctcgccgatcaccggattcgcgcaccgcctcgttctcctgctccaccacgcggatgcctcctcctctctctcctcctgctccaggctactggtaccaggtatcacgggtatcaggtaccatgtatcacgggtaccaggtaccaggatactaggtaccaggtattacgggtatcaaataccagatatcacgggtaccaggtaccaggcaccagggtaccaggtaccaggtaccaggtatcacattactagattttaggtactagcctggtaccaggtaccaaatgtatcagacggtaccagaggtaccaggtacctgatacccaaggtaccaagtatcaggatggagaggaggagaccaccggcttcctctgcttctgtggcggcggaggagttgccacctgcgctcactggcaaggaggcggcgggagcagcgggcaaggacgacggcgaccttggcgaggagcgcgagggaggaggggagaggccccggtgccggcagcaacgagagcgccagtggaagaagcagcgccacagcgcgtggaggcggcaccgcagcgggcggaggacgacgtcgtggaggtgcggcgagatcaccctcgacgccgccccgacctcgccgacgccgtgccgtcgtcgtccacggccgccggagacgacgacgaccccttcctcctggccagcttcatctccgcctctcgttttcttctcctgtgagagagagagagtttgtggaggggaaaggaaggagataaggtagtggagatcttatcccgtggcagctacgttgcaacggaatcccgtgcggtagctgccctctttgtgaaaagagcatcgcataattgtaattatctatatctgttaggacataaaaaaaggataacagatgagtggagaggactagcatatggggtgctctatgttcatcaggccttggggtgtagttagtactatgaattcattgaacttatttgtgttgctctactcatgttcatcgggccttcaaaattttctctccactttctgccataatggactagttggagcagctgcaaaatagcagattgttcagcaaattgttaattaagagaaaaagagcaaatgttctgcaaaaattgtgaatctgcgagtcatgacacatctcatcatcacatattgtagagattatgggtaccccatacccacacggtgtggttatccgactagttataggggataacttatatctatgaaatatgtaacgtatcgtgatttgggtattacgtttccctgtatattatggaacggcctaaagtcctggtttgataggattgtaaagtagatttagaaaaccgataccgtattggttaaggtttctatcttgtaatcctgccccccatcctatataaggtgggcaggaggccctctcgggggca

SEQ ID NO: 31669 - DNA, 1501 bp, Oryza sativa
aaattgggcagaccattgataactttgctagctacgtgccagacagcaaccagatccaaaacagtgttaaaatctgtactactgtagcatcatgcatgtttcacgccctttgctctcagcctatgcgtgccagctagcctcttttgccttcgattccacagtgccactgaactgccacacctgcacacaccaccacgtaggcacccaatacttttacatctgtgagtatgtcccttaatttgctatttgttcaacacaggtgattaaatgttaattaattcggtacacctactaaattcatagggatgccgcatatgtaaattatgaacaccataatttaaaccatgttctggagagtactatcttcagttttgtttggcacagctttagctcctggagctgaagctcatccaaacagtttcagctatacctaaaataggagcagagctgggtggagctctctcacaagataaactagagttgtggagctaggtctaggtagctccacatcaggaccggtcctagggttttggggccatagggcaaaaacttatatggaggcccctatgtatacatgtaaactagtatatatatttatatagtcttataaagaggaaaaaagatagagaaatttaccaaataagatgaattggacttgaaggagtgtaggatcttgaaatcagatgaatgaatgaattggaggagtgtagtgcaggcagcgggcgacaggggcagcgagtagtagcgagcagagaaggcgaccggtggacgatcaagacacacgagcatggctactggcgagccgcgatttgctgacttgccgtatccgtttgcgagatgccgagaagtcaccgagagcgcaggagcagcgagcggcgtgatgtgatcgagatggtgcaacgcgagtggcgtgtgtgatgtgatcgagacgaagcgacgggagtcagaggaagatcgcttcgtcttcgctgaaacaagcctggcgatggactaaaattcattttctatattgggctattcagctgtctaacttatataggcccatggcccatggactaaaattatataatacgtagtatatatactatatgtgtataggggcccctagattttggggggctcgggtggcggcacggcctgaccccccccaggaccggccagtccacatctccactccagacccaactcatgtaactaaatttagacgttggagctctaccaaacaggccacccttacacctatattgtttcatgaatctcatcatagaaaacccaatccaaatcaaatgtgacaccccaagtattattcgacatttctggcatccaatatctctccatttgacctaagaaggccatggtagctggtggcacgtggtatagacttcggcaaaacatagtaagtgctccgcgaccaattcattatggaatacacaaaaagtagatggacgcactcctttttctttcacctgtgttcataaccactctctacttagaagccatt

SEQ ID NO: 31670 - DNA, 441 bp, Oryza sativa
tagtttcaatgagttgaaccaaattaggattctagttcgtgagcttaacgagacagctgctcgtttatctcgttagtccaacatattatcattaactaatatttagttccttaattacattgaaactatttatatgtttatataataaattttaccggcacttgccggttaattggattatagcattataatttatccgatcttaaaatatgtcattcaaattcgcgatattcaagttgtgccattaaaattttatgggtatttgagatatactactgcttaccccttcgatgcatttctcaaattttttttaccaaattaataagggtcaattggatccatggcaatataaatttgtccgttttaaaagttatcattacaacttgcgaaattagagccataccattaaacaatagtaagtatttaagatgagtgtgaaca

SEQ ID NO: 31671 - DNA, 518 bp, Oryza sativa
  unsure (1)..(518): unsure at all n locations
cctggcggtagaacactcctaccctactttnntatttttttttgttgactaggatgccacgtcagcaaaaccgggcaaaaatactgtcaagggacctccggtgaatggtttgagtaagtttaggggtagacgtttctggttttgtggttaagggacctcaaaaaatctctctgttaaattgagggggacctccggggaacttattccaagaaaaaaaatccaactcggcccaatatccaaacctaatgggcctcctcctccagcggagcccaaaaggtgagaagaacccggcccgacccgacccattacccaataaccaggcgggttggctaggaatatcctcgcgtcgcgtcctcttccgcatcggcccaatccacccgcggcggcgatctctctctaccccgatctcctctcgccgtcggcgtcgcccgggtcgccgccgccctccgccgcgcagtccgcagctagtaggtgggggggttagccttagcgtgagaggcctttgccgccggctgcga

SEQ ID NO: 31672 - DNA, 247 bp, Oryza sativa
caagaatccagtgactgccataaaaatagatagttcatgcatgaacagcataatggttttaacgggcatccattgacagatagttcatccacataatcaggtcttaactagcacataataagttctaactggtaagaacaagcacataataaggtcttaactagcattacatcatacgaatttggatggcactacaaatattgccagacaaaatggtgatgttcatccatcacactacttgagaaca

SEQ ID NO: 31673 - DNA, 158 bp, Oryza sativa
ggcaatcatacgccgttcgatgaataccctcaaataaccgaagcggtgtgggaggaattctgctctttcaagaccacccaagagtttagggaatcaagcgaggcacatcgtgtactgcaacagcggaatgagcacccgcatcggctgggcaccgcagg

SEQ ID NO: 31674 - DNA, 265 bp, Oryza sativa
ccataattattgtgagaggtgtgagactaatcacgaaaaacattgcttaacccgcccataaccgcgggcacggctattcgaatagttttactctggccagaggtgtaccactgtacccacaagacacagcctcaacatcttgtctaccatgcgtcgcgatactggaaagtacccgaatagaggctgtgacaataccctctgcacaacacaactcaccacagtgcaccattcctggatcataatcacccccttataaaacaaggca

SEQ ID NO: 31675 - DNA, 1501 bp, Oryza sativa
ccacagaaacgacagcaaacaatcagttgagctttactggcggcgcatttggtagcaaacagagccacacgctatcacgaacctcatcgaagtacttcacgtggacaacgtcgtagagtgttggctggccctctatctgcgcgaacgcatcggaaatcggcatccctgcagcagcagcagcaatcgcgacctcccacgtaagaattcaccagccacagaatggaagcccggcgattgcttccaacacaagcatatacatatccgtggcaaagcgagaggaaacaagcaagcaaccgacgacgacggcgatcccaaccgtggcggaaggtgggtggttagggttgggggggaggaggagctcaccgagggtgaagggcccgacgccgttgccggggcggaggtcgagcgtgatggcccccatggccgtgccctcgcagcgccgcctcaccggcaccgtcgccggcgacggcggcccgacggcccccgcgccgccgccccccaccatcgccggcgatctgtgcgcctgcatcgctgggcccacctcctcctcctcgccgcgaacggattacggattattccttgcgctctctcctcccctctcctctcgattcgattcgattcggttcgcgtgggcttgcgtctactcctccctcttcttctccccctctccgtcgactgctttgcttcgctttggtttaacgagaaactaacggggcttgggtcagactgacaggtggggtccgagtagtggtgggacccggtcctcagtgagagtgggttacactgacaggtggggtcggaaagagtggtgggacccagtcgtcagtgagggagttttgccgtcgcttcggtttcgtgaagaggaagaggagcgtcgccgcccgccacgaaggttaagtaggtagacggtggagatcgcttgtgccgccgcgtgcgctgcatcggggcaaccgttggatccgtgccttccaagactcggaatcgcaacagttggattcaggacgaaccgtttagggatagagaaaaattcacaaggatttcatacgaatacaaacatttgcgccatttttaacggataataaaaaggcaacggcccagagttgtgacgccacgctgacaaccaaatgcaagtaggttggatggatcaatcgaacgtaacacattaagcagtttatgcttgactgaaagataaatgatgcataggcatagcgatgtgtatgtaacaacaatgcactagctgatggaaaaacgaaacaaaagggtgacagaccagtggcttcgttcttattgatcatacaacatgtcgattgcacgttatcaactggaaaaagggaaattaagttgtttgcaccctggaggtgctaagttctgctcctagatgcagcagggctcctgttcatcagtcttcttttccatagttgtagataatctcgatctgcaggagtcatataatcaccttataaactgattgcgacactttgatgcacgaaacacaaaatca

SEQ ID NO: 31676 - DNA, 1501 bp, Oryza sativa
cagtgacaagatgctaaagctgttcatggagtagaaacgagatggtatgattcagagaggcaaattaagaaggtagaaggaagaagagaagaaattcagagagcagagcaaggaaacaaatagaatagagagagagagagagagagagagagctcaaattagctttgataaagacagctaaaattgcatggaaaaattaacacgaggaggaactaggaagacgacgacgtcatatggatcatgtggttggaatccatgaacaagtggggggcgagaagaagaagaagaagaagaagaagacgactcgcgtggaatcaatcgagagagaaaagaggacacgtaccgtcgcctcgcctcgcctcgcttccgcgtcgttcgttcgcggcgatcccaacgcacacgccgcgtctcccacttgtaccatcacactaactgtacaccagtcaacaagatcaatgaagagagagtgtactgttcttaattgtttttttcttaggataaaatcataaaataataaggaaatttattgttacaatcaacatagcatggaggaatgaatatacttacctcacctgattcattgctccatatctgcatatcagcatctttctttcttcaacgtgttcacgtcaaaattgaaagtttgattgaaattgaaacgatgtgacggaaaagttgtaagtttgtgtgtagaaaagttttgatgtgataaaaaagttgaaagtttaaagaaaaattttggaactaaactcggcagtagtagtaataactgtttgggtcaaaattcaaagtgtttgttggtggttgaaatggtcaaaccaaaagctttttcttctacctgagaaacaaaggggccatcaatctaaatgctgagtgtgcaaaatatgctcatgcctctttacaggaaagggaaggtgcatgttgatcttttacctgcaaaactgatttttgaccaggcttgggacaaaatggaaaattggatttgattcaacaagcggcaaccaaggacgcgaggtgtgaaacggtaggagatgtagctgatgatccttccagcagaattgaattttttttgtctgacctttttgccactctcgccatcgtcgtcatcttctcctgtcgatcggggacgaaaacaacttggcagcttgacttgtttatgtggacagtcttgtgcttgtttcgttcattcacatcatcacagtccttggcgcgctcaagaattcgaggccacacgtcgcactaattctgcaccttctttttcattttttttctgaaatcaattatgcaattcgatttggctaacaataggtaaaggaagctcaaaacaaaacccttatagctgaagctgaaggataacaaatgaaacatggtatttgtatctgactaagtaaattgtgaccattttggggcctaatattgttcaaaagatgtctgaatcatagttgtactaccttaggggtcctttggaacactggaaagtagaatgatttcacgtgaaaaa

SEQ ID NO: 31677 - DNA, 1501 bp, Oryza sativa
gcgacgcgtcggccagcgccgccgcgtaccccgtcgccgcgcggctggacgacaggcggtgctgctgatgaacgacagggggaactggcggcgccgacgccgccgcggcgcgcgcgcgtgtcctgctgctgggccgcgcggtcgtgacagctaggcgcgcgcgcggctgctgatgctgcttggccgaggcggcggcggcggcggaggaggccgggttgagatggtggagcgcgcgcgaggcggggagcgggagcgccccgtggaggtggagggagacggcggcgtccatggcggcgagccacgcgggacacggcgacgaaatgagtggcttatcgcttggcttggctaatcctactacggcgtgatgtgtggctgtgatgcgatggaccggccggaggagtcggagacgcacacgtcacacgctacctgtatatgtgtggacaaaattttctttaaaaattttatagatgtaaaatatagtctataattataatgtaattgtattataaattgcatataacgtacttatatgtagcttttaaaaattgtacggcaaacccactattttcatgaagcgagcagccctcacccgtacgtacggacactatgatttttttttcctttctcgcttgcacgaatcttaaaatgaatctacgatttaacggattaaattatatgaaagttaccgtgtaattacaatgatgctatatatatttacatatgacgaagttttaactatagtaaaatcgaaattgcaattcaaatcgaaattgaaattggagcccaaaacatactaacccaaatctggcccaaaatgcgatcgctaccaatggtctggtctgcgatccaaatttggcccaaaatgatagccgtggcccaacttacggcccaaatctgcgaatgcatcgcgcagcgcttctcatggggcagtggaatcacatgggcctctctttgttgaattatatgggccaaaagatggatcactacatttggcccaaaaaaactgtaaatgcagcgagagatggtgatgggccctggtcgtacaaacggatgccgcatgagaacggctatatgccgtgcccatgccgcctcgctggccgatgtggtacaaaacatttttctatcgcaaggatcaaaggcagagtttataaaagcttaatttgtcgttaagcacctgcagagctcgcatgactgacccagaaaatactttaataacactgctaatcagtaatctggttccattttccacgcacaggagagtgattacttttgcattattaattgatgttgtgatatttatatgaatacatatataaatgatatttctgcaagttgggtgcagttgcagagtaggttagtcccccctaggccaaggtcactcgcacacatccagccccagccaataggttccaagggcccatttgctactccacccacggttttctctcaaaccttcggccctcgaatcagctatgtgccaaacaaaatgctcatatatacc

SEQ ID NO: 31678 - DNA, 1501 bp, Oryza sativa
taaaacaatcggaggattgattcaactgaatatgtacaatagacgcacacaatttatgccaatatgcaagaatctgaccaactaaaactcttctaaaggaaacattcagtggaatagatctgataacattgacaatagtagaacttttctttctgacaatagcgtataaagatggatatttgtctttaaaagccacgtttccgagccatttatcttctcagaaccttgtttcccattattcacaatttttttttgagagtggaaagcaaagaaaaactcaaattacagcatccagattacagtcctctgataacagagaaaataaaaactccggtgctgacactatccagctagaagaagcacgcgcgttaaggctttccttagctaaacggtgcgccactttatttgccgatctcctggtccatatgagcttgaaatcctggaatgactgaattctcctcttcagttcttggattacaggcccgatttcagaccgatcaaaacttttattcatcaccaaactcacaacttcagctgagtctgtttcgaagactactctggttgctgcaagtcttgcacccacccgcgtcgcttcgaggcaagccaatgcttcagcatgcgttgcgcttaacacttccctgaagaaaatcctgctcgcacccataaactcaccccgatcatttctcgctatcactcccccacttcccatctgttcgtctgcagcaaatcccccatccgaattcagcttaatccatcctgattccggcaacctccagtgcattgtcggactaggaacagtatgatcagatttttcaaacaaacttgcccactcttccaggaggaacaaaattctctccaccatcctgtctgggttacctgggatctgttgattccgtgcatcattccgtgctgaccacataatgtagattgtaactaacagcactgaagagatttcttgtgtctgtattgatagttgatccagtagccaaacagataagattttattgtttctgcattcagctggcggttgtggaatgtcctcacctcgatgctcttccaatttctgccaaatccacctagcaaatgggcagtcccagaaccggtgaaaaagggattcctcccgattattcacaattttgtgtgtacgattttcgtacgattttgtgtgtacgatttgcgtacaaagtaacgcttctccgtttattaaatgtttcaagcagaaggttctggcctcaagacggaaataagttcctctccatctggtgaacttctgaatattaatagtactccatctggtgaacttctgaattctgatgcttccaccgacagaaatgaagtgggcaagctgaagcttgctgatttaagctgcagctacccggcaaactttccaggtcaaactcagagcttccaccaagttaagcaacaatggtgagacgtctccttgtcattctcctccaagctctgaccggcctcctcgtgattctcgccctgtggatcgtct

SEQ ID NO: 31679 - DNA, 1501 bp, Oryza sativa; identical to SEQ ID NO: 31636

SEQ ID NO: 31680 - DNA, 1501 bp, Oryza sativa
atagctgcgaccgtttatctccatttcgcgataaaccggccgaaatggacatcgcaccttcggcagacccttcactgccacaaatttctcgttttgacttcgccagctcccggaagggggccggatgcacgactttcggcgaaccccctgatggatagtgcagaaaaagcaaaacacagcttacatagtaagaataggcggaagaagggggaggtatggcataatgtgagatgagcgaaataataatatgccaaagactttgatcatcaaaaagtagttaagattgtgtcatatattccaaatgtacaaaaaagccttttttaaggattggtggtagcctgccgaatgtacatcattcgcctctccaggcaaacgcaaaagagggtggaaaactacaaaactctaaagaaagggcggagggcctcacacctctgggtgatcccgggcatcgcctccaacctcttcgcccactgcgccctcttcttcgcaccgatctgccgcctccgccttcgctagttgctccagaaggcgcaccttggcagcggaccggccgtctttctgccagaactgttttcgccacgcgcgaagagcaggcgaaatgttttgcgccctaatctcccagtcccccttcacataggtagggattcggcgacgtgctcacaaccgaactgttgcaaatgggcctaaggtgaaggccgccgatacacgcgcacagcaatcgccgtacatgctggcgcagtccgaaaccgatccgccagcctgctaggtccactcggagaagtcgaaggctgatgcatcctcagcagggaccccccgcactttcgcgcccatgtcggtaagggcgaggcggagcgtttggcaagccgttctcgcagattcggtggtcttcgccatctcctgtgaaaaccgctgcaactcctccgcggcgctcgcttcagccctactagccttcaggcgaagagcctccatcttcggctcagtaaggttgtagtagtcattcagcaccgccgaatgggccttctccttctccagttcggccttgaggcgatcaacctcggccctagcctctttccccgtatccagctcagactgaaggcgttggacttcagttttcgcctccttgagggtgttggccagggcctcctcctccaggttcttgcagcttatttcgtcatccttggcccgaagacggctcttaaaaccatcaaagcgggcccgtacagttcgcttcgtcgaacagtgagccacaagaacctagatgaaagataggagcgggcgaaaagaacaaaaggttaattgtcagacgaaaaaaaaggggacgaagaggaaaacgaagacgaaagaaaaggcatacccgaaccgccaggcttttaatggcggaacacccctcgtcgaactcattaagttcggtgaacaagctcggggtgccggcgggcaagacaaggttgctcaccccctccacaaagggaataaggtccgcccgagtctcgaaatcaccagg

SEQ ID NO: 31681 - DNA, 1501 bp, Oryza sativa
cttgtatcggagtaatactactgcgtactcaggtggtgtttggatcagggacacatcggatgcttggacactaattagaagtattaaacatagactaataataaaactaattgcataaatgagagctaattcgtgagacaaattttttaagcctaattaatccataattagcacatgtttactgtggcatcaaataggctaatcatggattaattaggcttaatagattcgtctcgcgaattagtctatagttatggaatggattttctgattagtgttgcatgcatcatccatatgtactcctacgctactccctctagaaacacaatattagggatgagtattcatcctctgaattgaacttcttttaagagagggactacttcattggattattgatgtacgctccctccgtccttaaaaaaaaccgcactataagtgagctttttttttctcacggaggggtagattatttgctctacgcttctaaaaatatgttttctaaaaaaaactactatgttggttagatcacttattataaactactccatccgttccacattaattatataagatgcattgtttttctaaatttgaatttcttttatgttaattataactatagaaaaatataacaatatatattttcaacatcaaacaaacatacgtaaagtttaataaaactaattaagtttgattttagaaaaagttaaagcaaaatggaggaagtagttcataagtttatttttaaaaatatttaatatttagatttcttataaccaactagataatccgctataacaataatccagcgaatcatctgtcaaagaaaaccaagtatttttcacgaacgcgtaaaataattacacgtaaatataacttaacagatgcgtgtggaatccacttgttatctgcaaatacaaatgcatactcaatcaaaccaacttgagaaaacaccagtcctgttgctcatacatgcagtagtcagtagtctttttttttttaagaatcactattcacacacgcacttactgctgtcaacgtgtagatgtacttgtttacaaaacagagaggagaaaggttaccaatttagatgtaatcatgtactacactattataattgtaattaagtagctatggcgacgcatgcaaaggcatctattcacacgtgtgccctactcaacgagctgtacatgctttgactggtcagtgctcacacgagtcattctctgcaattaacggaacctctctttgtcagacgtaataaccggttttgtacacttatatcgctaattatcacctctctgaaatgagagatagatgtggatatatctatagacgcaatcaatatatattagattaattagttggttaatttttctgatcgattatatatacatcctccctggactgaatgatttagcgtccctttaattgatttcatatataatttgcaactacacgtattagctggctgttatagctgcctagctagcatgca

SEQ ID NO: 31682 - DNA, 1501 bp, Oryza sativa
cggcgccggcgccgccggcgccatgggagccgccgtggtggtgcttctggtggtggatgatgccctggacgcggcggaagtggtcgacgccgcaggggatggtgatggcgcccttctgctcgaacccgaactcctcctcggcctccttgaggagccccacgaacagcgggtgcttcagataacccaccggcaccacgaacctctctccctccgctcctcctccgccgccgcccacgccgccgggccccaccaccctcaccgccatgcaccccttcggcggcatccctccccccgccgacgagccccccgccgacgccgatgactgctgcctcttcagcaagtgcacacccatccttctacctatatagatatgactatatctaatcgaagaaacgctagcttggtcgatcgatctctagctccgacgacgagcaagaacgcgccgccgttagagcggcgggatctccatggcggccggtgaggtggcctcgctagcttgatggtttcttggctcgaggaggagttggtggaggaggagagcgtagggtgcgcgtgtatatgaggaggccggtgactgcgcccttttgtttctatctgtgaattttttttttactcttttttactatttatgatttattgatttcctttttcttctactgtttcttttcctgcagctgctgattttcctggtgagaaataaatgtcatatctctccccataaatattactccaccatttcaggagtgatattaattaatccagaaataattatttatcttagctttctctttgggatgtttaaaagaaatgtgttttttttttgtgtgtagctagctgttggagatagagcaaggcactaactctacagctttgtattagctacagcggagagggcatctgatccctccgtagagtgtagctggccagtatgccctggtgttgcctaggctttgtgtgcttacaagtgtcagtgagaacaccatgtgtttgagatttgagaatgtggtaccatacatattagaattagttagaatcaatttaccatgttgtatattaactctattattcaaagcaaaatatttatatctttttttactgtaggtaatatctatatcttatagcttcgttaattcgaagtaattcatacatttattatacccacctacacctacctcggcctggtagtaacggatatctctatctctcactagagatgttgccggtcaactttaggagacatctgtggttcctataaacgacataggaaagatagaatttcgtgtatgctactgtcacatattacaccaaacgctcgctcattgtatctgtgcagtctctcacaaacgacataagtagtgatctggcaagcataaaaaaatttaaagcctagcaaaatacgcaatggaagtctctagacgccgatgaccaaggtcgcaggccttaaatctatccaaggcgatagaatacatgtggtatacatattgcttgcaatctgcataac

SEQ ID NO: 31683 - DNA, 1501 bp, Oryza sativa
tacctcatttttaatccaagagctcctttagaactctagaggaatagtttgtttgtgggctcatcagctgcaacaaaaatttgaatttcgaacctaattttagagttaattttaagcatttttcgtcgtagtttatttttcagcattgaaatttaggggttgttctgattatagtcaaaataaacattattgtcaaatttttggcaatttggtaatatcgccaagttttggcatgattttttatgtgtttactaaagtttgataaaaaaaactaaatagacgcaaagttttggcaactttaccaaaatttggtatggtttaaaatgacataaatccgaacaaccccttagtaaatcgctaagaagtaagaacacatgtataataatttacccatatattattatatctcgttgcctcgttcatcttttaaggactagtaatccatttcattaaggtcctgttcatttctccaataagagtcggatgaagttaaagatttttgtagcacgcttttcaaactgctaaacggtgtgttttgtgtgaaaactttctatatgaaagtttctctaaaatatcatattaatctattttcaagtttgtaataatttatacttaataaatcatacgtaaataccacctcgttttacgtaaaaaacttaatcttcatcatcttcattttctggagaaaagaaaaccacctaaaccgtagaacaaactgtgagaggttaaagccacggtgaaatggtggtcaaatgtactggaaaataaactagtgatccatttcattataaactaatcaaggttatgaagaaacaaactaatccttgatagcagagagagagagagagaggcaggttttgggggtgtaataaaaacggggtacagacacacaagtggacaacggaagcatcaactgccccggccacccgccgtgtttctggagcgccccccaaaccaccccacctcacacacaaacaccaaacacccactccccccaccacccacctcccgccacgagtccacacggccccacctgtcattcaccccgtactcattcattgccacctcccctttctcccccttttccgtttcccacgcacggcttccgtacgcggcgccacgaacgggtcactgacgcgtgggcccaccccctcgtgggacccgccaccagaaaggcgttacaataaaaaaatatttcctggcacttttgcacattggcccctgggaaaacgtggaattgacagtcgcctccctggagtgatgtaatgtaagcccgaggtgaggtgggggaggagagagaaattggtaacgaacgccatttccgatttctctctctctctcctcttcttcttcttcttcttccccaacgagcgactcgcctccacctcctcgacctccacctcgcgaggcggcggtgcggggggccccaaaccctaaccctaattccgctgcgcccgcgcccgcgcccgcgcgcgccgacaggctgttgttgttgttgcca

SEQ ID NO: 31684 - DNA, 1501 bp, Oryza sativa
tttctgtagatgtttcgccactgcgaaccatcggcggggtgtctcagcatccgtcctgttgacgctcttcagcgtgccatcgcaacattctagcattccccttgttcctgaacaaacgccttagctgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctagttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccagtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagac

SEQ ID NO: 31685 - DNA, 1501 bp, Oryza sativa
gtttggtatgtatactgatatttgtgtagcaaaaggtatatcttggagcattttgttttctgataggaaagttggtgcgcgcacacattactcttattgtgttgtgattatctcttgcttgcgtgtacttaaaactttactttctacgtcaatcgccttttggaattgctgacaataacactaaccgttgttgctagcatctgaggctactggcgctttgcattttgtcggtctcgcaccatctattttgttggtgggtggctaggttagttgcctgtattgtaggtgggatgctacacatataattacctttttgtttggcgtttattatttttaggctttactcgtatgtcattacctacatagtttatctagctcacactcaaagtgattatgcccagacttattttatgttgatatttaggttgcatttgggaaagaagaataggctgaatactggcacgaaaaagaggagagtcattagagcatgattaattattagagcatgattaattatgtattgattattctaaattaaagggtttatctttttttaatataactgttatataatttttttacacgcgacatattgtttatagtttgggaagcgtgctcacggtaagtgcgtattagcccagcccaaactcacattctaacacactcttagttaattgggaacatatactgtacacacgagctttccgtgcacactaactatcaaatatcatgacttttttttcaaaaagatggacatgtattctaatagtattaggcatatatgcaaagtctcgtattcaaattcattatattttagtcgtaacaaaaaaaagtgaaaaatataatagttttaagataagatttcacacataggtgtaatactattgaaagtatgagtccaaccttttatatatttttttacgacatttactagttggtgcgtacggaaaacttgtgtacataggatacgtttctaaattaattataattgaataaagtagaccgtataaataatttctagccacttcccactagcaaaaagatcaaatgccatttactctttagctagaggtttctatggctaaagtgttcatgcaaacacttaactctatatagttcattccaaatcatagttgactacatctacatgtctagtattgcatctgtcaacaaaatgggtagctaggcaatgcatttgtgtgttgaattagctgtctccctatagcaattcaaccatttaaatgcgttaactaactcagacaaattatgtagttcccttgcaaagggggtaaaaattaaaaaactcgcacatgtacttgaccagtcaacctcagtgtgtagtaagttgctacgctagacagtacaaaagactcggtatttttggaaagaaacacgaacctaatgccggattcttgcacagaaattgcctacatgggctccattctatactccaattataaacttcaactttctcgttagcacatttccaaaagtgtgtgta

SEQ ID NO: 31686 - DNA, 1501 bp, Oryza sativa
tctaaaaaaaaacaaagaaagaaatgtcactaccctaccctggggtatgcgtagcaactcccctgggacccaggcagaattccccctgccgtcgcccaggccggcctaggaacggccagggatcacaccgtacattaacgacaaggcccctcgcaccccacaggcccatcccatcccacccgcccatccctcccgcacgaatctcaaagcgggggcaaacccgggattttgccgcgccccattcccggggcggaaaggcggaggaggcgggcgagaggcgaggagggaggaggaagcggttcgagggtttaagaagccttctcccccaacctctcctcggactcaaagcagagagaggagaaaaaacacaaaaggcagcgaagcggccgcgaaaagctcgactcggagataaaagggaaagcgagcgagaaaaagagaggagaagcattggtggcgtgaggcggttggagcggggcacgcgcgcggcccaaggggggagaggagaaaagaagccggggtggccccgacgccggcggcaaaggttggttgtcctagggttcctgtcgttgctcgcgggaagggtcagcgaaggtgagggcctttggttacccctaactcaattatgtgtgaacagtgcttctccgtttgtgctctgtttatgtgtgtgtgtgtgtgtgtgtgtgtttattgaggctttgagtttttttttcttgagggggttgcttttgctgtacaggagaagatgatgtttaagtttaatttaatttaatttattttttttactcgctgcggtttgagcgttcgtggagtggtatgtgttgcgagcacacgggtgggtttgtggttatgaatgtgtgtgtgtgtgtgtgtgtgtgtgattctgtgcaatgcttgatcaggtggcgagttcctcacttcggtatgttttaaatttatcctttttcgggcttcgtttgatgttgctctgcggtctgcaccctctagcttggtttaggcatgagattgtatgcaaggtgttttctttttaaccaatttcgtgatttttgggctagttggagacttgtttctgttcagtaataagtatttggggcagtaaacttttcttttttggaagatgtaatttctgttttcgatgggcgaatgtgtgcgtgatctcaccagcaagtccccgcctttggtgtgcttcacgtggtgtcctccatggcctcatggggcaggtttctctaggcggtggattttatctgctgtgctggatcacaaaaaccatgggtaaaaactaaaaaatcgcatttatttggcattttgctatgatgatttcgatggttaaagttcttgagttttttttttctttttgggtaatggagcttgcatatttgcttgctttgtagcattacatgtgtagttagtctgtactcgtataggttctaaaattgaactgaacttacagaattcagttgagaaattatcactaaaaatgatcaccttttgttgtccagcaaaa

SEQ ID NO: 31687 - DNA, 1501 bp, Oryza sativa
taaggaaatttgcagattatctaaacttgttgatttatataccctttttgtctatgagtaggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctatacccctgctactgctgttattgtgggctacttgttaatacacctgttccttgttttatgttgttgctgcccctctccaagtatctttgcccctgcttctgctgcccaatgtgttccttgttaaatggccagtgatgaattgctcaataagaacagattatctacacttgttcatttttttatctattcttctttttgcccctattgtggctcaataagtgatgaattgctcaataagtgaatcttgaatgtggatttaagtgcaactgctgctgtctatgtttgcccttgctgtctatgtttgcccatgctgctgcctatggttgcaactgttagttaagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatatctctacacttgttctttttttatgcataagaacagattttgtgcacttgctctttttttatgcataagaacagattttctgcacttgttcatttttttatctacaataatatatgcatgatttatataccactgctgttgttgcccctgtacttcttgttaaatggccaaggatgaattgcttaataaaattctatctatacctgttcttttctttatggataagaacagattatctacacttgttgatttatatacccttgctgtctatgtgaatttccctctgctgttgctgtttatgtgaatttccaccctgctgttgctgtttatgtgaatctccccctgctgttgctgcccctgtggcatatatacccctactgctgttatatggccctgctactgctcttattgctgctattatatggccatgctattgctactgctctaatttcctgcacttgctattttctttatggataagaacagatgaactacacttgttctattttatggataagaacagatgaactacacttgttctattttctttgggttgctttttcctcctagtagctgatttcctctttttatcccttcatgcaaatgattgtaattgatgcatatttctcagcaaaactgaggccatatctttcatagtgtaccccgtattacattggatctaatgctatttagtctaatggtaggaaatttataatctttttcgcgaaagttaaacca

SEQ ID NO: 31688 - DNA, 1501 bp, Oryza sativa
attttcctacaggagaactctgatggatatctgttcatgaagcaagtataaagtctcacttagctacagaatgaaaatccttaagcatgtagttgaagaagaaaatattgttacctgttctttaaaaatcccagtatttcaagtgcagcttctgcttcgaattgattacagagcgattgtgtagcagcatttttcccacactgctcacggccgtcagctacgtcaaagaacatgtatggaccaagacagtcatgaccatggaatggagctgacttgtcagcagcctgagcaccatccagcaatttattttcatagaaatgcaacgatgggaatctgctgatttcaggatgcattcggtactgcagtcaaaaataataattggcataaatcagcagatggtttacactgactgctcttctcacatacagatgtacgtagctgcatactaaaagacattggaactctgtatgaactatgaagtatggatatatttttaacatacgaaaaaaaacaaaatcatgttggttccttttaatcatgttaacaactgagtctgttttgtaaaaatggtatgctaaggtttgctcatatataggaatgagtccatgcacaaaattagcgcatagaactaaatctcaggaaccagtctaacaagggcatgggaccatgcaatctgacacaagtaaccaagcatcactgagctacgatatagtattttaccaaatcaaaaataacctgcaaaatttcctgtttacttcactaatctttacttccacactgcaaaatttacagataaaaaatctatactatagaaatcacggagcatatcacggaaaataacctgtttggtgagcataatcactggataaccagctcgttgtaggcgttcaaacatactacactcataaagaaatttactagccaatccagacatcaccgtagcaggtagctgctttggatctccaaccttcaagcaagacatcagtaagcaaaagcaagtgccatacaattgcatgaaggtgtaggaaaagaagtaacagaaattaccattatacatttagttcctttcgacttgagtagctgaagtggaatcaaagttgcaggctcaagagcctacagaataagcccaaacaaacttagttttaattcaataaaacatagtgcgatcatcatttagaagaaaaaagttagtattgcgataatacctgtgcagcttcatcaatgacaacaacgtcaaacaaagcatgctcagaaaaattcacaaatttattagctgaagcggtttccgagcaaacactataaatgtcacctccacacccactgagtgttgtcacaacaatttctgcttctccaagaattgactttcgcactttgtgcttaagaaatctgttttcatcagctattttcttttcacgtgcatgagcagtggcaagttcggcagaaactttccttttctgtgcatacagaaagttgagctttgcaccaattgcatcatcagaaa

SEQ ID NO: 31689 - DNA, 231 bp, Oryza sativa
agcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggca

SEQ ID NO: 31690 - DNA, 1501 bp, Oryza sativa
  unsure (1)..(1501): unsure at all n locations
gccgnctttgcgccgccgtctccgccgtcggttgccgtcgtcggcaacgcgcgtgcgcgtgcgcgcgccgtcgccgtgaccggtcggccggctttgtgccgagctgagcctagcctgaccgccgccgcaccgtccgatcggccccgggccgatccgggccgtcgatcccgtggatcggcggtggatcactcgcgtggtcccggtccacggtagaccggccacccttgagtcgctgaccagtggggcccgcatgtcggcgccgcaccccctccgtgctgacgtcagccctggaatatattgcgcaataaatagtttaaggtttttcttgtatagtaataaacacagtgaatcttctaaaaatcataactaatccatccgagctccgtttaagcccaatcaagtctcagtaaatcaagaaaaatgtgtagaatccattaaaaatggttttgttccctgtttcagtagtcttatagcctgtttgcaatgtttgccttgtatgtcgctagattccggctcttccgacgctccggtgtacttcgaaatagtcgccgaggttcctccagcagcagagcaaggcaagtcatgcttgtcacttgatcatattgatcctatattgcaaatgtcctaatgttttctttcaaataccgcatttgttttgcaattatactatgggatggttaccttttgttacagccatgctttttggacaccatgctccttgttagcttgggttataacatgattagactttggactaggaattgcttagccatgcttagttcaactagcacactatggggaaatctcatttaaaacctagactataggtttatatgataatgttggattagtaccaccgctctggtgttggttaaataaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcttttgaatttggatagttcaggtggacggttgggcctgtcgcaacatgggttagcgttggacagtggatagttgatgttaattaattattacaactgtttaaatctttcaatttc

SEQ ID NO: 31691 - DNA, 322 bp, Oryza sativa
cctagcaaatggtttagtactccatccatcccataaaaaacgtatcagtatcaatgtgacatatcctaatatagatatatgtttaggtactccttccgtaaaaaaaaaacctaacctaggagttcgatgggacataagattatgtctcatccaacttctaggttagtttaatttttttggatggagggagtatcatatctggtaatatgttggttttttatggaacgaagggagtacaaccgtttttcattctccccaacagtgagctgtgatcacagcgagactctgcctttttcttccatttctccttgtcattttcagc

SEQ ID NO: 31692 - DNA, 1501 bp, Oryza sativa
aaaaaccgatggaaaaaccgtagaccgcaaaacccgccactttggtgcggttcggctcggtgtccggttttcggtaatttcttgcccacccctaattactaactacaggcctagagccttatttaagatatcttagcaagatccaaaacagtgattacatgcaaaaacgttgcaattaaggacatttgtttgaaagattgtggttattttttcttagaaagatatgatggttttaggaaacagaaacggaagtctgaaactgtgggtataatacataatgccgtgaaaaagcttcaggatggaaaccacgattatatccaacttgtaccattaatggacttgcttctggctttgacttagatagtggttggcaactattaattttatggaccaaaaactgtttcacgccacaaggtggtgttatgtgtaataccttagctgattactcataagattttcagattttgcacccttttaatctacaagaagaatcaaatgctttgttctcatattggataatataatgcctctttccatatttaacactggaaagttctccctgccattccttttacatttgattcaatcttcaatgttccattagtatcacttatattttttttgtttagtaagaatattaagtatgttgaaatctgtagtaggatctgacctctataattcaactcaatgtacaagttgtgttcgatcaagtgctctaatatcatgccaggaggcatgttgagattggtttagccttgtatggctttaacacatttggtctgatttgtctgctttaatttcttataactgtattaacattaacagtaatatgcaggaaagcagttgacttggaccctttgcaacccttactgcaaaaatatattaattttttggaagccgaagttcttccatctacttcagaatctccaaggcctagggtgcagctcaaaagagccgatatatggcttggatttaaatcactgtatgtaagtttaacacatgtattacatatgacttaccatgttgcttcttccaattttttacctgtcaatgtattgactttgtttttgcagccttggatttcttgatgcacctgctttcgaagatggaatcttggagagataccctatattcctgaatattgtacttaaccatgtcagtgatgatagatctgatttatcatgtgctgttagttgcctgaaagcatcatttgaaatgcttggtaagtgtaactactatgagtttttgctgtcctatgaggctatgatgaacttttcctgttgcaaacttacacattttcttgttttaggttgcaaactttggttgagaacaaccctatcacctaatgtcatgcggaacacattgttgggccattgttttcatactagagatgagaaaagccacaaagaaatttttgaccttttcctcccatttctccaggcatgtttgttgttcctttgaatccaatgatattcgcatatactgatcattagtgcattat

SEQ ID NO: 31693 - DNA, 260 bp, Oryza sativa
tagccccaaattttagttggtaaaaagaaacacgaatattagaaaatgacctaatatcaaataataagaaggggtgaggtttcgaacccaggttatctagcctaccatcttgtgaagctagccggagcccgaaaaacctttaggtgtttctcaaattatagttggtactcaactgatttatgcgcccaggtggtcagatgctagccagtcctcaagttttaattgaagtctataacaaatcctaatcctgttatccaagg

SEQ ID NO: 31694 - DNA, 227 bp, Oryza sativa
agaattgtgggtattcccagctttatttctgtagatgtttctttggacattatacagtaccaggaagggtatgtgcactttcatgttcttttctcagaagttatggaacaataggtttgtagacatgtaacattcatacttgtttgtttagatcacgaagaaggaactggatacagctgtaggcatacttttgccaggtcatatcccaagggctcaaaaaagactga

SEQ ID NO: 31695 - DNA, 1501 bp, Oryza sativa
ataaggattttactgatgccagaaagagctagcaaccactgtgtgtatggcataacataacctctattatccacagcatcacacatggaatttagatagatgtgcactagagaataagtaatttcgtattaacatttgaaattcatagttagaggatatctggaaattttgaaaaatatttagtcctagaaagtatcgtttaagagggctctcggaattcagatcccaggggcaaggagctccaaatggtaggagaagaagttcatttctaaacacaggggcataatattatctcagattctcaatctccagctctggcttcactgcctaaacaaaaaccaacaaaagcaggaagcatatcaaaaccaccatgaaactacagcactacgctactatcagcgccagcattctcctatcagtctataactagcgactgccaccaagtattcttgtagtataacaagaacaaagggctttccaacattagtatcaggcaacaaggaaccatctcctggcagtcctgatggtaggcctgtcaattgctttcattttagtttgacctgtcagttgtagcagtgattttgtcctgcaactttgaacctccttttcatctgttaataagttcgatagaattcctacctctctctcacaaagaaaaagttttaaaatagatactgacctaataatgtccaggagtacatagttcttcttgatgtctttcataaccatgataagtatggtccctgcattgaatagtagtcaataaataagatagcctgaggttataatttctaggcatagaacaaactaaactgagaactacttgcacccaagctccaaaacatatccaccttctaactaagaaaagggactgtaagtttataccatttcttttatttgattttgccaactacatgatgtatcaacttgatactatagcactgttgagctacggaaatcctcccatccaaacagggtaaatattccatcagtgattcatcaatactcaaaatgagtgatcaaaccttggaaaaaggccagcttcttacttgaggttattaatgttatgtctctattttttttggagatgcaattctacatatgacttaaactgctgatcaaatacgaagaaaatgaataccgaatttaagccgcgtgatcaagctgtttgtcttgcgctgccggtgcagctctgaggacacaacgctgagcttgtaaaacacaaaggcaagggcagcatcaacgaagacggaaggagccgccttccacagctggtagcacccgacatatccgagaaacgcacctgcaaatgttgatacacattcaccgaataacataagtggtctggtgatcagaaggatatacaatcgacggcattgttaattgcggtaagaactcaactcaaacacaccaaagagcatgccgatttgatagtcctcgaagtcgtaggcgctgcggagagagcaaatgtcagctaggtttcgcagcaagggccggaaca

SEQ ID NO: 31696 - DNA, 1501 bp, Oryza sativa
cgtaggcccgctagtccgctgctgtttatttttgattgtcaggccttaagtgcctttgtaataatgtaaatattatcgatttaataaagatgtgtcttttatatcatgtttgtatggtgtaccccggcttttcctgggacggggattaatacactagcgttcgggaaaatgcaattttcccggtcgcgacaagatggtatcagagccatctcgactgtaggataagccaagtagataaaacctaaggacttattttataaatgaaactatttgcgaaagtccctttttctcctttcctcaatgctatttgcaaaatgtttactcctttcttccttcttcggatttccaactagtactacatggttggttttgcgaagaaaaagatgtcgccaattgttcgccgaagctccggaagaccgcagggtctgctagcgaagtggaggaagcagtgaagtcagctgtgaagccgaagttaagatcttggagaaccagccgcagaacctaagccaccctctagggtttcgttagtcgtgtgtttccttgcttgtgtgtgtagcgtgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctccctagtgaatgaagcaccagacaccagttgtgtgacactggtccaacacctgattaaccagaaccgattgcttatagagatactacagcagcatcagacgccaattctgaacctgagtcagatacaagctcaagtgcagttggaggcagtccaatcactcacaccacaagtcagcatgccgccagcatcccaaaagacccatggtggcgtgccacatgttgactcaaaagaagcaagtatcatttgttttatgtgtgatgagcaagggcactatgcaaggaactgtcctcagcagaaaagaaaaacaccaatgcgaaccgaagatgaagtccgtaagatgatcattaccagcacagaatggcctccaccaggaatgaccaaacgtcagagaagaaataccttccgaggtgcaccacagttgacagagcatcttttagctaatggaggtagagtgtctgatagtgaagattcagatcaagtctccccagatgatgaagatgagaagtctccccaaagtttcaaccagaataaaatggaacgtaaggcatgctctcgttgtggagaaatcggtcatgttgccagctcgtgtgccactacatgcgttcattgtgaggaagaccatccacccgacaggtgtcaaacgagcaggatcacctgtttcttctgtgaaggaactgatcatgtaccaaaagattgtcaat

SEQ ID NO: 31697 - DNA, 1501 bp, Oryza sativa
ttagatcaatgtatctagctctgattaataatggttatattgagagaaataagattatttgaaagcttaagatgtcgcttaagattaagatctttatgtggtacttgcttaaaggagttgtactaactaaggacaaattggcaagacgaaattggaatggcagtttaagatgttgtttttatatgaaaaagacaccattaaacatctttttatagactgccattatgcaaaatttgtttggagagctgtacagttctcttttggtttataccttcctattaccatatctaatatgtttgatagttagcttttgaggtagataagaagatgactaaactcatacttgtaggagcatctgccatatgttgggctctgtggttgagtaggaatgatatggttttcgacaaatcaccatctatatcatatatgcaggtaattttcagggcaacttattggctccggttttgggcacagctgcaaaagtgtgaagatgatggagagcttatgaaagttgcatgtcataggcttgagacgacggttatgcaactttttacaaactatggatggagatttacaaacagacttcaataaatgtgttctccttatctttgtttggtctttttattttattggatgtgtttaatttcgtttgaactacatcttttgttagagtgatactttgtaataattggctgtagctctgatgagcaaaggccgggatgtttattccattatctaaaaaaatgtatagcggtcctctcaatgctagacacttaattacactcgctcacttattatattgctggagtccaaaatactcgctgatgtatccctctgcatttagagtttgtttggttcttggccacgttttgccaaacctaagcttaggcatgcaacaagtgcttaggttggtgtttgcttttctactaaccataggcttgccttaacttgataggcatgtttctgcttgctcgctgtgtcttgttttgccaaatctgtggcgttctttttctctgccacaagtgcggcaactagcttaccttaggcgtggcaattttagtcccaaaccaaacaggcccttagtccgtccccctaggctcctagctatctctcctaatcctatatgtgcactttgtcatttctcgtgtttgcatgagcgattggtgttttgagttgatgttttatttatttctctatcaatgagataaggaaaatcttttatctatgtttggaaacagtagcatgtactacggaattgtctattcatcacttgagggaatatccattcatttttttaaggtctatgtgctacaccatatacgagttatatgactaggtctatgtttcgcaagaatattatattgcttaatgcctcaatggcgcatagtgcagtggtcctgtacctttcaccatctgttgaaaaacatgaaaattaatactaaaagaccagcttaagttggcctggtttcaaaaatatatacaaccaggcttgtctcaatgt

SEQ ID NO: 31698 - DNA, 1501 bp, Oryza sativa
aaaatcttttatctatgtttggaaacagtagcatgtactacggaattgtctattcatcacttgagggaatatccattcatttttttaaggtctatgtgctacaccatatacgagttatatgactaggtctatgtttcgcaagaatattatattgcttaatgcctcaatggcgcatagtgcagtggtcctgtacctttcaccatctgttgaaaaacatgaaaattaatactaaaagaccagcttaagttggcctggtttcaaaaatatatacaaccaggcttgtctcaatgtaatatatatgtttacccactcagtatgggtgggcgttcagtctggaccggaattcttcattcccggttattcggtcattcagaactttggtctttcgaaacagaaaattgaggtaggcaacaaaaaatatggttgggagtgatagttcggttaaccggatagtctgtccggccttcggtttccaccgaactaactgaagcgatggtgatggcaatggcgcccacggcagcgatgacggatgggaggatgctagtggcagcggtgaccctaccctccctctctcatatccggtggtggaccgacaacggtagcatcagcagagggaacgaaagcaacgacccttcactcctctcccctcctagaaccaagcttcgggtgcatcgtctcgtcgacggcggctccttcctgcctcgaggtgctcttggcaacggcagccatgatggcatcgacgatggcgacggggggcggatctagtggcggtatggttggagaccaccggtagtggaaggagtagatggggcaccgcagtggcttccccactcccttccgcttgcctccctctcccaaatctggctgtagggggcgactagggtgtggcggcggcgatagcagccgaaggggttggtttcggcaatagctcgtccacggcagcttcagcaacctccaaggtcaccgatgatgacgacgaccagttttgatgtttatttgcatgatatttcatttgcatgtgttaatcttggatgtcaatttgaatctagatctctgaatgttgattgattttttttttccttagtgatgttgcctataaaaattaattttctcaggtgatcatcttaagtgtttgcaaacaaaaaatctattttcgtaagcggatcgcaacactgctagtcaaaatcatttattttcaatagcctttaggtaattagcggctaacaatgccgtcactaaaagccgctatcactaaaaatcagttttgaccgccgagaaaacactttatgaagtgtacaaccatttactctccccgtcctaaaatataggaaccttgtactgaatgtgatacatcttagtacaacgaatctggccagagaccctgtccagatttgttgtgctagggagtgtcccatttagtacagggttgctatattttgggacagagggagtagaaaaccagtcgcatgtttatctgaaccaagctccatacattgagggc

SEQ ID NO: 31699 - DNA, 1501 bp, Oryza sativa
gctgacaacccactgcccccagcactgggtgtagagctttcggtcgttccctgcgtgatgtccgatggcctgagagattccgacccagagcaatagagaagtacgatgggagtactgacccagaagaattccttcaagtctactccacagtactctacgctgccggagcggacgacaacgcgttggcaaattatttgccaactgcattaaaaggctctgcacgctcatggctgatgcatctcccgccctactcgatttcttcgtgggcaaacctgtggcagcagttcgtcgccaatttctaaggaacttacaagcgccacgcgatcgaagacgatctacatgcgttgacacagaactcgggtgaatccttgagggaatatgtttggcgctttaacgagtgcagaaatacaatccccgaaatcaccgatgcttctgtaattcgcgccttcaagtccggtgtccgagatcactatactacccaggagttggcgacaagacgcataagaactactcggagattattcgaaattgttgagcgatgtgcccacgttgacgatgcgttgagacgcaagaacgacaagccgaagaccgggggagaaaagaaaccagccacggacgcacctgagtcaagcaagaagaaaaatcgcaagagtgggaaaaggaaggctcaagcagaagttctcgcagcagaatacgcgaacccacccaaacgctgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacctctcctccaaagcttctcttactgaagggggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccagctcgtcccaagccaacccaggccaaccattccatattttagttgttgagcaaattttaagaattgaaacactgacctgggtacattgctaggcttgcccatatccgagggctcggctattcgaatagatttactctgatcagaggtgtacatctttacccacaagacacctctccctcacgtgttgccacgtgccacataccaccacggtatacggacggaagacgtgacatagt

SEQ ID NO: 31700 - DNA, 1501 bp, Oryza sativa
cccttcgaccaaatctgccgaaacccgtggcgaaagctatggagcaagaacggcgtgaggcgaagagtcgtacgagtgccttgccaggccagaggcgtctcaggcgaagggtgcaaggcgaagactatctgccgaaggaagacgacttcgccatggcaagttcgcccccgcgagggccgaagaagcctttccggcccatcaagcctaggggctatagggccggcgatcgccagacggcccatcaggggcccatgagcccttataacattatgtacccctgtaaatgtcccttttgtaagtgtaatcatgtaaattctcctgtacaacctaaaccctagtagtaagaacctgtaatggggctataaatagtcccctagggccatgtaatgggggaatccagaaaaaaaggaagaaattcaagattcaatacacttcgtttccttccaaccactgttgagtaaccacgtctttcgacgtatgcagttgtcatttcgacaacatccgtaaaaaagataaaatattaatatcaaaagtagatcaaaagtagatgaagggagtatctctctaagtgaaagttggaatgtgccacatcatgcaatgaatattggccatcggattcagaaaacgacaaactagccagagggagatggtcatacacgtcggctcagatgaatggttaaaatgaaactgaaaagatgcaactagacgagtcagggaaaaaaatcacttctctcctcgtgcactttccgccattgccgccggcgactagtcgacccctcctcctcctcctcctcctcatcgccacagacgcaacctaccatccttcctgacgccattgccgaatgctccgtggggggaggatgagactcgatgagggggctggagaggagaggcgaagacgacacaccagcagccccatccatcatcacgcctcctcagttttccccgcgcagattcagcctcccatcccccagcgacctggcaactatggtggagctcaagaacctgtaagcggtggagaatcggcgtgcgccggtgatcgattttggggaggaggaaaggacgagcaaaggcacaagaagagacagcgagatgggtctgggctaggagacgttgttgggctgttgggctgttgttgggcttgtcctacggatgtgctgttcctcttcaaaaggctcgatggattgtcgtgggatggaaggccgcattgtctgttgtaacaatatcccctcattctatgaaatttcctaattcgggcgacgggacacgtggcgcgcgcggagagagaggagagggggcggatggaggatggcacaattttcctttttttttcttttctagtttcttttccttttttttaggttctttttctgttttttcaatttttaaataaacttttatacacgtatacaaactttatatacgtctagacatgtatatgtatgtcagggttacgggttaggtagaccctttaccgttcgatatacgttacatatcgata

SEQ ID NO: 31701 - DNA, 1501 bp, Oryza sativa
gtaggggaagaaatctagagcactgatttttaatctggttcggtggagatgtggctgtaaagtaagttcagcaggtcatggcttgatggtgacttgtctgaaaaaaatctgtttttcaggagggtttacttgtctgcttctgtaactgcaagcacttgaggttcagacgattggatcaggttgaggttccaactgattttcagatcatgtgggacttttggttgcaccatgaccatactacaaggtagactagtgagtgctattactttcgatgatattaagatgatgatgatgcggcaagtgccggctactgcaactgaactctgaacactgaaagatgaagatgtgccctgcgattacacaggagttttataggatttttcacgtgaaatcattctactttccagtgttccaaaggacccctaaggtagtacaactatgattcagacatcttttgaacaatattaggccccaaaatggtcacaatttacttagtcagatacaaataccatgtttcatttgttatccttcagcttcagctataagggttttgttttgagcttcctttacctattgttagccaaatcgaattgcataattgatttcagaaaaaaaatgaaaaagaaggtgcagaattagtgcgacgtgtggcctcgaattcttgagcgcgccaaggactgtgatgatgtgaatgaacgaaacaagcacaagactgtccacataaacaagtcaagctgccaagttgttttcgtccccgatcgacaggagaagatgacgacgatggcgagagtggcaaaaaggtcagacaaaaaaaattcaattctgctggaaggatcatcagctacatctcctaccgtttcacacctcgcgtccttggttgccgcttgttgaatcaaatccaattttccattttgtcccaagcctggtcaaaaatcagttttgcaggtaaaagatcaacatgcaccttccctttcctgtaaagaggcatgagcatattttgcacactcagcatttagattgatggcccctttgtttctcaggtagaagaaaaagcttttggtttgaccatttcaaccaccaacaaacactttgaattttgacccaaacagttattactactactgccgagtttagttccaaaatttttctttaaactttcaacttttttatcacatcaaaacttttctacacacaaacttacaacttttccgtcacatcgtttcaatttcaatcaaactttcaattttgacgtgaacacgttgaagaaagaaagatgctgatatgcagatatggagcaatgaatcaggtgaggtaagtatattcattcctccatgctatgttgattgtaacaataaatttccttattattttatgattttatcctaagaaaaaaacaattaagaacagtacactctctcttcattgatcttgttgactggtgtacagttagtgtgatggtacaagtgggagacgcggcgtgtgcgttgggatcgccgcgaac

SEQ ID NO: 31702 - DNA, 1501 bp, Oryza sativa
tagccaagccaagcgataagccactcatttcgtcgccgtgtcccgcgtggctcgccgccatggacgccgccgtctccctccacctccacggggcgctcccgctccccgcctcgcgcgcgctccaccatctcaacccggcctcctccgccgccgccgccgcctcggccaagcagcatcagcagccgcgcgcgcgcctagctgtcacgaccgcgcggcccagcagcaggacacgcgcgcgcgccgcggcggcgtcggcgccgccagttccccctgtcgttcatcagcagcaccgcctgtcgtccagccgcgcggcgacggggtacgcggcggcgctggccgacgcgtcgctccgagccgggacgctggccagtgccgcccgccacgcgcgcgcgctgctcgtctcggacgccgccgccgccgtcgacgttgctgaggattcgcgggtggtcgcgctggtgaggatgctcgtcggcaagggcaaggccgccatggtcgccgacgtcatggccgagttcgtcgccatctgcgaccgcctcctcctcctccccgcgcgcccccacgccgccacctcttactaaagaattacattactctgtcagactctgctacgctgcaattaaacctcgcatgttcagaattgctgcttgttcattgcaacacttgcatattgccaattcatttctcagtaaaatatcagcttaaatctctactcttttttttttgtcgggccatacatgctacgtcccaaaatatagtaatctaggatcggattggatatatctcaatgctacgaattctagattgatgtattttagaacgaatggagtaatttacataatgttattcctgaatcatcatacatcatgtaccatgaccttcaattctaaatactacctccgttccaaaataaatacagccgtggatatttgtgcccaacgtttgaccgtccgtcttatttgaaaaatttgtgaaaaaattgaaaatatttagtcacacgtaaaatattattcacgttttatcatctaatagcaataaaaatactaattataaaaaattttcaaataagacgaacggtcaaatgttgaatgtgaatagtgcataactgcacttattttgggacggagagagtatgttgtactgtggttctgcagttcttctgctgcaaaaccgctgccaacctctaaataattcagggaccttgatctttattgcacagaaaaaatttgaagctagcaagctgtttcatctgtcacagccttggggtttataaatgagttcacataataaaaaggacaatcatatattggtttggatgatgcactagccacattatgcataatgccaaactcataattctcaatagaataattgagtcataaagttgtggttgtgcaaccaactgaaacaggaaagcagaggaacgtgagacgccatgggagattgacactgccgcagcgtgatggaaggtacgtagtagcagttgagaacctgtactgtatat

SEQ ID NO: 31703 - DNA, 1501 bp, Oryza sativa
actttagacttgggaaattctcatatcatttggacactgtggaattgttggattatgatggaattggacatacacctctattcctctttcaaaacccctaaaacctgttttcggtggggtttgggtgcatgccagttatgggaagtggcaccccggccactataaggactaaagctcgggcctctgttgcaaagcactaccgtaattccacatgtctaatcggtaaggcttagtttgtggctcagtctagtcataaacaaaagtacacggattggagatggatgaagtcgggcttcgatggacattctccagggcaaatgaaggctacacgagctgcggcccggtagtcgagatgtcatacggcgagggttggtgcccaatgctaggggctcagttctacctgcctgtcccgggtatcccggccgtaggtaggattgggtcggtactcttgtctaaggctaggatgggttggaaactatgtcacgtcttccgtccgtataccgtggtggtatgtggcacgtggcaacacgtgagggagaggtgtcttgtgggtaaagatgtacacctctgatcagagtaaatctattcgaatagccgagccctcggatatgggcaagcctagcaatgtacccaggtcagtgtttcaattcttaaaatttgctcaacaactaaaatatggaatggttggcctgggttggcttgggacgagctgggacccaggtcgggttgccagttcggtccaattcatcgtaggccttgggttaaggcaggttcgtgagggttcacggccttgtttaataacactgtgtagctctaggatcgtctttataaaatagctttgggcaactaagtgacttttaaatgctgtttactgcaaaactgaacccctatattattatctccttgtactcccttgcattaatcatgcattctccggtgtggcttgctgagtactgtggttgtactcattcttgctcaatcttttcccccttcagtaagagaagctttggaggagaggtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggaaaagccaagtggataaaacctaaggacatattttataaataaaaattatttgcgaaagttcctcttttctccttcccccaatgctttttgcaaaaggtttactccgttcttccttcttcggattttcaactagtactagatggtcaggtcagtgaagaagaggacatcgtcagttgtttgccgaagttccagaagactgcaggatctg

SEQ ID NO: 31704 - DNA, 1501 bp, Oryza sativa
cattcaagacttaaatgaagagataaattaaatgttttattagaacccaaggagtcatctaaatacttattagttgcatgcttgtattcactccttaattttgtaacattcaaggtgatttaatttctccttagtcttggtgttaaaagtaatatgtgtaacttttgtggatggaaggagtattacaattcaacgagacaacttacatcatattgaatctgatatctatatggtatcatatttggtatcgaatgtattagatcggtatctacgatatcgtgctgacatcaactattccgttacaaaccgttctgaagtctttctcttattttatacttctattttatgaataggacagtcaaaagtttagactcgtagtattatatgcatatataatagtctattcaagtatttttgtacatttactatatattttaggagaatagagtattatgtccttactaatactactctcatgtaacataatagaggtgtgcagagtatattttgtttgtggtcttataaaaatttggcaaggataaaacttgaaaattatgctcccaagttcagattttctacaggaataacatcagttcgagcgattttgaagggagaaaaaaaaatacagtgtcagagatgacactgggccggccgacgacaaagatgcagatgtgctccacgtcggcccaatatggccgtacaaccgaataaacagaggcccatgtccgctcacgccatctccaggacatcccgatgggctgattgggccgtttgatctccaactgcaccggcctagccagcaacggcccattaaacgccaagcataatcagccgtacagcatatgctgcatctgtgtggcgtgtaacattggagaactaggaacataaagctcatgctactgccatagcaataagtagcatgatagagcagcatatacattttctggacaggaacgaaaagaacaacaaaaacagaatcctaagttagttaggactcccttcgtcccattttaagtttatccataattattttccgtgtataactttgaccgtccgtcttatttattttttttaaaaaaaatttagaaaaacataagtcacatataaagtactattcatattttattatctcataacaacaaaaatactaactataatttttttaaaataagatggatgattaaagttgggcacggaaagttgcacttaaaatgtgacgaagggagtagtacaaatttcccatatatatatatatctagctactgcctagctagtagcttattcgatatgcgattattggtctacttaattaattggtccagtacaatgctgatcgaattgaattgaacttttaaccacaaaccgttatggaatcatataatcattcaagctagctatagctagagtacatatgacattactgatcgcgtactgcattcgatactcgcgaagacgaagaagaagaaaagagaggaaatcatcatcttgccaattggtcgat

SEQ ID NO: 31705 - DNA, 1501 bp, Oryza sativa
cccaacaacagcccaacagcccaacaacgtctcctagcccagacccatctcgctgtctcttcttgtgcctttgctcgtcctttcctcctccccaaaatcgatcaccggcgcacgccgattctccaccgcttacaggttcttgagctccaccatagttgccaggtcgctgggggatgggaggctgaatctgcgcggggaaaactgaggaggcgtgatgatggatggggctgctggtgtgtcgtcttcgcctctcctctccagccccctcatcgagtctcatcctccccccacggagcattcggcaatggcgtcaggaaggatggtaggttgcgtctgtggcgatgaggaggaggaggaggaggaggggtcgactagtcgccggcggcaatggcggaaagtgcacgaggagagaagtgatttttttccctgactcgtctagttgcatcttttcagtttcattttaaccattcatctgagccgacgtgtatgaccatctccctctggctagtttgtcgttttctgaatccgatggccaatattcattgcatgatgtggcacattccaactttcacttagagagatactcccttcatctacttttgatctacttttgatattaatattttatcttttttacggatgttgtcgaaatgacaactgcatacgtcgaaagacgtggttactcaacagtggttggaaggaaacgaagtgtattgaatcttgaatttcttcctttttttctggattcccccattacatggccctaggggactatttatagccccattacaggttcttactactagggtttaggttgtacaggagaatttacatgattacacttacaaaagggacatttacaggggtacataatgttataagggctcatgggcccctgatgggccgtctggcgatcgccggccctatagcccctaggcttgatgggccggaaaggcttcttcggccctcgcgggggcgaacttgccatggcgaagtcgtcttccttcggcagatagtcttcgccttgcacccttcgcctgagacgcctctggcctggcaaggcactcgtacgactcttcgcctcacgccgttcttgctccatagctttcgccacgggtttcggcagatttggtcgaagggcctcatgccatccgccaacaagccccttacgggtaagggtgagattggagcttcggccgagaccgtgcaaagtatgtggtatggtatgcggcgccccctttcaaccgatgctcctcccgaaacctacattattcctgcgaatgaagtttgctacttgtgcgcctattattattttgccgcgcttcgcctcctgcgattggtggttatatattttcttttcccgggccgaacggaacagtattggactttcccttcgtggggtttttactgtgccgctcggttggtgggaatttaccgtttcgcctaccattgcgacacgtggcgctttattactggtgggtaggcgaacggtcgcccgggt

SEQ ID NO: 31706 - DNA, 1501 bp, Oryza sativa
aaaaagaacctagctccatagacaagaacaaagagggccagctaactagctagatagcaaatgttgttttttttttctttcatctcttctaggattctagcttactttcttggttttgtccactctcagtactaaacaacaatcatcagaatttacttagtgctaagctagctactccagctgttagtgctactcatcgttattctctaaaagaaaacttactaggacaataaatcgcctactgatcgacaggcgccagcactacccaatgcattccaacacattcagagtttttagttggtgaaagttgttggtgaaacagaaaccgagaatgaacgaatggctaaatagcttatttatgataattattataggaagttggaaaatggatttgtaatattgtttagtttgaaaaacgtccggtttaatccattatccgttcatcacgaaggcagtagtgcaacagttgtcagagcttcttgtggcagatagacctggcactgtcagagatgagatgagagagagtgagagaagaatctcgagatggtagtagggagggcggcgccgcagtaggaaatggagaaggggatggatatgaacaagcaaaggacacgttgtttggccaaaaggacaggcagtacgagaaactgagaagcattgcagatcacacacacatgtaccgtacacattcagaagattcagacagataatctagtttaatttattttcttggtgattttctccccttgctaattactcccaccatcccaaaatataacggattgatacatgttttagttaattgcaaaactacctcttattatgatccactgaacatgccagattagattttttttttcatctcaacgtgcagtgaaaagtaaaagtaaatcaaactgatcagagtgctatgcggtcatcatgtttatgagaggtgtatagtttttagcattcccgaaattcggagaaatccaatccagatcattcccgaaattcggagaaatccaatccagatctagctagtggcaccaaattaagttttcacaaataattaagcaagaattgatactctagtactagcagctagttagtggtaggtcacttttggtgatcaatagggaaagagagatgtgtatgtgtgcgtaggtcagaactccatgtaatgtggagaatgaaatagaatcgtgcttgatttttctttttgaaagttgtgttcgatttggatctctccatagctgctattaaaaccctaggccattgatgtggcagcatacttgtcctcagagatgtcattctacaagctacacttcattattcattagtgttcatcatcgattaagcatgtgaaattaggaactagaatgatgttgaacccaaaatttaaggctatgaccggttgaactatagctgaataagctgtcaaaaaatgaatgacaaacataaataatttatgatttttttatatttatattattagcaattttaaaaataaggctgaaaa

SEQ ID NO: 31707 - DNA, 1501 bp, Oryza sativa
cagcaatctcaatctcctggctttgtctgtggtgttaatatataggttaggctcttaactgtgctccttaattaaggtttgactaattggaaaagctaataatataatataataaaaattaggcgagactaactaatctccaagtcttcagacttcgaatgggtggcctgtctataattaatcttgtttcatgctttctgcacaacatgtacatcaaacttgcagttgaaggtttgaaaatttgaacttgttatacgcagaatcatagtctagtcaagctattctgacttgacctatcatcctatcatctcgaactatatgaagactcagcgggaaacagcttagttagtgtgtcgccgtcttttttcctgacttgtaaagaaaagaaaatatttaacctcaaatctgaaaattgttgaaacaagctggcactacatagaaatccgagacttaccgaagctttgcttgataatttaggctgtgttcggacatccattttcccaacctatctccctcgttttccgcgcgcacgcttttcaaactgctaaacggtgtgttttttgcaaaaagttcactggtggagaaaccatctttcgttggtcggccgatttccacaatagtcccggatgcaataaaaaccggggcaaaagatgatctttagtcccggttcaaaagggtaacgggcatatttgatctttagtcccggttcgaatgctgtcaggacctgtcaggcccccccgggatctttagtcccggttggtagcaccaaccgggactaaagatcttaacttaccaaccgggactaaagatcccggtgatctttagccccggttggtgctactaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 31708 - DNA, 1501 bp, Oryza sativa
gaatctccaggggttaagagccggtgaaaggggcacaacattttcagtctggtgtctcctgattagcagcaaactgctgcttgcgcaacctgtgctagctgctctgtctgcttgcaaacacagttgcagatcgagatgctacgatgtgcttcttctcttcgaagttagcaaaggttccttccaatgcgtacgcatgcatacgcattgagatcgaaggaatctgattccagtcgattgatctgggttatatatgcttggaaaatagcgttgctggcttgttcttatccccaagatcatctgatacgcaggaaacgatccacacttgttcataaacaaatcagttaatcgcttacttagagagcatattagctatccaaagccaaacctccttttctctctctatggcgaattggaattgcaggctgcctcagccttgatctagctgttatacacgacacagaaaaaggcctggaaacttaaccgggagactgcaacacacagcctcctcgtcgcctttagaaattggcagaggaatgcgcgcggcggcacggtagtagtttcccttcgtgcgacgcgttgtcgtacgtcgtaaacgctcaccaagctgcaaagtgcaaagcgtcttttgctacgaagcagagtaaccagctctgctctgtaggctgtagccgagtcacctgagtacgcaggagacggggccgtgtagtgggccgcagcgtcggcttttgtccaaggatggatggaccgtgtagtgggctgactaccaacaccagtgattaatgtgtgtgtttcaatgtttcatcacgatttgtgatgttctgcagtcagaacagtgcatttgaccatttgccacatttagatgttgtaattaattttttaccactgaactcacatgtcatagacacatgtggacccacatatcattgagatagggggtggcaaatagttatttgccaaatctaaaaatggcaaatagttaaaagccccaaggaagagatggctgcgtaccgatcacaaacacggcctggaatgaagcccatgaatgaattgacgcctgggcctgggtacaaatatgggtcatcatgggccgatccacatgtagcccataggactatagcccattatcaagtacagcaacacacgcaacgcaaacccttctcctctccttcgccgccggcgccgccatggcgcgcctgagcgctgctcgagctttgcctgcgccgcggcggcgctcaagaggaacaagtccggggaaggcggatattcgccggcgccggtgggtctagccatttcccaaccttgccctattggtgggtccgcttggggctaaatacacgaacagattgcgattttttctgcgaggggatcggtgatgctgcgcgtgcaccgcgctgatctgggtgtgctgcggcggcgcaaccccgttctgggttgcatcctcgtcggcggcggagggcggcggatcttgcgtcttcgtgcctactcgtcggcgtcggcgagg

SEQ ID NO: 31709 - DNA, 303 bp, Oryza sativa
caccttatatattagtgatcagatcatggatagtgctccgctgtgagattgtgaggggtataggcacatagacaaccaaagtttaaggctagttcgatttggaggaatttcacgggaattttggagaaatcgacctgttttctgtgaaaatcctataaaattcctacgttccgggattaatcaagatgatgcaaggatggaagaggattattcgaccagtatgtgcacgctagctgattgcattattgttactcgagagtttacgtactctttggcagtaaattaatcaatatgatgccagga

SEQ ID NO: 31710 - DNA, 1501 bp, Oryza sativa
gtatctctataagcaatcggttctggttaatcaggtgttggaccagtgtcacacaactggtgtctggtgcttcattcactagggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacacgctacacacacaagcaaggaaacacacgactaacgaaaccctagagggtggcttaggttctgcggctggttctccaagatcttaacttcggcttcacagctgacttcactgcttcctccacttcgctagcagaccctgcggtcttccggagcttcggcgaacaattggcgacatctttttcttcgcaaaaccaaccatgtagtactagttggaaatccgaagaaggaagaaaggagtaaacattttgcaaatagcattgaggaaaggagaaaaagggactttcgcaaatagtttcatttataaaataagtccttaggttttatctacttggcttatcctacagtcgagatggctctgataccatcttgtcgcgaccgggaaaattgcattttcccgaacgctagtgtattaatccccgtcccaggaaaagccggggtacaccatacaaacatgatataaaagacacatctttattaaatcgataatatttacattattacaaaggcacttaaggcctgacaatcaaaaataaacagcagcggactagcgggcctacggctccatcttcacaggcgctcaactggggtataagccaagactccacctaagacttcttctccaaagcttttcttactgaaggggggagaaagatagagcaagaatgagtacaaccacagtactcagcaagccacaccggcggatgcacgattaatgcaagggggtacaaggggtaatgatataggggttaagttttacagaaaacagcatttaaaagtcacttagttgcccaaagccattttaaaaagacgatcctaaagctacacagtattattaatcaaggccgtgaaccctcacgaacctgccttaacccaaggcctacgatgattcagaccgaactggcaacccgaccctgggtcccagctcgtcccaagccaacccaggccaaccattccacgttttagttattaagcaggttttaagaatttaaaacactaacttgggtacattgctaggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagc

SEQ ID NO: 31711 - DNA, 203 bp, Oryza sativa
ttcttccgtgttttgggttaatatgatgcatttttttgtgttgtggacatgcatgattgttctattgattcaccacacaatggtgtttgggccatctgttctgattgagacattgggtactttagggcatattactgggtaccttggtagtagcttaatgccccggtgaatattgattgctctcttaccttgtccattttaca

SEQ ID NO: 31712 - DNA, 1501 bp, Oryza sativa
ctgggcacatgtcggggcagctgcccacgatcggcggggcgtcgccgccggtaccagccgcggtggcgctggccgccgccgggaaggaagaggtggaggaggaaggaggaggtggcggtgaggggccggcgccgcggctgagaccaaggccgcggccttctccccgacctcgccagcctcggccccatccgtggccacgagtggaactccggccgcggtggctcgccatgtcccggcgatccatggcggcccttggcctcgagctccgaggggtagtctggtaatttggtggttagttgaaccgtggagtggaacaatggagcttcaaacgaacatgcttttttagtggagagagagagggggggaggccaagatttttttttaaccttttaaaattttaattttaaagtaatgtcctgttttccaatttttttttcaaatttctaacttttccgtcacatcgaactttcctacacccacaaacttccaattattccgtcatatcgttctaatttttttaaacttccaattttagagtggaactaaacacagcctaaatcataacaaaacttatttttaaactgaatctttcgaccacgtcagcaagagtggtgtcatgaaataccgttgccatgtcatctagaacaatactactccctccgtcctctaatataagggattttgactttttgcttatactgtttgaccactcgtcgtattaaaaattttttggaattattatttattttttacttactttttgcttgcaccgtttgaacattcgtcgtattaaattttttttggaattattaattatttttttgacttactttattatctgaagtactttacgcacaacttttcgcttttttatattttcacaaaatttttgaataagacgagtgatcaaacagtgcaagcaaaatatcaaaatcccttatattatgggacggagagagtatcacactaccctggctagtgtgacggtgttattttgccacacgcactctggctgacgtgggcacgtggcaacgttctcttgccaagccattcatattgacatgacaaagcaaaattttcacatcaataaatcgattattgatggtgtgacaatattatttcgtcacgcacagacgaagtggcgtggcaacaaatattcaggtttagaaataagtaaagagatgatttatgtttagaattaaaagattaagaatcataaaaattcaaaaacctaaaggcaagacggtgtaccggtgtttgaggttcaaactgagatgtgggaactttttttttcaattacacaaaaaaatgtatattcacgttatatagtctacgcacttgtgaatgcatcatctataaaacacttgccgagacgggggcataaataaatacaagaaatataattggaagaatgagcagttctttttgaaagctctgcatttctgtcagggttacgggtaaagtataccctctactttttgatatacgtcacatatcgata

SEQ ID NO: 31713 - DNA, 1501 bp, Oryza sativa
ttaggagtaccccatttgatgccttcttgtatagatcattgccgatcatatagtagacctttgctttacaggatattttctcagcttctgcgtcgtcctcgggcaactctttgctgcctatgaatttgatgagtggggtgcgccagtcgtctgtggtctcgatatcggcaacgacgcgctctacctctgtagcccccgagctgttgttgagggagaccgggctatcttcaccgcttgcgtctttcactgatggccttgtcaggacgtctagaaaggtgccaggttcgagtggctctcgtctggacgcacgccgtgctatatcatctggttcaatgttgtccttgcggtatacatgtcggacctcgatcccatcgaaccttttttctagctttctgacttctgcgagatacttggataatgtcacgcccagaaattcccgaatagaattccaagcagaatgtgcattaaactccccgtccaggaccagccggggtacacaaacgacaatgttgacattcagatccacgtcttacaaacatcataaaagtcttacagaaatgcagcggaaaacaaaagaaactggagctaagccttgactaaactgcagcgggaacaccactccacaggcatcctcgacggcacggacgaagcctactcctcggggaaaccttcatctgacacatacccgtcctctggggttgggaaaagtagagcaagactgagtactacccactgtactcagcaagtcataccggaataggggtatgatgcagggaattaacaaagaagagctaaagtggttcatttgcataaatactggcatttataaacaggaatttaatgcgaaaacagttgtaataattaagcagtattaaacatccgctgtccaacgctaacccacgttgcgacaggcccaaccttccacctaaactatccaagttcaacaaattacactagggtgagactaatcacggtgaatctggttgaccgcccataaccgcgggcacggctattcgaatagttttactctgatcagaggtgtacaactgtacccacaggacacagccccacgacacgtttccgtgcgccgacatgccaccacgacataccggaaagaggccgtgacaggacccttcacataaccccctctaaccaagcacaccacacctcaggtttcacccccactgctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttaattaaccaacaccaaagcggtgccgctaatccaacattatcataa

SEQ ID NO: 31714 - DNA, 1501 bp, Oryza sativa
aagtaacccgcacatgaaaattgattttcgtgtgcgggcaacgacccggcttcgctccccccatttttccgtgcagtccaacttatggactacatggaaacaaaatggggtggcgtccaggaaaatcaatcctgtagtagtgcaccgccacctcctcccccatgtgagcactgtgatctaccccccacctccttagcatcgcccaccctgatctagttatttcgacctccggggtgccaggtccggcctccccaaggcagcgagaagggacgacgacatgcctcctcattccccaaccacgtccgcccttttcacagcgatgaggagggatgctattgtggggtcacggtacccgggtacccacggttgggccattgggccgcataacatagagagggccgcgtaggtctgagtttatgcagtgcatgtgtggctagataaggcaaccgatcttatctcatgtaaatagatggtaggttcctatattataagtgatttgttacctaccataattggccgcctccaagtatatataaggaggaccgaaaaccctaattcaaggaagaggacgatacgttctacgtgctattcacacgttatgctgcggatacttagatacaaatctaatctcatacaactggacttaggggcgttggcgcgcgaccagccccactccccctagtctctatactactactatatactctactactatgatatatactactattcctatatacatatgtatatacatacatgtaactttgtatacgtacatacaaagtttatatatatgtatataaatataattttctatatgtatatattttataaaaaatatatacatgtatacaaactttgtatacatacgtatacaagctttgtatacgtgcatattaaaaacaaaaaaaccgagaaagaaaaaaacatgtatacaaagtttgtatacgacatatacaaactttgtatacgtcgtacaaacatataaaaacaccgaaaaaatgaacaggaaaaccaaaaaaaaccaacaggaaaaccgaaaaaaaaccaacagagaaccgaaaaaacgaaccggtgccatgtggcccttccccatcgcgccgttcagccctccccctcccccatcgcgccacgtgcccagtcgcgcgcggggggcgccaattagcaatttcgactggactagggcattacccctgagagcctgaatcagtataaactctgtgtaaccatatctccttaatttcgtgcaccctataaattatattgcggatccagagaatcgactgttgatacgccaggtagaggggcgctagatcaatcatcaggaggagatggcttcaatcaccgattgataccgtcgacgagatcgcgttgatggcataagcagcgcaggacgatgcagtgcacgcctgcgacgtgctatcctggccggggtggcgatcgcgcaagtcgtggacgcgtcacgagctggcgcgaccccaggctgttcatgtcggggcat

SEQ ID NO: 31715 - DNA, 1501 bp, Oryza sativa
ttgtcacaatgagtccaaattaaagcaaagacaagtgtcaatttcatcggggtctttaaatatctttgtttttatagttatttttaatatctaaaattgtaaaatatgttttttataacaattatatatcagttttaaatttaagtcattctcttgtaaaaatggaaataaggccggcaaccaaaatgtaattttaaattcaaaattaagatatatagcttttaggataaaggtatgccaaaagccggctctaaatatcaacgttctcaattttttttagataatcaacgttctcaattcttgcaacatttttgttataattgaaattgtcgacgggggttaccagtagaccggatatagagggtattggggtacgctggtacgaggatctacgtaatacgacatcgagtaggcagaaaacaaagattatactggttcaggccccttgataggtaatagccataatccagttgatatgggattatatgatggaaaccacagattacaaagggaatagtggaactcgacgataccgacgagatcgtagtcgagttgattcgactagatcacccggcgacttggctcctgtaggctccggcttcgtaggctgtggtggatgtgttggcggtaagattcgatgcccaaggtcctccccggggggtcccttttgtaccacaggtcaactggtctccaagtaagactcggagacatcggacccgatacgatacaatgacgacccagttctatccgagtaggactccttccatctgtgaactccataatgaatttccttaacgtatgccgaaaacgtccgtatacgcgcaagtataccatatcaatatgtgacgtatatcgaagggtaaagggtataccttacccgtaaccctgacagtagcccccgacttctgcttatatgaactcgtgaaaccgatcgcgacttctgatgtcgaagttgtcgtcgttctcggtgtgaggactgagagacaaggagtgatcgacaacgccaggtgaagctcaacggtcatgagtgaatttaaattgaagtccgaaaaactgccgcgcgtaacggacccagaaatttccgacggccatctctctcctttccttggaattcgcaccgtcggaagtgcgtctatttaagggagttttggggatccaatttgaagtccgcctgttgtgaaaaaactctccagcccccaagcgtccctcgtcttctccgctcccgcaaaaaaccctagctagctcatctcggtcctttctccggcgatccccggcggcaatggatctcgacaagtctacctccaccagcacgtcgctaaagaagttgcaggaggatggcgcccttcccggtcgcgggaccgcggagagagaagtaggaggtactgaaccccaacctgtcctaggtcgcatggttgtgatcgaggactttattctctgtggttttcttcctccgccttctgaatttcttctcttggtcttgaatttctacagtctttccttg

SEQ ID NO: 31716 - DNA, 1501 bp, Oryza sativa
cttcagcgacgccgccacctgatggtccacgagcggcccgatgatatcagtcagagggagagcctacgcttcatgaagtcataatgcgatcccggaagaaaaatgcaaaaggaccgctgagtacacttacattgatggcaacgtcgcgctcggctgcccctttctcgcaaagggggacttggacgttgctcgccgttgtcgggccagtgatcatcagttggccgacacggcgctccacggttgcgctgtccaagcctgtagatcgagaccagaatccgataagtcgggaagaacacgcacataagggagccaatttaactaaaaagaaaaataccccgaggagaaacccgggtcgcgtcctccggcccagaataatcaaaggctggatgggctcgagcctggagcggctagatccgcctaccaatgaagtcggcagcgacttcataccccgacaatccccgtactcggaggtcatcaatgatatcgatgaaagattggagggatggggtcaaggcgagtttggcggtccaagatgaaatcttgtctagttgctcctcaggaacaataaaaaccggatccgaatcttctatctgaagatagaaccacctcccccgccatttgctgcgagatgaggggcactggaagaggatgtatcgcgacttcaggccatcccgaagtcggaaaccgacacatccagacacctttttgggttccatccaactcaactcatagtaaaagcggaagaggtcaagaaacggctctaccccaatgtaggcctcacaaagatgcgaaaagatactcatgaaggcgatggaattggggttcaaatggagcaaggaaagactgtagaaattcaagaccaagagaagaaattcagaaggcggaggaagaaaaccacagagaataaagtcctcgatcacaaccatgcgacctaggacaggttggggttcagtacctcctacttctctctccgcggtcccgcgaccgggaagggcgccatcctcctgcaacttctttagcgacgtgctggtggaggtagacttgtcgagatccattgccgccggggatcgccggagaaaggaccgagatgagctagctagggttttttgcgggagcggagaagacgagggacgcttgggggctggagagttttttcacaacaggcggacttcaaattggatccccaaaactcccttaaatagacgcacttccgacggtgcgaattccaaggaaaggagagagatggccgtcggaaatttctgggtccgttacgcgcggcagtttttcggacttcaatttaaattcactcatgaccgttgagcttcacctggcgttgtcgatcactccttgtctctcagtcctcacaccgagaacgacgacaacttcgacatcagaagtcgcgatcggtttcacgagttcatataagcagaagtcgggggctactgtcagggttacgggtaaggtataccctttacccttcgatatacgtcacatattgata

SEQ ID NO: 31717 - DNA, 1501 bp, Oryza sativa
ccaaaaatttattatttgttggtagtttggtataagcagctgtcagttaggataacagattactgtggagcatttatatattgcacatgcctaaattcctactggcttatgtgtgcacggtggtgctaggtgattcttttttacatagttttgttcttggagacataactgtccatagaggaatatcattgacaacttgcataagtgcaggtgaaaattagagcctacaaaaagattgttatggcagaatttatcgtcattgtatatatggggatatatcataaattaaagatagagagacaaataaagcaggagtaggttataacaaatgaagtttcatattcatagaaagccgatttgaggaaagtaaataaggtttggatgatagagttggttactccatacactttcgagaaagagaaaattccctgtgtacgcctaaaactttgtctaatccctatgctcttcagtatgctcattccctttatacttccaaattttagtttgcatctcttctgcaccgtttgcgttagttcgttgttaaactcttatgaaaaagtctatttttgccctatggtatgcaaacatataaatttatagtgtacaaaaatttgttgtatgagaaagagaaacttgagacattttataagagaaaatctcttatatatccagaaattttagctaatcccttctatgcttctaaattttgcttagttccttgtatacccctaaaatttgattttgatccttttcatactccttccttcagttgaccatagttgaccgtctaatttctatgaaaatgaccattttaccctttggatgaaaatagaatttatgaattacattattaaaaatgtaaaagtttgtcgcatgagtctattattattatgagtttgttgtgtgatgcattatttatcacaaaatttatttttagataatgaaataaaaaatatgtatttattatttaaaagaagtcataaaagatgaggagcatttatataaagataggactaccaatgctcacaataattttttttatgaatgctcccgataaaaaaatccattgtcttattaaaatttcaaataaatattttaatttagtacatttgttttatttagtctcattagtttcataaaaatgtacatactatgcactcaaacaaaattttcaatctttttcaagcttatattattggaaaaattggaaccatgccattataattttacaaaatttgagatatggcatcctgacccacatgccattgactcatgtgggtcctacatgtcattgagataccgatggcatatctcaaactttgcaaaagtacaatggcatggttccaatttacctattattaaaacttaaaacatcaagggcaaaaaagacatttgcaaccaaatgtagtagctagtgaaatgaagtaaaatataatggtaggggtatggaaaggatcaagttgaaatttcaggggtatagaagggatcggattaattttag

SEQ ID NO: 31718 - DNA, 1501 bp, Oryza sativa
ttgtttgggccggttctctgattacactgtggctgtgagaagttgttctcatgtttcacattagttagttacacttgttttttatattgagatatgtaacacaatcttcacgcagtatgtatggtgctactatgctaattgttataccatggtaggccctccgtagcaaaaacagctgtctggtggttgagatgtgttcaagaacaatgagagttattaagtgtctgcttgcttggtactatgtataagtaaaaaaacaaaccccagtgtgcgtcggccatcgcgtgtgtgcagcggctagctagtgcttttggagtcagtcaaatcttttttcttgtaacagtagctaggaataaagattgaagggggataccagtgagcaattgggtgtgctgcgcagatgatgatgctggcagcttgttggaatgaggggcattagaaattctaatggcaggatttgaatcgtttttggcgctatgaatgcaagcggtttaaagacgcgaaagctttgagccgctggacctaagacccaagttgttcgactatacgaagaggattaattagttgcaggctgatagtaagatttttttttttggcttgtccatgaagaaatgcatgttccgatttgaataataaacatagtgacagccaagttccgttgctgatttgattcatcatgttggtaattagcatgtgctttcaaatataaaatctccctctttcaacttgcgcaagttggcaggggggcactgttacactattcatgtttattttttctcattgcttatcgattcaaagaggactaaaattttagaatagtgctatcaaaattaacgttgccaccgaaaaagaaacctacatactccatctgtttcatattataagactttctagcattgcccacattcatatgtatgttaattaatctagacatatatatgtggctagatttattaacatcaatatgaatatggacaatgctagaaagtcttataatatgaaacggaggaattaccattcttaaccatcacacaggattgttcccgaaacagtcaataattaaacattgattaattatatcttcgccatacatatatacaatacccatcagaaaaaaaccgaggccctaaccatgaacaaccgctgccacctacttgaagtcggtgttgaagttacagtagattcctgatcagacacatgtcataatatttttcctagttctcctagattcccatgtttttatgaacttgcaaccagtttgccaagtcgccacgtgagctcatgatccacccggggttcaggggcaagcacagcgggctggcggggcaagccggctgcacccagactcccacatcttgctctgagatgtagcaaactcgctcggatgactcatctctaatggctcaataagtttcccttttaaaatataactaccgggaatgacccattaccgatataagttcatctttatcgggtcgtagttctaacacgtcacagataa

SEQ ID NO: 31719 - DNA, 1501 bp, Oryza sativa
caaagctcgagcagcgctcaggcgcgccatggcggcgccggcggcgaaggagaggagaagggtttgcgttgcgtgtgttgctgtacttgataatgggctatagtcctatgggctacatgtggatcggcccatgatgacccatatttgtacccaggcccaggcgtcaattcattcatgggcttcattccaggccgtgtttgtgatcggtacgcagccatctcttccttggggcttttaactatttgccatttttagatttggcaaataactatttgccaccccctatctcaatgatatgtgggtccacatgtgtctatgacatgtgagttcagtggtaaaaaattaattacaacatctaaatgtggcaaatggtcaaatgcactgttctgactgcagaacatcacaaatcgtgatgaaacattgaaacacacacattaatcactggtgttggtagtcagcccactacacggtccatccatccttggacaaaagccgacgctgcggcccactacacggccccgtctcctgcgtactcaggtgactcggctacagcctacagagcagagctggttactctgcttcgtagcaaaagacgctttgcactttgcagcttggtgagcgtttacgacgtacgacaacgcgtcgcacgaagggaaactactaccgtgccgccgcgcgcattcctctgccaatttctaaaggcgacgaggaggctgtgtgttgcagtctcccggttaagtttccaggcctttttctgtgtcgtgtataacagctagatcaaggctgaggcagcctgcaattccaattcgccatagagagagaaaaggaggtttggctttggatagctaatatgctctctaagtaagcgattaactgatttgtttatgaacaagtgtggatcgtttcctgcgtatcagatgatcttggggataagaacaagccagcaacgctattttccaagcatatataacccagatcaatcgactggaatcagattccttcgatctcaatgcgtatgcatgcgtacgcattggaaggaacctttgctaacttcgaagagaagaagcacatcgtagcatctcgatctgcaactgtgtttgcaagcagacagagcagctagcacaggttgcgcaagcagcagtttgctgctaatcaggagacaccagactgaaaatgttgtgcccctttcaccggctcttaacccctggagattctgcatctccaatcccatattcatattcttcaacaacttgacactccataacactagttagtccagtatcgccactgattgatctagagcatggagagaccaacctagctgtgagatgagacatgcatgcattgcatgctccgttgctgacctaggcagctcgtgatccggtaccacacttaattaacaagctaattgattatttgattacagtactagcacttaattaaatcagccatggcgatgtaaccacgttgcagagaagaatcctagaagctagcagcagct

SEQ ID NO: 31720 - DNA, 1501 bp, Oryza sativa
ttattgattccaagaggactaaaaggctgaatcacatgagtaacaacaacatttctgcttttatatttgctcgtacagacatacttgaagcatatacaatcagtggtcagaaatattcatgatacggattttcatggtattctaaaatattctgactgcaaccaccagacaaaatcccagttcatcgtcagaaactattcacaatatttgccagtctgaccgatccaaaaagcacatcgccaataatcttcaaataacaaaagcagttatctcaaataccaattatttatcataaataataatcaaaacacactttgatttcacaacgaggttctcttatttcaaatgacagaaatatgtcttcacgtttatcaatgtactagcaaacctaggccttggataggagtccattcaccctctatttttatggggttgttgggttggcaccatcaactctggaacgatggaaacagtggtcttgaaatgggttcttagtctcttagaagaaaacattatgctcttagccccttttaacttgaaatctattcatacatacaccgtctgaaaatgatgcatagtcaaaacatcataactagttaaaaaaaataagtccaatcgttctgtgattgcagttttaggtctggttgggtggtttcatagacttcttctgggattgtacttagatgttccctaattttcacatttttattcaaaggatgaagaatttcatcaatcactagctaaatacattctcatagaaacgaaatataaaaattttgcacaatctaattatgcttatttcttttcgtcaaaaaatattccaaaaatcaattatgtagaaatttatttatttttacatgagaccatcactgaagaattaagaaattcatataaagtcgccctcattgacacatccaccatggacaagtggccggtgttgaaaccagctaagtactcagctacatgttcatgcctcagcttgttgtaaaaccaaaggtgttttggattattattctgtgatgaacaattggcatataagattattggttttgatatttggaatttatttacgaagtggttttagagatgattggaatttgcaggtgaataggaactactgctgttgatttggtccagtcagaccgggcatgtgctgccggtcagaccggcgtgtatcgcgcagtcaaaccggcccagcccgaggtctgaccggccgattctgtgtcagtttcggtttcgggttgtttgtttggatatctatgattgttttatatttatagcttctagatggatactatgtgtatgtaatactgttgtttgctactaatgagtcaagttggagatagcttggtctcggaatatagtttatttgtttgattcatgtgtaggtgacttcatgcctcgggagagtactgccggtgatggatcgggagtcagcttggagataagacgatgtccgtgacggtcagatatcatgcgggatactaagggtagagttcag

SEQ ID NO: 31721 - DNA, 1501 bp, Oryza sativa
cagcacggcagcagccagtaggcaggttgcagttgggtttttttttctgaatttctgaactggccgtggatggaggttggggattcagaggggagaaaaaaccgagaaattgccaggcgtgaggtaggtgcacaggcagcacagctcagtgccactgccaatcatccgatgaattgataaaatatttatcatttgaaggcgtggcagatcagggcagtaatgaacgaaacattactacagctcatgacctggctacagttcacgatggacacctcatcagctaagaagcatctaccaagaatcttacttccatccacatcaatcagttcgatcaattctcaccggcaaaattcctggagatataactgatgaaccagttcaagtgcaacgcacacagatacatcatattaattcaccgcaccgtgcactaaacttcacgacggatctccgcccggttcgttgcaccttgcagacgtctgattttagtgattcgatctccaaagtctccgtcggcgctggaccaaaaatatcaccggagcagccacgatattgcaccaaatcaacacgctactagtgcccaaaaaaaaaacggagtacgagttggcagtagctgtgtcaaccgggggaaattccgtgaggtcacgaacgccgccgatgttggacaggcgagcgagacggcgacggcacggtgaattcaagaggacagtacgggtacagtggcatatggtgtactagtctgtcttgaaaaagggtaaaccctcgtaactaggattgattttttttatttttttctaagacgaaggggtacgtggtgatacttgagagaggcgaaggcagcaaacctggagatcgaaaaccgtcgctttcgagcccttttctcgtgcggatctccttgccgcttttgaagcttccggccacattttcggaagctcccggcccagcttactgctgaaaaaaaaaatcatcgcgtccccgtctcatcagttcgttggtcacggatgaggcaaacgcggatgaggggaaaaaaatcgggatgattttgatgggactcaaatcaacctgagaccgggtaaaacacacacgctatacgagtgtggctgtgtgggtgacgagactcgccagtaaaatttgacaatttgacatcgccttcgccgtgttgaattgggcaatctccagacggacggagggaggcaggccggcacgcacgtcggggtggctccgtgtgttttgacctcgccaccactcggagcaggcaaggaggctgctaattcttgactaatcatagtcatcaatcaagaagacaaaaatgaatagaacaagtattagctgatacagtaagtctttggagggcgatgacgtctgcgcccgtttgcaaaattgttcaagcgaacttcaattccttaatcgatcgactgattatgtatgaaaattgcaagaatttgggaggctgttcgtttccttttcagagaggaagaggcaatgtatggatgcacggacagtt

SEQ ID NO: 31722 - DNA, 1501 bp, Oryza sativa
gcgctagggcacgggcgctggcggcgggcgcggcgagaggagggagatgacaggtgggtcccacctgtcagcgagagtggcgggcgggcccgcctgtcagcggcgcgcgcgcgcgcggggagccgatgggccgcggaggagaggagagagagggagggagagttgggccgagccggcccaagagaggaaggggggggaaagaagacttcttttagggtttttctttttataaaccttttcgactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaacgcccagacccacaaggtacgacgcaaagaaagcatggtgccccatacacaagacggacagacattctttggaagattgccttgtttttaaaaagtcgttcgagaagcacatggcattggaaaaaggcaagcgagtacgcgtggtcgagaaagatgcggaggcgactgctccagaatcggattcagcatatccagactctgaccttcgtgtctcacacattttcggaagttctacaacgtaatcctcaaagcgagaatacaagaaagtggaacgagaagtctgttcgacatggcagggggctgcacccaagatgaagtggtctgaacagaagatagaattttcggaagaagaccatcccatgactgccgttatcccaggacgttatccgatcgtggtcgaacccactattcggaacatcaaggtcgcgcaggttctcatcgacggtggcagctcaatcaaccttctcttcgccagcaccttggacgtgatgggaatcccacgaagcgagttgacacccaccgatcaacccttccatggaatcactccccagtcctcgtccaaaccattgggcaaaattacgttgcatgtgactttcggccaagcaaacaacttccgaacggagcagatcacctttgatgtcgctgaattcgatacagcgtataacgccatcatcggttgaactgcacttgcgaagttcatggccgcatctcactatgcgtatcaagtgctcaagataccgggaccgaaaggaacaatcactattcaaaggaacgccaagctagcggtacaatgcgacaagcggagcctcgacatggtcgaacaaacgcccagcccaccagccacaactgagcctcccaagaaagtgagcaagacaaataagacgccgaaaccagacagcgcgatcatgatcgtttcgctctctagtgccaaccccaacaagaccgtcaagatcggggcatcactaagcgagaaataggaactcgcgctcatcatcttcctccgcgacgtgttcgcttggttgccgtccgaca

SEQ ID NO: 31723 - DNA, 1501 bp, Oryza sativa
ggtaaaagacaatgtttaaaaaaactacattgaaaatattttaaaattaagtttgaaaattcaaattttagctttgactttggtttattaaatcaaccgatggagcccttgagcaaatccaggttgtcaggttgacattctgattaaaatcatgtattgtttctctattttcgttcatgccattgattaaaatcatgtagtgttcagttactagttttttgttcatgctattcatctgattatctgaagataccttgcctagacactactgaactgaactgaacgcggcacgccaagtttcagactttcagtaccagtacatgagtacagaactagaaatcctttacttacaacgagaaaaactaacactacaagaaaccatctgattaaaaattttgatgcagttcagctgcaaatactgcaaagaatctctacaaacaaacagtcatctgaagatgagagataggaatctctctcaatctctctcttctctgcaatgcctgtctattgcaaagtcactgtgattctcaaacgaggaagacgacgacgagggaaaaccaaaaaccagcggataagaaggaaaaccgcctttgcgaaaaccacagcctctctccctcaggctcagcctcagcctctcgatttttctttgatttttttattaaagcaagaatggtccttggctcttgctggtactaccagcgtgtggccaaatcatgcagctttgatgatggaaaaaaggaaagaaaattcaggagagagagaaagagacgtggggtgtggttggaccgcaaggcacggcgccgtagccgttggcagatgcgcgtctccctccgtctccgttatcacgtcggcacgccgacgtcgctgcgcctgcgcgtgggaggccagggcagatgctacgtgccatcaggaatgtcgacctgatgattattttgttgatcatgattttcttttggctatttgattttttgaaagatatttttttccctgggaagacacctatgggacgaagatattatgtttcttatatagcaccaaacaaatttaatatatatatatatatatatatatatatatatatatatatatatatatcacatcagtctctgcacaaagtgcatcctgggctgcttcaattataaagccccattcaccacatttgctagatagtcgaaaagcaccatcaatattgagcttcaggtatttttggttgtgttgtggttggattgattctaatatataccaaatcaatataattcactaccaaaatataccatagccatcacaactttattaattttggtagcttaagatggtatatataataaccaattaacaactgattctaattttactacggcccagtatgtaccaatacaaaacaacgagtatgttttcttccatcgtaatcgtacacagtacaaaaaaacctggccagcctttcttgggctggggctctctttcgaaaggtcacaaaacgtacacggcagtaacgccgctt

SEQ ID NO: 31724 - DNA, 1501 bp, Oryza sativa
ctttcagcgatgccaccgcctggtggtccacgagcggtccgatgacatcggtcagagggagaacctgcaccgcatgaagtcgttatctgatccaggagcaagaatagaggggtcgccgaatacactcacgttgattgcggcttcacgatcggccacctccttctcacaaagggggatggggatgtcacttgccgttgtggggccactgatcatcagttggccgacgcggcgctccaccgtttcgctgttcaagcctgcaagtcaaggaccggaattcggtaagccaggaggagcacacatataaggaggtcaaatcaaatgcaagaaaaataccccgaggagaaacccgggtcgtgtcctccggcccagaatagtcaaaggctggatgggctcgagcctggagcggctggattcgcctaccaacgaagtcggcagcgatttcatacccgacaaacttcgtgctcggaggtcgtcgatggcctcgacgaaggaccgaagggcaggggtcaaggtaggctttgtggtccaagatgaaatcttgtctggttgttcctcgggaacaacaaagacaggatccgaattctctatctaaagatagaaccacctcgcccgccatttgctacgagaagaagggcactggaagtggatatagcgcgacttcaggccatcccgaagtcagaatccgatgcatccagacacccggttggattccgtccaacgcaactcatagtaaaagcggaagagatcaagaaagggctctaccccaatgtaggcctcacaaagatgtgcaaaaatactgaggaaggcaatggaattagggttcaaatggagcaaagaaaggccatagaagttcaaaaccaagagaagaaattcagaaggcggagggagaaaactacaaagaatatagtcctcgatcgcaaccatgcgacccaggacaggctggggttcagtacctccaacttctctctccatgcctccacgaccgggaagggcgccatcttcctggagcttcttcagcgacgcgttggtggaggtggacttgccgagatccattgtcgactggagatcgccggagaaaggacggagagtaacgagctagggttttttgcgggagcggagaagacgagaggcatttggaggctggaaagtttctccacaataggcggacttcaaaatgaatccccaaaactcccttaaatagacgcacttccgatggtgcgaattccaaggaaatgagagagatggccgccggaaatttctgggtccgttacgcgcggcagtttttcagacttcagtttaaactcactcatgaccattgggcttcacacgatgttctcgactatgtcctgtctctacggttcccacaccaagaacggcatcagcctcgacatcagaagtcgcgattggttacacgagctcatttaagcagaagtcgggggctactgtcagggttacgggttaggtataccctttacccttcgatatacgttacatatcgata

SEQ ID NO: 31725 - DNA, 1219 bp, Oryza sativa
atcccttatattatgggacggagggagtataatacaaattgatttacaggtaaaacttttgtatatgtgtttttaatgagctattactccgtcccaagaaaaagacaaaccctagctatgaacctatgtccaggtttgtagctgggattaggtttttttgggacggaggaggtaaaagacaatgtttaaaaaaactacattgaaaatattttaaaattaagtttgaaaattcaaattttagctttgactttggtttattaaatcaaccgatggagcccttgagcaaatccaggttgtcaggttgacattctgattaaaatcatgtattgtttctctattttcgttcatgccattgattaaaatcatgtagtgttcagttactagttttttgttcatgctattcatctgattatctgaagataccttgcctagacactactgaactgaactgaacgcggcacgccaagtttcagactttcagtaccagtacatgagtacagaactagaaatcctttacttacaacgagaaaaactaacactacaagaaaccatctgattaaaaattttgatgcagttcagctgcaaatactgcaaagaatctctacaaacaaacagtcatctgaagatgagagataggaatctctctcaatctctctcttctctgcaatgcctgtctattgcaaagtcactgtgattctcaaacgaggaagacgacgacgagggaaaaccaaaaaccagcggataagaaggaaaaccgcctttgcgaaaaccacagcctctctccctcaggctcagcctcagcctctcgatttttctttgatttttttattaaagcaagaatggtccttggctcttgctggtactaccagcgtgtggccaaatcatgcagctttgatgatggaaaaaaggaaagaaaattcaggagagagagaaagagacgtggggtgtggttggaccgcaaggcacggcgccgtagccgttggcagatgcgcgtctccctccgtctccgttatcacgtcggcacgccgacgtcgctgcgcctgcgcgtgggaggccagggcagatgctacgtgccatcaggaatgtcgacctgatgattattttgttgatcatgattttcttttggctatttgattttttgaaagatatttttttccctgggaagacacctatgggacgaagatattatgtttcttatatagcaccaaacaaatttaat

SEQ ID NO: 31726 - DNA, 1501 bp, Oryza sativa
ggggattgggagtttacacaagggaattgctgatgagattaagatgagaatttgatttttaatcccaatatcttgtttggtagatgtgatggaaattgatagagagtttagttggagattaggtcattaataaaaacagatggctgagatttgcttagacaaagtaaagaaggaattccctcccaattacctgcctctacccaggtattaaaaaggagagagttcctccctcaattccccattcctatcgcaccaaaattgtcatgtctcccaaccaaacaaaacacttaatagcctcatctctttaaactcccaatccctcctaaaaactccctccaaccaaacgggccgtaagatccaatccatgtattacaatatataccggtccctgatgcttaatacaatgtatcaatatttacagtatttctctctccctatactattcaacatagtatcagagcaggcgacctagagccgccgctgccccgggagagttccgatctcccgtgggtggacacctgttttttttcctatcttagtcgtcgtcttcgtgttctacttcttcatcgcgtggtggtcttcgcgtcgtcgcaaaaacagcaacagcaccagctacctccacgagtccacctcggtcaccgggggtcatctccttgctggctccatctcccacggtcgtcgtcgatctgatctgctcctccccgccggccgctaacttggtgttctgccgtcggcgcccacactggagctccttcccgccggcactgcagggcagccaccgccacgccgggtttccgcgaccgccactccaggggacccgttgatccacccaccaccgccgggagagcccctccacatccggtgcgccgctccggctgtcctcgccagtcgtcacggatctggcgcccaccaggctcgccactgcggccgctgcctctcggggtgttcgtcgtcatcccaggccgccggctggactcctactccctctgttttccacacgattggaaccgcctccgcaagcccgccgtacgcaccgaggtcgtcatcgaagcacgctccggttccagcacgccagggcacgcccggagcgaaagccgaggtcgtcgaccactgctccgctagccttgccatcgatctcctgctgcccatctctctctctctcttatctgtctacacgtgcgtggatggataggattttgagaacaggcaaaactggtatcttcccgattttgctgcttaccaaaattatgatctgttagcagtttcacatgtcctaaaacgcgatgtatctgttttccaattgttgtacgactaaaagctctttcaaaattcgcaaaatctaattagctaattagcttgtactagttgtgaagtcatgtaagggtggtttgtacgttggctgtgtttttgattctgcaacctagaccagaagctgcggctcggtacgtgactgtttcaacgagctgaggcctaagtcctgcaaagaggggagagcgggaga

SEQ ID NO: 31727 - DNA, 1501 bp, Oryza sativa
ttcgataaaccagccatctttccgggaagaactgatattctagtggacacgaatacacgacggcagatcacgtggcacgaattcgggatctgatgcagtcaaaacataatgacccacatatggccgtgtttctttgtatgactggaccctgctgcaccagttggtggatgattttgattgattaacttggcctcacacgtaatcaatcggatctactaataatactacatccgtttctaataataacatcattgattttttatcacacatttaactattcatcttattattaaaaaatatataattataatttattttattgtgaggtgttctatcattcaaaatattttaagtatgatttacatcttatatatttatataaaaatgatgaataaaataaataataaaaatatgtttaaaagttaacggtattatctaagaaacagagggagtaatgcttatctcacacgctgatacgctgttctcccgggaaaatcaactgctgatacagaacaaagcatgaactgtgcgtatgaattactagagtggaaaaaagaaagaatgtatgcacaagtgggcattttgttagctaaaggcagtcaccatctcaagggtatagaacagttgcaaggaacaaaacgtagcagactaagccatgacacgttcagatggcgccatcagggtacagtttacaggactcataccgtttcaaccaaaagaaaaataaagtcaattggcaaacattgaaatggaatgatggaatattttttttatggagcgaatgatggaatatgagataatgatatctattatatacttaaaaatctattaaaacattgtacaaacttttttaagctgcaacttgatactcttataaacgtttctaaaccgccatgcatcactctaataaactaaaaagaaaaaaaagaaaaaaaacatttgaccattgatttttctttaaattgatgggaccaaaatttataatcacaagatcaaatcttaatctaatgaaaaaaaaagagagcgattctgacactaatgaaaaaaaatcacgtcgactgacttggctcactgaaagaaaaagaaaagcaaggcgtcttccatcttataaaaacttctagcccgatcgtaatgcaatgctggagtccatatcaaaatcaacttttatatatgtttattatacacaaagttaattaagatctaaaatatcaaggaacaagcgcaatgacctacacaaacagaacaagaaaatttggtcttatcacgcacgcatgagatgataatgaagagagttaggtcgcctaattatataaaaccatgtacggtgctaaaaagcattgtacgaaaagatagtaaaaatgcctaattctgtgaaaataaaaaggagaaaagatggtaggaactaattcatgaccaattgcacgcagcttaagaaaaataaaaaagtgatcagtttggagtattgctaatgttatgcgtaccattatttcacatacggact

SEQ ID NO: 31728 - DNA, 1501 bp, Oryza sativa
atagttagttactaaaacaggaacggaagactattacatattatggagagagtgaactaaccaactcaagagcatattgtttcataagggtattgtcacatcctgatttttgtttcaggatttataaattatttaataaattattattagaatttatattaaatgttctttaattttcaagtgaagttaaatgtgggaaataaaatttcctaaatataaagcatggatggatttaatttttattaaattctccatggttaattatactctctggaatattctcggatttttcggagctcaattcctaaatgatacaaaaaacagttcagtaattagttaatcaattaatgatctaattataattgttaaaagcttttcttgtttaaaaatccttaaattgttgtttaaaaggaattattagaaatgatcttaaaagcctaaaagagaagatctaattttaatttgctaaatctcaatataaaattggggtagataaaattttgttaaatacttctcttgaatctttagttcctagatttttctgggatttatttgagccaagaaagtatttttaataaatggaattgcatttcttgaataatttaaattgaaaaaggtttttaaaagtctcttttggctttgggccgaaagccggcccaaaacctctctatttctctctccctccccggcccagtcggcccagtccgccgcgtccctccctcctctctctcagccgctgacaggcgggacccacctgtcggggtcgtcgtcctcctcgagccgcccggccgaaccctagccaagccgcgccgccgccgctgcccttccaaattccgtcgcccctctctatttccggtcaaattgattgagggcaaatgatccttgagatctcctcttccttttctcttttggaaacatcggctaattttctttggaaaccggaggatttgagttggattcggattcatctctctcctctaaccctagactttccttctcgccgccggtcgccgtgggcctccgtcgccgcctcctagccactataaaagcacccccgagctctcctctatccgccgccacctttgccttagcccaccgtcgcgtctagcgccgcctccgcgtagccctagccgtcgccgtcgttgccgtcggttcagccgcgccgcgccgccgttgcagccgccgtcgtcggtcgccgtcgccaccatcgggatcacgaggtcgtcgccgtccccctccaccgcttcgccgccgctgtagcacgccggagcaccgccgtcaccgtcgacccgaagaccgccgccgcttcaacctcgccgccgtcgtcatccgtcgtcgtttgtcgtcgtccaagagctcggtgagttcgccgcgtcgccctctacccgttggtgtcctctgtttgcgtcgtcgcgccgtcgttcgccggcgagcatgcgccgcccaagccgtcgccggtgatgacgtcatcgctgacgtcatcgttgccgtctgccttata

SEQ ID NO: 31729 - DNA, 1501 bp, Oryza sativa
ggcatcggcgcggcggtgatgtgcaacgggcgggagtgcaagcgggagtccgcgttccgcgcggcgtcgctgctgcgggagcgcgacgccgccaagggcgagcagcagcagcggcagccttcggtggacgggcgcggccggcaggcgacggaggcggaggcggaggcggtgacgatgtcgagggcgagggcgagggcgagagcgagagcgtgggaggcggaggtgcggaggcggcacgcggcggagacggagatcatgaagacggagaagatcatgcacctgctgctctgggggcccaactgacggcgatccggcctgtctcgtgtctcctctgtgccccgggaagctaggttgcatcgtaccaaaccgtttgtgtgacggggctctaccgctctatggcttggcaacttggcatacttgtttatttgtttctgttacttggcaaagctgctcaattatttggttcgcttactccacaagctgcacgatcacgttgcttggcagattgcgatttgtgttagtgtttcttcctttgtttaggtgtttattacagagaaaattagctcatcttctcaaataaagaagagaaaggaagagaaagttcatttaggattgtgactcgtgagatacgggccaggtatgcctgaccacatgctatgtgtacatgcgtgacgtactgaagcaaagtcaataataaaaagggtataaggagatggggtataaaattgcctatgggcttttgctaatttcctcgagttccgtcatactatgttctcaatgggcttgtttccgcggcccattgagttgaagacaaggggctttcatgtcatgccccgaaggccgccaccacgcatgggctgctgatgggctgatggcaaattggcaagtccatcagcccaagcaaaagtaccattttgcattagcgactatgggcctgtttggtacagctccaactcctaaatttagctccaggagttgggtctggagtggagttatggagctgactaaacccaactccataactctagtttattttgtgagagagctctacccagctccactcccaattttggtggagctgaaactgtttgtctaagctccagcctgtgccaaacaggccctatatgacgtgacgtgcgaagaacaaatgaataagtttgatctttcccctttcaaatttcaaaactcacacaagtttgtaatttggcggcaactttctgaactcagaaagcaaacgccctccaatacattcctgttccctctgttttctgtttgtggggtttgcgcattcgtgcaatctacggctctaatttgtatgggaggaacactcgatgcctcgattaaacaacgttaaaaacgtaagtataaagaaaccatactctactggtactccctccgtcccaaaataagtgtagttttacactattcacgttcaacgtttgactgttcgtcttatttaaaatttttttatgattagtatttttattgctattagatgata

SEQ ID NO: 31730 - DNA, 1501 bp, Oryza sativa
ttaatccgatttaatctttgaaaattcataactaattctttgtaacttagtttaatgtggttcaagttgcaaaagttttataaaataaagatctacatattaaaattatccataaatagaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtactgtttatttggtttttattagtttttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattctttgataccttgggttattataacttgactagttgagctttatatattggttcagctagatattagatatgattgcttagccatgcttagaaacattagcacattattgggataacttatgactcattattacttaatgatggtttaaagatagttcacgatggtcaatcgtgattggttaattaattacttgccaactaaaacttgataatggttttgagagtcgtgctcatgacaattaaggaccggttcgcgagctactattgtgaaacattaaccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacaagatgttgaggctgtgtcttgtgggtacagtggtacacctctggccagagtaaaactattcgaatagccgtgcccgcggttatgggcgggttaagcaatgtttttcgtgattagtctcacacctctcacaataattatggatgttatacctagtaataatttgcttagctcctggtttggagttagttctgtacagccgggtatggttgttcaggatggttgggcctgtgcagcatgggtgtgttgttcagtgttgattaaaatttctgattaattactccactgttttacttctcttaaatgttttgctaaatgctgcttttgcaaacgagcctatattatgccatcctttggtatccttgtgcacttgcatatttgctgtgtggcttgttgagtatgtcatatgctcattcttgcaataatcaatca

SEQ ID NO: 31731 - DNA, 1501 bp, Oryza sativa
cctctctcattgtttttataaacatcactgctctctccgtcccatatcatagttgtgggaccatctgtcttatttaatttttttttgtaattatttttttattgttattagattataaaacatgaataatagtttagacatgactttatttttattttttaataaaattttcaaataaaatggacagaaatattagacatagaaacgtacaactacacttaaaatggaatggatgaagtacttttctattgaaagtgtaatcacacgtgcgtaattgtcagacatggtttgaaatcacgtttgttggtgaaatataacccctaatgagattgtggattttataagatttaacacaaatcaaacggtttgggaacttttaattaagtgacaaacacatgaagtcatgtatcagtactctactaccgctcctctctgttaaagaaaaattaataaggttcttttgctcttcactaaagaaagatatgttgaagttgagtggtagttcacatgaaacatcacaaaggcttgcagaagatacttgtcttatgttaccatgttcaacatcctctagattcttcacgctctgccggctgccgccgtaagagctgcacgctgtatccaacaatcagcgtactctccacatcacggctgctatttataacagttgaaattctctcttttgtgtggattccgtttgcctttaggctctgttcgtttcctggagttcccaactcccccgtctcatttttcacgcgcacgcttttcaaactgctaaacggtgtattttttgcaaaaagtttatatacgaaagttgcttaaaaaaattatattgatccatttttgaaaaaaaattagcaaataattaattaatcacgtgctaatggactgtttcgttttccgtaccggagggatgggttcccaactcaaccaaaagaacagagccttaagccttagtcttctacgtacagactgggctttagtactaagcaaatgggcacgcgccaaatgcgacggaatcaactcaatcaacaagtactaaacacacttgttgtactccatttcaatcgcactaaaataaaaacggcgccacgaatatgcgccggcggtgatcctcgggagtatccagaggctgcgcgtgggttcgcagctggggtgtttaagagcaagtttaatagtatagccaaccgctggctttaaattatctatagttaacttaatagtcaatttatcttttcacacttgtcatgcacacatgtatttgggagtccgtgtttcagttggctacaaatctgtagccctctgttcttttctcttctatttcatctcctcgaaatatgtttatagcgggcttatagtctctcattgtacttgctctaaaaagtgatgaaaataaagattaagttgacgcacgtaaaataagaaaactattagcatataattaattaaattttaactattgcaaacttaacaaatgtatacgtttgatattttttttaaaaaa

SEQ ID NO: 31732 - DNA, 1501 bp, Oryza sativa
caaccgacgtgcagatagcttctgggctaaggcaaaagacatgtaattaatatagagaatattttcccttctccctaggtagcactcgcagcacatgtggtatccccttagagtataaaaggaggaccatgcctagcggagaagggggatcggactgaggatccctgagccaaagcttgtctaaccctagcttgcataccagggattcagggactttctaagcacagaagaatcatacacacaggagtagggtattacgctttatagtggctcgaacctgtataaacctcttttgtctcatcgtcttggaggagcctccgagatcaagatcacacacagtttcgctcaccaaatccttgaatctcacccgctgcccccgaccgaactctcaaagggaggcctcacagcctcccgctagagagggtcacctctcgacaaacgtaaaatgagatattttgtatatataataatatgaatgaaatcattgcggtgaacataaccattcaaaagttggataagcaacttcaaattatttgtgcccatatgtaatagtccgtatgtgaaataatggtacgcataacattagcaatactccaaactgatcacttttttatttttcttaagctgcgtgcaattggtcatgaattagttcctaccatcttttctcctttttattttcacagaattaggcatttttactatcttttcgtacaatgctttttagcaccgtacatggttttatataattaggcgacctaactctcttcattatcatctcatgcgtgcgtgataagaccaaattttcttgttctgtttgtgtaggtcattgcgcttgttccttgatattttagatcttaattaactttgtgtataataaacatatataaaagttgattttgatatggactccagcattgcattacgatcgggctagaagtttttataagatggaagacgccttgcttttctttttctttcagtgagccaagtcagtcgacgtgattttttttcattagtgtcagaatcgctctctttttttttcattagattaagatttgatcttgtgattataaattttggtcccatcaatttaaagaaaaatcaatggtcaaatgttttttttcttttttttctttttagtttattagagtgatgcatggcggtttagaaacgtttataagagtatcaagttgcagcttaaaaaagtttgtacaatgttttaatagatttttaagtatataatagatatcattatctcatattccatcattcgctccataaaaaaaatattccatcattccatttcaatgtttgccaattgactttatttttcttttggttgaaacggtatgagtcctgtaaactgtaccctgatggcgccatctgaacgtgtcatggcttagtctgctacgttttgttccttgcaactgttctatacccttgagatggtgactgcctttagctaacaaaatgcccacttgtgcatacattctttcttttt

SEQ ID NO: 31733 - DNA, 1501 bp, Oryza sativa
gtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccgatggttgaaaaaccaatgccagctatcctaatgaactgtgataatcaaacagtgattattaaagtgaatagttcaaaggacaacatgaagtcatctaggcatatcaagagaagactgaaatctgtcagaaagcagaaaaactctggagtgatagcactggactatgtccagacagctaaaaatctggcagatcagtttaccaaggggctaccacgtaatgtgatagacagtgcatcgagggaaatgggcttgaaacccacttagagttgcacaatagtggaaacctgtccattgtgatcggagatcccgtgaatttggatggcgaaacaaactattgtgtaaccgagagaagagacccttaaatgggctcattttcatgatgtacttctcttctactctgtgtggtaggatggcttatgcctcggcttttattaagcagagatgttgacctgcaaaacatattagaaggagtacacctatatgagttcgactactagtcacagtctatgagatttgggtgatctctagatactcatgaaaggcctggagtatgacttataagctccaacctgagggaatactaacggttgcctagtatcagttatggaattgagtgaaacctaactgcacaagactgacaattcaaggcatagtccattgttcagttgtggtccggtgtagctccttttctaggtgaaagttcaacttaacagtcttcaccaaaacactggtatataaaagctgctatggaatagagagcattctcatgagccttgaaatttggtggggattgttagatttaattgggtaattgatccaattaaatcaattaaatcatataaattccaaggctcattatgctaggaattcatgtgtattcatcctcttatgggatatcaatgggatcaagagttttgagaattaatccatttgattagggaattggtaacttatatcaattactcctacttcatggatggttgatggttgtgtagtggaggatggttcatggctagttgatcacaataagttgctctattcctcttcctattccatttgtaacctacatcaattactcataattgacggttggttgatggttgtatagtggagaatggttaatggctaattgatgagaattagttactctatagctcttccgatttccatgactcttactcttcatcttgaatttctcatataaaatgagaatggatttgatctcccaaaagagaaagtgagacacactttcatccattttccaacgctgttgctgctacggtaatcccatcccga

SEQ ID NO: 31734 - DNA, 408 bp, Oryza sativa
  unsure (1)..(408): unsure at all n locations
ctgtggtaaaagcaaattttatttttcggcccaaaagaaccccttttcccgagagggataattaaggtcgatttctttccggaaccttacagtgccccctccaaagaggaggggcagccacacctagagaagacttgggagcctttagccagtcggagttccacccgcaaccactgtatttctgaccagttcaatnctcaaattgtttatgccgtctgtagtgaacagctcctaattcaaagttacaaagacttaagacaccactgtagtttgcggacaagttgtgccggttgcattatgacaaataccacctcttggtcgacttggctcttctttaaccacagagccaaagtcaagtgttatgatctcatggctcttgggtgtaagangaggccagatcaagaacaa

SEQ ID NO: 31735 - DNA, 1501 bp, Oryza sativa
tcctctagggtttgtcttactcaaccacacgctgttgggagttcatgttcttgactctccacttgcttgatgcttaactaagtatagagtcgggggctaatgtgggggacacggtacctaggtaccaactgttgggcctttgggccgcatagcatgtggtgggccgagtaggcctgagcctatgaggagcatgcgtggctagataaggcaaccgatcttatctcatgtaaatcgatggtaggttgccagattataggagatatgttacctctatatagggtgaaccaaaaaccctaattctggggagaggacgatacgtgctacgtgctattcacacgttgtaccgcgcatactcaaatacagatctaatctcatacaactagactaaggcattacctctaccatttttgttggcggctaccttaaactagccgccagcgaaaagctatattccctggcagttggcgatcgccagtgaattgaagatgctgcatcttcactggccattggtctctagcaatgccggtggccgcaaaaaaaaaaccatttttgtattagtgaatttatccaatgcattgtttctacttgttggatcagataataattttctttgtccatctctctcctttgattttatgttgtcgatactgccctcccctccaatgctcttttacttgcatgataatgtcagattcaagacaccattttctctctttaattgctgacatgaaaaatcctatgtggcaagattatttgtctctcttctctttaatatttctctctctactctttaattgcttgtcaagtgaccttgtcattttcgaattaaggctgaatattcctgtcagaacccatgcaacttttttttagacgggtcaccggggggcgaaatgcccacctaaatatattacttcaaacggtcttacacagggcaaagcttctgctacacaagcgcagtagtcctggaggataagagaaagtatacagggaaaaacaaggaagagaaacacaacagaaacacaaccaccccgaagggcacctgagccacactagcaggactacgagagagagagagagagagagagagagagagaaagagagagaggaggtgtttgatgtttttcaccaacaagatcacaaaaccacaatcctaatctgagctaaagctagctccctagcctgacaacatctactctacacgcaaccttcaagcaccgggagttgaattgtcagaaggccatctgccacgcacaagccgactcagtttccggagattagaggttgtgtatgtcaaagaccacctgcatcaagccatcaaaacccgatttcattgtgttgaaatattgatcaatgctcgccaacgccctttgggtaaaggatgccccagaagagggagagcaactaagggttgctgtaaaggccgcacacatcaaatcggcttcaatccggcattagcaaattgccaattaatacaacgcccccgacgccccaagggagaagg

SEQ ID NO: 31736 - DNA, 1501 bp, Oryza sativa
aggcttgggatctaaggctcgtcctagggtcaagggggctctgataccaacttgtcacgaccggaaataacccaacgggtgttccttacgtgcgtgcattaatccttgtcccaggaggcaaggtacaccaaaagttgatacaattcagagtttaacaagcggaagcgtaaatagttaatttattacatgggcagcaaaggcccagcacacacaaagacaaacgagaaacagcggaagactagggcgatgaccacaggcgcttgacggcaggcacgagctagacaccaaagccttcatcttccaggggctcctcttctgggtttgggaaaaattgagcaagactaagtacaaccaccgtactcaacaagatacacccacaagtgcagaataaatgcaagggagtacaaaggagttatactataaagggttagggttgcagtaaatagcatttaaagatatttagttgctcaaaactatttagtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccaccttttaattgttaagcaggttttaagaattaaaacactaactttggtacattgctcggcttgccattaccgagtggcgcggctattcgaatagattatactctgatcagatggtgtacatcttaaccactaatacacatcttcctcacgtgtaaccacgtgccacataccaccacggtatacagacggaagacgtgacatagtttccaacccatcctagccatagacaagagtaccgacccaatcccacctacggccggaacccccaggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatgtccgaggtgctactatcaaaaccatgcaccccgagcccagcctaaaaccattttggggattttgaatagaaggagcggtgtgaagccaattccacaataaccaaaccattccatagtgtccaggtgatatgaacatcccaaagtctagagttgtaaaatcacctaatgttacctaattaaacagcgaagcatctacctaaaatcatactagtggtaccatgagtagagtgtccactagttggggttttgtttaatctaaggtgaacaaggtaataataacaataacaataataataaggtcataacaaaggtaaataggcatggctagataaaacagtgataacgcggg

SEQ ID NO: 31737 - DNA, 1501 bp, Oryza sativa
gaggagcccctggaagatgaaggctttggtgtctagctcgtgcctgccgtcaagcgcctgtggtcatcgccctagtcttccgctgtttctcgtttgtctttgtgtgtgctgggcctttgctgcccatgtaataaattaactatttacgcttccgcttgttaaactctgaattgtatcaacttttggtgtaccttgcctcctgggacaaggattaatgcacgcacgtaaggaacacccgttgggttatttccggtcgtgacaagttggtatcagagcccccttgaccctaggacgagccttagatcccaagccttagcaatattttcaaaataaaaatcccttcttatttgtgaaaatcctctagtctctctctgtcctgctgcttcatttatcgccaaaatatgacctttaaaatgttgcttttctttttgtttttgtttgtagatggccggcagcgtcagccgtcgtggtctggacatgactggtttcgtcttggagctgcggggcatgtgcgttgtcctggggtatccgcatggagtggactaccagggcaggccgctcccggagcaggagggtgacgatgcagagccccatgctgcttgggaggttactgcagtgatcctcactggctctcccgagcggacttcgttggcagtcaccgcgggtggagattctttccccgccgcttgccagagcgccgctctcctcgccatcggcactcttcaccagggctacccggacgagttgcagcactcgccctaccgctaccaccctcgtcgcggaggagcccgcgacttcgccaccttccgggatgctagctcggaggatgacgctaccatcatgcacctggcgcgcatggtggaggcgtacgatgcggctcgtatcgacttccatcagatggtgcgtcgtgggatggtcgagaacaacatgaagatcctggagctgcgtcaggagaatctgcagctgaagaaggacctagacgcagtggaggcgcagctgcatcagctcaagatcacccagggagaggtctgtcgccccaagtgtcgccgcgtctgccgcagccagaagatcaccgcccgcaagagcacctccaggcccgagcttgttcgtcagtccctggcgtggacttgcttcgtggagacccctcgtgccgagcctgcgcccgtggttccccaggagggggaagcctccggcgttggtagcatggaggatgcgctgttgctcaccttccgtcctggcccgtcgcagcggtagacgagcagttagtaggcttgcgcgtgtgttctttctcgtttgtcttcttgttggagttgtgtggggcatggttatgccggtgtgtggtgtaactgtgtcggagcctgtctttattttatttgcttaagcaacttgaactttaatgaaccaatttaatagcagtaataaattcaagaattatggtagtcgtggatggttagctttaattgtcagctctctctgtttgctggttttgggtggggttttc

SEQ ID NO: 31738 - DNA, 1501 bp, Oryza sativa
aacaaatgtactaaattaaaatatttatttgaaattttaataagacaatggatttttttatcgggagcattcataaaaaaaattattgtgagcattggtagtcctatctttatataaatgctcctcatcttttatgacttcttttaaataataaatacatattttttatttcattatctaaaaataaattttgtgataaataatgcatcacacaacaaactcataataataatagactcatgcgacaaacttttacatttttaataatgtaattcataaattctattttcatccaaagggtaaaatggtcattttcatagaaattagacggtcaactatggtcaactgaaggaaggagtatgaaaaggatcaaaatcaaattttaggggtatacaaggaactaagcaaaatttagaagcatagaagggattagctaaaatttctggatatataagagattttctcttataaaatgtctcaagtttctctttctcatacaacaaatttttgtacactataaatttatatgtttgcataccatagggcaaaaatagactttttcataagagtttaacaacgaactaacgcaaacggtgcagaagagatgcaaactaaaatttggaagtataaagggaatgagcatactgaagagcatagggattagacaaagttttaggcgtacacagggaattttctctttctcgaaagtgtatggagtaaccaactctatcatccaaaccttatttactttcctcaaatcggctttctatgaatatgaaacttcatttgttataacctactcctgctttatttgtctctctatctttaatttatgatatatccccatatatacaatgacgataaattctgccataacaatctttttgtaggctctaattttcacctgcacttatgcaagttgtcaatgatattcctctatggacagttatgtctccaagaacaaaactatgtaaaaaagaatcacctagcaccaccgtgcacacataagccagtaggaatttaggcatgtgcaatatataaatgctccacagtaatctgttatcctaactgacagctgcttataccaaactaccaacaaataataaatttttggtgtcacagaatgacaattacatgttccccaccagtgacaacacactgatcagacctgttaacaacggaaaaaggatgagtctgagttaatggcaagataatatcagacacgtacatcctttttatatctcaggatggagactcaattaacggctaattaaaacgacaaaagcattatccccgatggtttcacaactactgtagtatataaatattcataccgcatgtcaatcttcttactctagcattcctcgtcctgccctctaaaaacaaaagaaagaaagaagagaaaaatgagtaataagttacacaatagtagtagacattcatttctactggcttggcattcctccaacctcgcgattttacacgaagcaatcagaataat

SEQ ID NO: 31739 - DNA, 1501 bp, Oryza sativa
cgacaagcggagcctcgacatggtcgaacaaacgcccagcccaccagccacaactgagcctcccaagaaagtgagcaagacaaataagacgccgaaaccagacagcgcgatcatgatcgtttcgctctctagtgccaaccccaacaagaccgtcaagatcggggcatcactaagcgagaaataggaactcgcgctcatcatcttcctccgcgacgtgttcgcttggttgccgtccgacatgccgggggtccctagggagttgattgagcacaaactcatggtgcgacccgatgccaagccagtaaagtaaaaactgcggagatttgcaccagaccgaaaacaagccatatgagaagagctcgacaaacttctcaaagttggctttatcagagaagtatttcatccagagtggctagccaatccagtcatggtgcggaaggccaacgggaaatggaggatgtgcgtcgatttcaccgacctcaacaaggcgtgtcccaaggatcacttcctcttcctcgaatagaccaactggtggactcgacagccggctgtgagctgttgagtttcctcgacgcttactctggctgtcaccaaatcagcatggcgaaagaggacgaagagaagacagcattcatcatgccgttcgaggtattttgctatgttaagatgccattcggactgataaccgcaaggaatactttccagcgcacggtccagggcgcacttagtgaccagctcggcaacaatgtcgaggcatacgtcgacgacattgctgtcaaaaccaagacaagcaactcattgattgacgatctgcgggaaacatccgacaacctccgacgatatcgcctcattcttaatccagagaagtacacgttcggagtaccgtcgggcaagctgctcggtttcctcatctctggcagaggaatagaagcaaatcccgagaagatcaaggcaatcgagaatatgaagtcgcccacaagactcaaggaagtacaaaagctaaccagatgcatggcagcactaagcaggttcgtcgctaggatgggagaacgaggacaacccttcttcgctctgctgaagaagcaagacaaaattgtatggacacaggaagccgaagaggcattcgttgcactcaagcgctacctaacaaacccccctgtacttgttgctccccaacctaatgaagaattattcctctatattgccgccacgccatattccattagcaccgtcattgttgttgagagagagaaagtacaacgaccagtctactacgtcagcgaagctctccatgacgcaaagacaagatatccacagatccaaaagctactctacgcagtaataatgacatcaagaaagctacgccactactttcaagcccacagagtcacaattgtctcctccttccctctcggtgaagtcgtgagaaacaaagacgttgtcggccgcattgcgaaatgggtagtcgagctaagccagtttgatgtccactttgtaccac

SEQ ID NO: 31740 - DNA, 1501 bp, Oryza sativa
catatttttcggtgagattccacaaataaaattgcaaaatagagcttaaacattgtcgcactgagttttgctatatgaaaaaaaaaagttcaatcaaatatgaaaaataagtctaatgcaaacgcttggacaatatttacttggctagtttagcttgtgataaccatacagcaccgataacaaattgatttgattaagtacgtgtgcacattaggatggtttttgcaacaaattaagtaggggtgggtatttgcaacaagatgatttatggggtgaaatgttaaacttcaagtgatttatggggtggtttttgtaatttttccattacgtaataacgaaattaatcaaatatcaaatgaggtattgcacacgtgggaaagggttgggagtttaaaactcgaggatttcttatgaccgttggcacgtgcagggtgcggcgagcatctctgagcctaaggctatgttcgagaggaggtgttaggaaaattgggaaagaacacagttgaacgtcggtgatggccgccggctgggtgcacacagatcgacgacgttgctttacgttctcgtctggtttgggccatggcgactggcctgcacgtacgccacggtgatcatgccgctgcaggggtatatagaagtatatatcttctcccgtggtggccacccgcgtggtcaccgccacgcctgcatatatatataggccgatcgacgaaggacacgaatacaacgatgacctcaagtttaattgttcaggaacttaattacttgccgtgtccatgcatgaatccatatatggtaaagaactagctagagaagctagggcgccatcggcgcggcttacgtgctcgccggcacgattgtctcgtaaagtaattaatgttcgttcgttcaccgtaccgttggggttgattcggtttcggcccatgatgtcaacctacaccggcgagatcatacggttgcgaaacagggccgggctgtcatgcgagcgggcgtggcaagaacgccgtactcttatcagtcgggggcagctaatgcgcgaccagactggtcgcgcggtccgcacctgctgctgctgctaattactactagtagtactactatactattactactactagtatctactactactattactactagtacctactattagtatactgctggtactactataaaaaaaatatatttttatatgtataaaaatatatatacatacgcgtataccaagtttatatatatatatatatatatatatatatatatatatatatatatatgatatatacaaaagtttgtatacgtcgtatacaaagtttgtatatgtcgtattaaaaaaacaaaaacaatactagaaaaaaatcacgtatacaaactttgcatacgcacatcttaaaaataaggagaaaaaagagaaactggaaaaaaactaaaacagaaagagaaaactgaaaaggtgtatacaaagttagtatacgtacgtataaaacctaaaaaatac

SEQ ID NO: 31741 - DNA, 153 bp, Oryza sativa
caaccatgtagatcatgattttagatgaattatgagacttaaacggcctcattccgatttcgtatgagttaattacgaattttacaagatttaattccaattaaagcctattaaagaaaagactattccaaattaattaaacaatttacaaat

SEQ ID NO: 31742 - DNA, 1501 bp, Oryza sativa
tcaatatgtatgcaccccgcaactaatggttcaattcaaccgagcctaacgaatgctgccacctgcctagtcatccaatgcacatattgttcttatcttgctcatcgttaagcatagttttaatcgccatttggccaaacattaactactattagtcctggaattagcttcaacttgcagtacaaagaagagattagttccaactaaaacacgtcacgagtggtttggcattagttgcagggtcgttttcaattgtatggccctattaaattacgacggagtcgtcggttgatcctacaagtcaatgatgaattgcgtgtttgtttacctgcaagtgtcatttaagcaattggttgctgacttaagagccaccgtaaaacatgctgtcctgatcagcttgggaaacaaaaaaataattctcagcaaacagctcctttcaccttacgcacgtagcacaattttactaacaaaatctagtagcattagcaggattagatgacaaacgacagcaacctgcaacctcatcagttacccacattccctaataaaccataatactccctccgtcccataatataagggattttgtgtttttgcttgcactctttgatcactcgtcttattcaaaaaattttgaaattattatttatttttttgtgacttgttttattatccaaagtactttaagcacaacttttcattttttatatttgcataatttttttgaataagatgagtgatcaaatagtacaagcaaaaactcaaaatcccttatattatgggacggagggagtataatacaaattgatttacaggtaaaacttttgtatatgtgtttttaatgagctattactccgtcccaagaaaaagacaaaccctagctatgaacctatgtccaggtttgtagctgggattaggtttttttgggacggaggaggtaaaagacaatgtttaaaaaaactacattgaaaatattttaaaattaagtttgaaaattcaaattttagctttgactttggtttattaaatcaaccgatggagcccttgagcaaatccaggttgtcaggttgacattctgattaaaatcatgtattgtttctctattttcgttcatgccattgattaaaatcatgtagtgttcagttactagttttttgttcatgctattcatctgattatctgaagataccttgcctagacactactgaactgaactgaacgcggcacgccaagtttcagactttcagtaccagtacatgagtacagaactagaaatcctttacttacaacgagaaaaactaacactacaagaaaccatctgattaaaaattttgatgcagttcagctgcaaatactgcaaagaatctctacaaacaaacagtcatctgaagatgagagataggaatctctctcaatctctctcttctctgcaatgcctgtctattgcaaagtcactgtgattctcaaacgaggaagacgacgacgagggaaaaccaaaaac

SEQ ID NO: 31743 - DNA, 1501 bp, Oryza sativa
aacaagtggttgtcatgtatatctccaataacatgtttttttaggaacaaccaatatcatgttctgtaattctgtttaggcaggaaaaagagagcaaatattaaattgcagtttactattgtagacaaggacctttacctattgtaaagatatgtggtgtgtttgaaggagaaacatcaacgttcttcggacttccacaatgcttgcaattgtccccaaagcacaactgttcatcatagagaaccggaagctctgcaaaggattcgatctgcaaaaagttatcaataactatttgctactcttgcatataatataaaattttagctacacaggaaatctgatgtgacacacctttgttgtttgaggtgaactggcatcaagtctacagaaaatcgtagtatgttctttctcaccaaaacacttcccacacctgcagctcatttgcacatggaacttaatcccgaacagatcgtgtgttcggcatatgcaatctccgcagctgacaggacttacttcacgttcctcaatctcactgttgaaatcaaaatgcagaggagtttctgacatatgcagtgcttgaagaatcgttgccacaacctcagaagcaattcttttccagcctgcaactgaaattgattcaccaggtttaaccttgtgaaggcagaaaaatatacatgaaggataaagttctgaagcagaataaagatcatggtagcctccgaccgattagttcggcactttacatgttaatcaggaaaaacagcaacgaattgattaacagagcttgccaactaaagaacattgcactcgtatatctaagtttgttcattccagtgcatatggaagtgtggaacaatgacaatgcaaagaaacccacataccttctgaaacatgttatcatttgcaattttacagagattaaccttcagagaggtcagtaaaacatccactccgttgtgtcattattctcccaagcaaagaagattccatagaataggtcagcgatgcagaagttttctttgatatgtaggattgttgcaggtggtgcccttaaaatctcatctctgaagcacctcaaattccacagtgactgcgcatgttcatagttaatcagaactcagaagttagcacatgacaaaacatactgcatgcaactttgtactacctgtatgatcacatgcaagataaacatgtctttgtccttgttttctttgttgggaacatcaatacttggcatttcctcagcagattggcaggagttactggatgataagaacacacaatcaccatggatagatcggttggagctctgctttcgttggtttccttgttcccagcgggaggcctaggtagacgatggggaagtcttcaactcggcaagagaggatggattcaaccagaactcgttgttcattgctgcactgaatcggtgtaatagcgctcttgcagaagttggttttgagtcccgttgcctcaccaaaaagagtcagcaatctcttga

SEQ ID NO: 31744 - DNA, 276 bp, Oryza sativa
cggggcagcagcactttttcaagcggtagccaagccaccatcagcaatatacaagctaaagaagaacagtgagcacatcagccatagccaagcaatctgcaatcagaagggtttgatctgcaatcaaagagaaaactatgtgccaaaccggtagcaatacaaatgtgtacagtacacagtcagaacaagagcataatttagacaaatttgtttgtcagatcaaatttttaagcaaaacataagaaacagcacaaaagggtatagcagaagcaaaat

SEQ ID NO: 31745 - DNA, 1501 bp, Oryza sativa
aagcaaaacctatgatccacagaaaaaagaattaagtctgctcacaactacacttaggtgtcaaacataggttgctacgggaccactgaatttaatttaagttgataaaaagataaagtatgatagcagcatggaaatatttttagttaagaaaaatgcttatatggttttcctatatctaagtgtacgcttcagataatatctttggtccaaatttaatgtggtccgttttgggacgaggtagtggtatttttcatctaactgttaatgattgccattcatttttctacaagctttatcttcaatattatgagtctataacattctctattccaatgtattctacccaaaataattaggcacggccaagtacatagaggttattaccttaatttttacagttcaaggtcaagaccatactttataaccaaacatttggttgtttgatgattaaaaggaaataggaccatcagaccccatgcattaatagaggacagatttgagcaaaactcagcttttaaggatctaatctacctcaagcaaggctgtattctcttttcatgccaagtgaaaactaggcaggtgcacttgctccggcacttcattttcttcttcagtccatactcatgcaagtagcttgcttggatgattttgagtaaatttaggatgttactggagggcacaaaggaattcaggtagatcaagctattgtgcatgtaaaatgtgtatcacatagatccaacatttcgttccattctatttggtggagactggcccagaatacttatggtaacttgtcaaagacagcagcatgtgagagtgactatgcaacaaatcttttgcattggtaatatgcaactatctggagcagatcatgcagaaattaagcgctagcaagaaaatgtttagggagaaatggcatatttaagctcacgataaagtaatccttgaacattaagatcaagaacagctaaaacatcacatgttatcaaatatacacctgtcttatgaaatggcccaaatgagatgacagcagacttttggaataggaaaagccagctaacttgttagttgtcacctttatttaagtagtcttgagcttactcttattctcacactctctcagcccattctgttccttctcatccctctttctggtgtgtagtgtgtccaataattaggaagcagggctggttgcttctgcgataggagaaaactgcaaaccagtgtaggggcaaaaatggctgcctgctgacaagttctagttcacagtcaataaagccattcaccttggaagtgactccctattctgatcagcagtcatacacaaattcatgcagtgtatgatcttggtctccatgcatgaactctgctaccccacattctgaagattaactgatgcttagatatgtgcatggcaaagtaatacactagttcgtgagtatttccttcaggacacttatgttctttctttgtttggagtactgaggcacctcaccaa

SEQ ID NO: 31746 - DNA, 184 bp, Oryza sativa
taaaaatcgccctcccagagggcggtaggcgactatttccgtcaattttcaaattggaaaattatttttgtaaaacttttaataaaaaaaattataaataaaaaaaattccagaaacagatgtacgatgcgaaattccagatttgcccttccacttaatcagcacaacgcggatggaggggagg

SEQ ID NO: 31747 - DNA, 1501 bp, Oryza sativa
cgtcgccccttgctgactaactctggaggagtgatatgtcggatctttcgtgggaaatcttgtgttgtcaggggaccaaacgtcggtgagtgaggtggcgtgcctctctacagttcgtccactgatgcagctccgatctcttgactgagttggatgactgaattcatgctttttttcttctcttgaaagagtttcatcatgattttagtgggttatgatgtaaaccctgcacaatctgcttttgcccaacccgtttagcaaacagaatttcagaagtcatgagaaaggttaagtcctcaggagttctctttgcgattctcgacagaattgaactgattttcataaaattcatgtagaattcccatatccccgagaaggcctaacagtctttctggtgaatcataccattctttaacaaatcatgtcaccctacctcctctcatttcattatgttttgtctttgaattgctgcagattttgacaaaccaccaagagccacgctcccaacagaagtctgcacagacaaatccggccaggaggccgcctcctgctgccatgacatcccgagaggccccaagaacccgaggaggaagaaggcagcaagagcatcatccgcgagctccttcttgtcgaggtcaaggtcctcctcgtttgtgacagcgtgcggtgatttcagcgagttgcgtggcggcctccgagtcgcctagtttgaatgacagttcatatagttttctggtgtgtgttttcttcgtgctgttcgatcaggaggagaataaaatcgcctgaaataatcgtatgagcgttgtgatggatgctaagcgtctagattagggacatgtgtaatgtgtccatgactgaacaaactatgcattgtactgctttttttgagttttggctatttctgaagtttgaaaagttgaccggacctgaaaatggtgaataaacaaaaatgttccacctagtctgaacaattattctctgaagacattgtcagattttgtggatgcgcaagtcttttgtctattcctgaaaaaaattgtcatatttggtggctccatgctccctgccttcttgaccaatcctgaaactttttacagcatctttgagcattctaggaggacgcaagagcccctaccaaatcaaattctcagaatttttttttttactgaatgttactactgctgtttgttcagagattcctctcacaatgttccaacacacctactatattcgatccaggaggcttctgaaatttttctatgacatgaatgattgtcctttctgaactacaagatgaactcaaattcttctctgaatctctctctgtgcatagataagattagctgctcgccgcctatgcagagaattcttttctgaatccttctactactgccgaccaacgcatggtgtcgtcgcctcaagcctcgccatgtgtgtgggttaacatctcgacttctcgagtcatccctcatctgaaaatgacgttggatacgtatccaaa

SEQ ID NO: 31748 - DNA, 1501 bp, Oryza sativa
cagagatagattttgacgtcctgggggtggaaaactcacgttgagctaagacctcagcaaagaccagactctaatggtgaaggaacatttggagaggagatgatcacagtcttctagctctgtcaaacacaggggcaagcaggatcatgtggccatccgcgcttagcaaggttgtccgctgtgaggcagcgacttttcaccatcaaccacataaagaatctcacccgagctggtgccctagccttccaaatcatctccccataagggcagcgtactgccgtaaggaagaaaaactcataggccgatgcaacggagaattgcccattggttgagaacttccaaaggatagaatcctccaccccttgctgcagctgaaccagctgcagttcatcccatagggctagataatcgagcaacgcccttcctgacaaggagccctgcagtctcctaacccaagtattattggataacccctgacttattgttagattagctctgcccacaaaagaaaataggatgggccatctgctagcgatgctcccgtcgccaggaagccaatttcccctccaaaagttcgtgtcacatccatcgcctagcatatggactgcagttgagctgatgatgtcttgaagatctctgtccgtcccccaaccagccattgtccatggcctatctttgtgctccagtcttttgaaatcccatttcatccttaatgctttcccaaaaagatcgatgtctttaattccaaggccgccatttgaaattggccggcacagatccctccaagcaacaagacagtgccctccattaatctcttcctgccccttccacaagaatacgcgacggcgcctttccatttctttgatcgcccacctaggcagctgtagaacagagaggaaatggaccggaatggccatcaacactgatttgatcaggcatagtctaccgtcaggtgagagtaatttgggtttccaacctgcaaccttcttagccatcttgtcaagagtgggttgaacctccgctttggtaggcttcctgatcgagagaggtagcccgaggtaagtaattgggaaatcttccaatctgcaggctagagtgttctgcgccaatgtcttctgagactcagcacatcttatgggggtaacggcactcttggagaaattgatgtgaagcccagtagcagtcccaaacagattcagcagagcttttaccgcttccacctcatgaaccagcggcttaagaaagataatagcgtcgtcagcatagatcgatatgtttggagctcggttcctcaagtttactttgtcgatgaggccaatggtggtagtttgctagagcattgagtgcattgtgtccattaccaaaacaaagaggagaggagagagagggtctccttgccgtaaacctttctgcggcttgaaggattcacccagggcgccattcagatcaaccctagtttcagctgtcaagaaaagggcagccacccagcttctccatttcg

SEQ ID NO: 31749 - DNA, 599 bp, Oryza sativa
  unsure (1)..(599): unsure at all n locations
tgattccctccctctttccccccacttttccctctctctctccatcggattcgttcgggatcttttcccctaaacctcgccggcgcatcaatggcggccggatcttccgcggccgtttccccctcatccgaccgccctctctcactcccaaccctatataaacgctccccgggcctccctccgccgtttgcgccactcgtcgctctctctccccgccggaatcgagctcgcgccgtcgctctctctctccgccgtcgccgacgagctccggtccgccgccgtcgtcgccccggaccttctcccgtttcggcgtcgccttcttcgggttcgccgcaacctcgccgacctcgtccacctctccgtttcggtcgccgaccgccggaacgccgccgtccccgtcgacccgggccgcgccgncgtctttctccggtccggtcgccgttcccgtcgtcgccgtcgacccggggtgagccgtggaccgccgaattcgcttccccttccctcccctctctcgggcgccgctccgccgcgccggtggtcgccggcggcgaccatcggggcgcgggtgcgccgccttcgggcgcgtgccgcggctgcca

SEQ ID NO: 31750 - DNA, 415 bp, Oryza sativa
gcccgaggaagacgacgactgacgggtgggccccacctgtcagcgacagcgcgctcgcgcggccggctccgaactgggctgtcttgggctgagaagaaaagaagggattttggtccgtctttcggcccaaagccaaaagagactttttaaaacctttttcaatttaaattatttcttaaatgcaattccatttattaaaaatactttcttagctcaaataaatcccagaaaaatctaggaattatagaattaagcaaagtatatatattttgaattttcagggtgtgacaaatggtttggttattgtggaattggcttcacaccgctccttctattcaaaatccccaaaatggttttaggctgggctcggggtgcatggttttgatagtagcacctcggccatataaggaccggt

SEQ ID NO: 31751 - DNA, 524 bp, Oryza sativa
  unsure (1)..(524): unsure at all n locations
tatcttctgccgctaccatcaatgccacaaaaatactctccagganctgaatataaagaaaaaggaattagtttgcgcaaattgattacggccaaacaagtgttaagaagtaacccagcactaccgcagcaagttcagtattgtgaaaaatcatataacagaaggctgtcctttacaaatcaccactatttgtatacacaacagtcagtgaaataaactgtcaccttctatataatacatatgatgcaccaactaatttttctgtcataatactacaatcgctggcattgaaaaattgcctctttgcagagtagcagtctgtccattatagtccgtttagcttgctcctctgtctcggagattacaaacacgataaatggcctacagctccaccatagaatatattaagtaatttataagcaaccatgatcttataaatccaattgtctggcagcaataacttgcttcagattgaacaggacatttaagcttaaggatttagtctctctctttttgtttacagc

SEQ ID NO: 31752 - DNA, 1501 bp, Oryza sativa
atccaattaacccatttgcctcgggtcttctactgcagggatgaacacaatatgttgccattcaaagcagcagaccacctgcaactccactagtccactgacatttttttaggatcatgcaaggaatcatcaacgattcatggtgatcgaatttcacaacgagcaacgaaggtttattacccaggtggtgcattaggatcgctcctccgaccttgatcttacaaatctccggcgactccttggtctttgaacatcttcatctaggttttcctcctcatcgtcctcgtcctcgtcttcatattggagacctagtaagttctctccccataaataacggcgcctctgccttctcaggcccctcgatgagcctcttatctcatctcctgatctcatcggactactactgatcatatggaacagaaagaatgttgtcaacaaagatccacttggttcatttggcatgcctccttcctggtcaggtgaaaacatgtcacccccttcaacaacataatcaccaaacacaactgctccgggcatagccgacctgattgcacttagtatgtcaccatattcacgctggtgctccaggcggtgccatgcacggcgtcttgatggatccacatcagcaggccttgttgtgggatggactctccgggcatgtctacggagctccctgtagttgccagaaaatgcacatgtttcccgcgagcaagatctcgacttctcatccaaatattctctggcctctttgatgatcttccagcctttgacagtgcccctacataatgggcatgccaattggttcaagcgtgtcagttcacttgactccacagtgctactgctctctctttgctgagcttccaaagtcaaatctagatcttgattatagctattttctccctgctgtccagataggccagcagagctttggatagcatctcgatgattgaaaatttcatgggattcagatatgcctgtttggatttctccagtgggatcaaaatgagatctctggggtacattttggctacttatgtccctaggcaacgatgaactttgctgtgacgaaccgtcattgtggtctactttcattttcttgaacctgtctaggcaattcgaatgtctatagcttgtatcgcatatataggatctgcatcctttgtcatgggaactgcacagcagaagaacagcattgtggggatgatccatgcaaattgggcacaatgcatcgtcccattccttgtgcagggcagcaatatttgcatctgcagttggcatcttgaacaaactgctctctgcatttggcatcttcaataagcttgttcaaggatcactgaaaagtaacagcaagttaaaactagcattgagtgcacatatctaacaattgccgcatctgcattcagcattgggactataattatatgatgcatacagtttgctataagaaaatgcccatacgatgcaagcagacaaatgtagaggctaacaaacttcaacagtt

SEQ ID NO: 31753 - DNA, 1501 bp, Oryza sativa
ttatttggagcacattcacgcaggtcacaaaccccaatctcaaacatgtaagtagagcctcccccaaatatactagtgaccaggcctttcatatccatggtgtactgatcatgcttgtaagttgcctatatatctatccatcaatcccaaacgagcggctgcttgttttctcttctcttccattttaatcatataattaagtccttaattaagtagttcatttgatggatgtgagatgagactactagcctagcttagcttgactgctggaaaattgtctctttccccaaggagcttgacctcataccaactgtttttttggtcggttgtaacggtttaactaccatgtgatagctattaaatatgccctcattattttacaggcaattttccccttaattatgagttaaccactattgttctgcggttcttggattattttaaccactaagcctgacacaaaattagcttagttcggcgctgacactagactaattatacttagtttattttcaggccatatgaaggcctgagtgcctgagaatctcagtcagattatatatggaggtttgtcatgtggtagcctcatgaccccatgagctttgaaacaattgcatgtacttcttttcttacattttattaatttgtttggattcacaaatcgatatgtactctctggtgtgtgacaattaagtgaaagacactgcgccgttttgagagattgcaagtctggatatggaaacaaaaatgcatatatttttcatcttgttctagcaaataacaactactcctaggtgcatcacatgcaggataagcatagccattcatattatatagtcacattaagtatagtagctaattaatttgtgtttttttattgtggataagcccaaatcatctggtattcgtaatgaacctgtggtctttgattttagtagagtgttttctaagttggtcaatgcacttggtaggattctcatgtgcttgggttcattccctctttccctaatggggaaatgtacaaaatctctgcaagatacaaattaactcaatgtgagcttgacaaacaaatatgagataacttaatggcaaagaacatagatctatactagatctctgtgcagaaaaaatgagctcaatttgcatcgcattcatgttcgaagtctctaaacctagggcaaataaattaacggttctaggcgtgacataaatccaacaaaagattttgttcaaacatcaaattcgacctggttcatggaagatttaacacatgcatacacgtacagtttacgttaaaaacctggtagtgcaaataaaagcgtagctagaaagtatttgcatctgagaaggaaaaatagtaggtatttgtatgcatattacatctctgtaaaaatgagaatctttcagtgcttgtgcaagctctatgaactttatctgttcttttttttcgtcatgcgttctatactactaatgtaaagatcatttcaccgttattcagagt

SEQ ID NO: 31754 - DNA, 1501 bp, Oryza sativa
gatttgctattggctaggaaatattggtgcatgcattgagtttgttgctagagtaaatatagtatgagagagttattagcttttcttggtctttgtgtacctatgaaatatgtagatcaatttggaatggagggagtagtagagataagcatacaaagttttcgccacaacacgtagtgtttcatctagttttcatacagtatcagctaccccattgttaacgaccaaatttggtaagatcgacatcgaggaggaagattagatcgaagtggaatccaagacgaagattatttcagaaacagagcaagaatcggctagagtccaaatcggttatgttcagatcgactgagttcgagttagataaggatagccgatgcagccgattctgacaatatgactcggtatacgtcatcgagttaagttggtgtgctttacggtgattgctacgtaaggatagagtcctaaggaggcgattgtatctattaattaggatattttatgtaatttccttagagatatgtttgggcaaaagtctgccgtaaagacttatgatatcttagagtttgttagagataatagtcgtgtccggtatggacatatcttgtaattctcgagtataaatagatcccgagccctatgtaataattaacacacacgttcaatacaattcggcgcatcgccacctttttttgctttagttttatttcaacgagttcttgcttttgggttgagctgcatcggtttcgatcttcaacaagaggtaaaacttgttatggcggcttgcgttctcgggattagtgcttccatctttatgacactctaatcttgtttatgtaatctgttgagttatcatatattttatataatctctaacaatatcgttatctaacctacaatcgaccagcatctgtcggtagattgcagctgatcaggttagatattgacgtttatttagattatataggatatctaccactctataaaacttccagtggcttgattgtctagatgttgttcttcttttcatacttaatgttgtatcagttgagtttgatctattaagtcgtgcttagaatatcaatttctagcctgccttctggttgccgattagggtagtatcggggtttcagccgatcttacctgatttaactacttttattccatgtgcatgattgacatgttaagtctgccctttacattaagatcttattatatttgagtatattaagcttttgtttgatatattttacttgttttaatatcttaatatagagtggtatcggagtattagccaatacatgctagatctatctgatcggctatgctatgaacatatatagttctattattaacatatatttcgatctaagtgatttatactttctcggcatggcgtccgatctatcccaatcacttgatttaagtatatgtcaatatagggagtatatattgttaatatctacagccgatcgagtagatttagtttttccttatttattca

SEQ ID NO: 31755 - DNA, 1493 bp, Oryza sativa
gaggaatcttaaatttccagattctcttttaaggaaaagacacctgatgcattttaagggctttataaaacgatttcacagaaaagataccatcccttgtcaaattccaacaaattttgtcttcagagtcatcctataagatcagactttccaaactatttttgattctcacccaatctctcattttatctccatccagatcccttctgaatttgatacattgcaagcctttcattttcacctttgcaattgtcacatgtttggtcaaagttatgttatacagatttgggaactgaatgttaaggggttttccacctatccagctatcttcccaaaacaaagttcttttcccatttcccacttttttgaacaaaatttaaaaaaaatcatcctttacttccatcaacccatgccagaaatgagaattaccctgtttaaaagttaccccagacaaggtgaagcatctaggcccccggtgttaattttggtaattaatgacaagtgctaattgtggactaaccattcttttgagctatattttaagttagattgacatcatgtgtgtgcatggatgattattgatggattaaaattgacggcgcaaagcaaaaggaagagaagacgataaactagtgttttcattttgaattgatcgaggcgtggggcgatcaaaattgtgctagtttatttttagcttcgccatactattaagaggggtaatgacctatcaaagggatgattttaattgccaaattaggtcatttgcatttagacttgtgctcacatttcacaacatgcacttgctatatatttgtcactgctctggactgccagggccggtctgaccgccggacagattccggtctgaccggccggtgtcaccagtctgaccgccatgtcatggccggtctgaccgccgtatcaatgccggtctgaccggaaggtgttggccggtctgaccggccggccatatggccgggatggcatgctctaggatggccgatcccgagccgccggagccgtattcggtcagaccgagctgaggacggtctgaccgagccgaggccggtctaaccgggcaccccatgtcggtctaaccggccgaggcagtggggcccaatgacagccctacaacggctagaaaactagccgttgtagagtagcacggtctgatcgggcacatacctccggtcaaaccgacagagcactgagttgggggatttcgcccccaacagctagttttggtgggtgggagtataaatactcccccaccagcagcaaggggactctcttggcacccaattcaattgcatacaccccttgtacctctctcacacacctttgagcttagtgttcatccattgtagtgattgaggttgttctagccaagagtcaagtgcattgcttccatttgtagagctagtgtggcacttgattaatcatctccacgccgggtcattgcttgttactcttggaggttgccgcctcctaga

SEQ ID NO: 31756 - DNA, 1501 bp, Oryza sativa
aacccttggaccctcgcttctgcggccggtgccagcgccgccgccgccacgacggcgaaggcgaagaagagggcggcgagcttggacgacggcgccattctgtctcgtcggcgagagatcggtggtgggtggtgagattggtgttgcggctttggctgattgttgtgcagagcaacgtgggatcgctcgcaatttatagcgttagaatgtagagatttggagtttgaatgttcgtgtaataagattggactctggattaatttcttgtacgtaaaagcagattttagtttgaacgttcatgtaacgagattgaactctcgactgattttcgtacgtgattaagagatatctaatgaacttattacgggtgcaaagtgtatgatgttttctcatctgtgctttcgtttaacgttaaggatgcaatagagaacatcatgatacagcctgcaatcctgacgatctcaaactacatgggtgaaatttttcaaattttcagatataagttgacagaatttgtaagtttgcagttgttttcatacacacaggaggagaggagaacgccattgttacggcacatggagtctgaagctaatacttcgtcctgatacttatctgaattctggattacgctggctgaacaatttttgcgagtccaaccagtgtgaagctgtctcttttgttttgattgcctcgaagagataatataagctcgtagtagtaataattcttaatttctggtgatattgaggacatataactcttttttttcagataaaccgcagagtattcctttgttttacctcaaaaaagaaaagtatgtcgttgtccagagttaaaacttcaatttgtaattatcagaactatactgaagatacgggactctgcagtcctgaacaaataaatgccgtctcgtcatttggatatatcatatatgcatagttacggcaattgcgtgatgaagtctggagctgatacttctgtttgtaataaaccagagatttaaaccaaacacaagaattttgatgagtccaatcagtgtgaagttctatctctgggttcgcttgtcttccagatcacacagcttctagctattctgaatttagattgatattgaaaacacagaattcttcatatttttagataaaccggagtactatttcttttatgggaacagagagttttttttctatgttttcctccagcattggtcttccagaatgtttgggttaatgagaagcctaccaaagcaaagcgtttgtcgatcatttattttatagattctggagagtcccgtttatctgtttgaatcttttcttccggacatcacagatcttcaaaagttcagaatagatttggcttcgaattttaggatttcactacagcttgcaagctgcaagcaacaggggcatcaatctggcaagcaacaacagggcatcaacacgcatagcggttcaatagattacgtaactcgacacaggcagcacacagtaaaacatatact

SEQ ID NO: 31757 - DNA, 1501 bp, Oryza sativa
catatccatttccccaacaaggccttattcataatgtctaggtccagaacacctagaccccccgatctcttggtgagcagatgatgggccattgcactaaatgatattttctgatgccttggtcttcttgccaaagaaacctcctaaagaaatccattttttctttcacccctttgggtaacttgaaaaaggagatcatatacatgggaacactgcttaaactagaattgatcaagattaatctccccttattgactgaagtttcccttgccagcatcccagtttgctttccattttgttttcagcatttctccaatctttctttgtaatgcgtttctgatctattgggatccccaaatatttcatgggcaaagcacccacactgcaagtaaatatctgactgaaaacctctgccttatcagcagtctcaccaatgcagaacacctcacttttattgaagttgattttgagaccagataattgctcaaacaaacataagatgtattttagatttttttgcatgtcttattatcaaatagaagaaatatggtatcatcagcgtattgtaaaatgaccatcttgttgttatcattatcccccagtactcctatcagcagattatcctcagctctttacactagtaaagttagtacttcagctgccaaattgaataaaagaggagatagaggatctccctgcctcaaacctttatgtgttttaaagtaaggccccactctatgtgttttaaagtaaggccccacttgatcatttacctagacatcaactttactacccattatcactttctttacccaatctgaaaatgtaccgcgcatggtaactatgataaccacgtgataaacgcatggctgacgacgagattatatccacgtgagaggatgatggttcagatctaatcgatcacaaacaatgaaacaaatattgaatcagcgaatcagagtggtcaggaaaatgtaacggaaatatcgattcacgctcactcactcaagtaggtgagcagtgagctgagtcagcggtcgatggatcttcgaggacgcggttgttagtttggtcaatgagtttgaggctgtgtttagatccaaactttacatctaaacttttaactttttttatcacattaatttatcatacacatataactttttagtcacatcgtatcaatttcaacttaaacttttaactttgaaagaaactaaacacagtctaagcttcactgtgtaatgccagtccactacgcgtcaaagtgtagtgggctttcagccttgaagggctaatttcaatgggcccgggattccgtctatacaaggcctcgtctggttttgccacgtaagcgaatcacgagttttttttatttataattttttttattaaaagttttacaaaaataattttccattttgaaaattgacggaaatagtcgcctaccgccctctgggagggcgatttttagagggcggcgtaaatgacgtggcagccggcc

SEQ ID NO: 31758 - DNA, 1501 bp, Oryza sativa
cctttggctgcggcggcgatggcggcgccggtgccgccggcgaggcgggtgatgcttgagacggtggcgagaccggcgagctggggaacgggaacgggaacgccgggaagccggacccagacgacggcggagcgccgcccggcgaggcgggcgcagggaacggcagcgggagcgggaacgggaaccggaagccagagccagccgaaggcggagcggcgccgccgccgccagaagagccgccgatggggatcagcgggaacgggagcgtgaggaacgggaagagcgggaacggcaagccgggtaatcccggcaatgtcggcgctcctcctccggtggcagctttggactccccggctgcggcaatggcaggctcggacgccgcttcatggttgaacccttggaccctcgcttctgcggccggtgccagcgccgccgccgccacgacggcgaaggcgaagaagagggcggcgagcttggacgacggcgccattctgtctcgtcggcgagagatcggtggtgggtggtgagattggtgttgcggctttggctgattgttgtgcagagcaacgtgggatcgctcgcaatttatagcgttagaatgtagagatttggagtttgaatgttcgtgtaataagattggactctggattaatttcttgtacgtaaaagcagattttagtttgaacgttcatgtaacgagattgaactctcgactgattttcgtacgtgattaagagatatctaatgaacttattacgggtgcaaagtgtatgatgttttctcatctgtgctttcgtttaacgttaaggatgcaatagagaacatcatgatacagcctgcaatcctgacgatctcaaactacatgggtgaaatttttcaaattttcagatataagttgacagaatttgtaagtttgcagttgttttcatacacacaggaggagaggagaacgccattgttacggcacatggagtctgaagctaatacttcgtcctgatacttatctgaattctggattacgctggctgaacaatttttgcgagtccaaccagtgtgaagctgtctcttttgttttgattgcctcgaagagataatataagctcgtagtagtaataattcttaatttctggtgatattgaggacatataactcttttttttcagataaaccgcagagtattcctttgttttacctcaaaaaagaaaagtatgtcgttgtccagagttaaaacttcaatttgtaattatcagaactatactgaagatacgggactctgcagtcctgaacaaataaatgccgtctcgtcatttggatatatcatatatgcatagttacggcaattgcgtgatgaagtctggagctgatacttctgtttgtaataaaccagagatttaaaccaaacacaagaattttgatgagtccaatcagtgtgaagttctatctctgggttcgcttgtcttccagatcacacagcttctagctattctgaatttagattgat

SEQ ID NO: 31759 - DNA, 1501 bp, Oryza sativa
ttcaaaactacttgcgaaaagctaaggtttcttttgttttctttattttcaatagtttgtttctaaaatggttactgatctttctccctccttcaaaattgtagatggcagtgaacgccagcttcagttcccacggttttggtgagggtcaccacgtcgcccagcttcgtgacctcgcccgtttccttggcttctcttgtcccgagtacacggggtactccgtggaccgtgttccccctcactgtgagctctctgtatacctttacccccgtggaggtatacacggagctggccttcgcccacaccacttcaccgtggccaggcccactcaccagatcgcgtaccaggacctctcctggactgcgcttcgtcgcctggcccacgactacagccaccgactcggaggctccgccttccgacagcttccacgccttccttctggccactcagacgccaggtacccttgcccgtacagcgagtctcagccagtgctaactcgcatggtcgagctttcggaggctcaggccactcagcacgacctactccttgaggcttactgctcccttgcccgccgctacgccgctttggaggcccgtctggccgaggagggtgtcacctcagttgacactatctcttgggactcaggccgcctctgccacgccagccacctgtcctcccacagctcccgcggctctgcccgcactcccagtggcccgtgctcccccagctcgcgtgcgccgtactcaccagtgtactccccctacccacacccagttagcccttcctacacccccagacacaccccagttgcttcttccagccgtggcccacgctttatccgcactgcgcggaagcgtattgttggttcttccaccgtgttccgtttccgccacccagctcccccaccgccagcggcccgtgctgctgccggccctcgacaggttccgccggtcccttcgcgccagccgatcgacgtttcttcgactgaggagccgactacagggggcagccaggccgacgaggagtagaggaggcagtcttcagcagctgtccgtgtgttaggcccttttgttccgccgccaactcttttggagtcgtggcgaggtagcgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgcccttttctgggagtttagatggctagccgcccccgccgtgcagctcgtgcaccagcccgccttggttttgaagatggtagagttgagccagaagcaaatcattaatcagctaatgagcagtctcaccgcagcaaccgttcgcatcgtactgcttcccgtaacgccgaagtcgagc

SEQ ID NO: 31760 - DNA, 1501 bp, Oryza sativa
gaatttagaggacacaagtggactagagaccggcaagcacttcactctaaaattaatttgtttcacactgtttagctcattgagttttggtagattttcaaggtttcttttgcatttattactatatgtttaagcaggacatgtaatttcttttgactatgaatcctggagccaaaatggccaatctgatcagctcatgccgtgccaactgagcacccacgttgcatcaccgcttactgaacggtatcctaggacttgctaacggccatgcgtggttggatcatgccattatgcggtgacaaatgaacaaaaccctgccgcatttcagtgccggttgtcgatcaatcaggccatagcttagcccattggcacgaactgaactgttaccgatcagctcaaactttttttaatccccatagcccagtattattactgtattttgttcaaagattagaccagagtgtgcattgtacgcagtgccaaagattctcctaagccgcagacccatttacgatccgttcgtccgtttctggtccccttggaagtagcaaaacgtctcaagactgaagagtgagcccatgtcactggcatagtccatgcataagaccaaagagcaatttcagaggccagccagtcccaattgtttttacctaccagtttactccaagataatgccggcctctagctagctgcatgtgccaatgagacccgttcagtttgaactttgcatccatggagacagtaatactctctggccagctgaaggtagaagaagaagaaggcaatgatgaggaatgaatgacattagcagttacagacttacagttagcagtgcacagtcattgcagtattcaggttcttccccctgttcatcttgtagataatttctttcttgaatatacagtgattagtactatctgctttagttttggatcctttttctctagatggaatcatggaatgtgtgttgcgtgtcttgttaaaaatggagtggtttgattggcagcaatcggattgtccggcgaggaaggggagtcgccggagaagggggagatgccgacggtgtgggcggcgctcaagaagtcgctcaactgcaaatcgggggattcttgcggcgtgatcgagcgggaggaatctcagggcggcgtcacagccggcaagaagtcgtcgtcgacgtcggcggcggcgctgcgcaggtcggggtgctcgcggtccatcgccaacctgagggacgtgttccacagccagtacggtggcagccggaggcaggaggacgccgtcgccgccgccgccgccggcgaaggcgatgggggatgcggtagcccgaggtcgatagggagcaacgacgtgctgaacccggtgacccacgacgtgctgctcgccgccaggtcggacgcgaagtgcgagctccggatcagcacccccggccgcggcgcgtgggccggcgccggcggcggggtgccgttcccgcacagcccgctcctgctgcggtgcagcacca

SEQ ID NO: 31761 - DNA, 1501 bp, Oryza sativa
catgaaactttggcagccaaagtactataagaaaaggataatatatgggcgataaaacagtacaacaaaatgatatcacacaaactgatggaattattacgctctagttttgtatataaatgactctagtgctgatatcacatgaccaggtgcaggctgtagagtatatttcttccaacaagtagccagagatagaaaccaggtcatcagtgtttatcttacagggcagctcttgtcagatgttaccatggttggtattcttctaatcattttctcttactactagctcagttccacaacatttccaaaagtttctgcagaaagcacacagcgcagatggaattgatatctctttcacttcgctgtacaaccagcatcccgcactgtctgtcatattccccacatatgcagcccatcctctcaggatttataaacgaaatccaacataaacagatgaaacgatgtatactcctattttaaaaagaatgctctttcttggggccatggtaggacaccatgaatcttctcaaaatatgaatatcccccaaacttttcaaactgatagcagatcacactcaacccagtttcactccgtctgaataatttcctagaaaacaatcggcacaatctgtccacaatagaacatcggcggagacagtaattccattgcagaagaacagatttagagccacctagctgcggatcgagagcacacggcaaccgccgagaagcagaaaagcagatgggaaggggagagcgagacggggaaggggaggagggagagggggtgcgcgcataccaggtccaccgcgaggcgggaacggggaacgaggcggcgggccacggagctcggcgtcgccgtgggcgaagctgcaggaggcgcggttgcactcgccttgcctccacagcgcgcacagcttcgtcttgtacgccgggccgcggcggggaggacccatcatctccctcatctctctttcaccaacccaacccttctcccgcggcggcggcggcggcggcgaggaggaggaggagacgagacgtggcggcggccagtggggagacgagaagagcaaagcacgagtgccgcacggcgagttcgggagacgggacgacgacgacgacgacgacgaaatgggcctcatagcaaagtccggcccatgtggcccggcaaatcaggcccatgttctctgcgcaccattagcggcccaaccaaacaagcccaaaccaatgataatattccttccgtaccaaattataggtggtctttttttttttacacaatcttcaattgcatacttgaaccattaatttattctatgctatattcccgatgaatgcttcaaaatatgaatctagtaagataacgtgtataatatttagcactgttaatacgacgattaggggcaattgttattagtcaaacatttaccgagttatttttttcttgtaaaagaacaccctataaactgtgacaaggagtaataagtttccgggcaggagt

SEQ ID NO: 31762 - DNA, 395 bp, Oryza sativa
attaatgacctctaagcatgccattagatagatctcgagatttggggaattttggaagttgaacggagtcaaacggatttacggctgggaagatattgaatttccaagattatcggatttttggtctaaaggaaaaaggattaaattaaattctttttggaaaagaaaaagaaaagaaaagagggagggaacatagacttttctcgggcggctagggcgcggcccaagagatttggggcggctcgaccgagcttaacgggccggccggcccaagacggcccaagcgcgcgcgcgcgcgggagggaggagagagagtccggtggaccgggctcaccacgcgcggtcccgggtgggacccgcttgtcagcggctcggctcaccgtgcagagggagta

SEQ ID NO: 31763 - DNA, 1501 bp, Oryza sativa
caaactacatgggtgaaatttttcaaattttcagatataagttgacagaatttgtaagtttgcagttgttttcatacacacaggaggagaggagaacgccattgttacggcacatggagtctgaagctaatacttcgtcctgatacttatctgaattctggattacgctggctgaacaatttttgcgagtccaaccagtgtgaagctgtctcttttgttttgattgcctcgaagagataatataagctcgtagtagtaataattcttaatttctggtgatattgaggacatataactcttttttttcagataaaccgcagagtattcctttgttttacctcaaaaaagaaaagtatgtcgttgtccagagttaaaacttcaatttgtaattatcagaactatactgaagatacgggactctgcagtcctgaacaaataaatgccgtctcgtcatttggatatatcatatatgcatagttacggcaattgcgtgatgaagtctggagctgatacttctgtttgtaataaaccagagatttaaaccaaacacaagaattttgatgagtccaatcagtgtgaagttctatctctgggttcgcttgtcttccagatcacacagcttctagctattctgaatttagattgatattgaaaacacagaattcttcatatttttagataaaccggagtactatttcttttatgggaacagagagttttttttctatgttttcctccagcattggtcttccagaatgtttgggttaatgagaagcctaccaaagcaaagcgtttgtcgatcatttattttatagattctggagagtcccgtttatctgtttgaatcttttcttccggacatcacagatcttcaaaagttcagaatagatttggcttcgaattttaggatttcactacagcttgcaagctgcaagcaacaggggcatcaatctggcaagcaacaacagggcatcaacacgcatagcggttcaatagattacgtaactcgacacaggcagcacacagtaaaacatatactagcataaaaacctgagataatatagcatcagcactggcaatctggcacaagtcaaacagcctcaaaatcatagtacatctcaagagataagagataacaacgcattacaggagcaacagctgccaagtgccaagtcggcggctaggaagagaggacaaagcattactggagcaacagttgccaagtcggcgcagcagcaactttttcagccgtagccaagccaccatcagcaatatacaagctaaagaagaacagtgagcacatcagccatagccaagcaatctgcaatcagaagggtttgatctgcaatcaaagagaaaactatgtgccaaaccggtagcaatacaaatgtgtacagtacacagtcagaacaagagcataatttagacaaatttgtttgtcagatcaaatttttaagcaaaacataagaaacagcacaaaagggtatagcagaagcaaaat

SEQ ID NO: 31764 - DNA, 1381 bp, Oryza sativa
tgtgtgttgcttgtgttgtgtttgtgttggttttgcaagtgatttgtgttggtggataggaggtgagcaaggggtgcttaaatagaggttgtatgagagagcaaggaagaagagagagaaagcgattgagagagtgtgtgtgatgatggaagagagagaatcatcataagcatacttagcgtaggaaaaaaaaagggtaatcaatgatattagaagatatatagaatctaactcccttttttgaatcaggcatgttagttaactaatctagctcgagctctggttttggttctggttctgggctcggcgaaatcacgagagaattttcgaactgattttgtggccttaattaattaagtaatttttttttctcgttggcttgatgagagagaaattaagattctaattagtgatgaggcataaacacatgcggtgatgccctaggcacgtacaccagcagcccactgtttggggttagggggttagattccccagccctcatgggtttgaagctacacatttttgtatatattgagattccaactctttgctgcagttaagcgagcatgatgtgtgttaaactaccttgttaattggaggtttggtcaataagggtaactaactaagcatgaatgctcatggcgttggttaatttgttattcaccccctgtcacaatgtcacctgcgtatattccgagcaataaatgcatggttgttgttaccgttgtactctatttatcgatgatattccctgctgagaaattgtgctaaaatgataaattaatggagctgaaaatgtcttctcaatgcaagtaattactacttaagaatgagtagtttcataagagcaagtttaatagtatagcccactattggctccaattcatttataaccaatctaatagccaattcatacaatagttacttactataatattaatatatggtctcacctgacatacacacattgcgtcttgaagtccgtgctgcagctggctacagatctgtagcccgctgcttttctctctcatcatttatctcattaaaatatgtttatagctgattaatagcctgctattgtacctgctctaatcatgatatgaaagtgagtttcagggagttggcaacaggttatatggacatttggaggtgcatacacctctgtgcactactatttttactcttacagaatatatgtggattaccatatattttttaagctactaaacggtataatttttataaaattaaatatctatttaagtctttaagattactttatttaaaaaaaacttttgaaaatgaaagtcttacacataagtttgcttagttcttatcacaaatgaaaatgagtggtaaaatgcaaattaagaatgagaaa

SEQ ID NO: 31765 - DNA, 1192 bp, Oryza sativa
  unsure (1)..(1192): unsure at all n locations
ccagaagttattcacccggccgtgggccacaaaagaaaagggcgtaaacagggtccctttgagncccaatcacaaaaaattctccacatgggcgcagggtttttccctcttatggcacctctaaaggggggagcacttgggagttggattttttgggacaacggtacccataacgttgaaaagcctccttgggcgacatatcaaaagcctcctctggtggcctccgtcgccgggaagttggagccttctaacaaagtgcttttgtctcactccaaacaaagcttctaaggggccacaagcgcacaaagaagctaaggcttctcggacgcgttggtaccaaaactcataccggcagctcctcctggtggctccacactgnagagttaggctccgncaagcgcggaactttcctaaagaggacgttttcacttccttgcacacntcttcctggaagcggtggcancaatgagtttgggcttccacgagattgattcctctaaacaagcgcgattcataaaatcagataaagggattagggtagaggaagatgaaatgggaagaaaggcatcggtgcacaagctccgcccggatggttgatatgaagcattttcgaaaggaaagaggagggaaggggaaggaaaagagggaaagaggccaaataccaaaagaatatatttttttaatgcactgaaggattaattagtggcttatattaaatagttataaaattataatatcatctttataaatcgatgaattgcaatggcatattttattttcaatgacaatatatttacatggtacttaattagggtaatattaatccgggactattgtatgtggtgccacatttttcaataataaaaaaaattcaaatcttatatcgtaaattccatatattaatactataatttgaaatcttagaacattaatatacatttttcatgctcatgaattaggaaagaaattaattatatattcgattaaaaaacatattagttgaatgaaagtataaaaaagaaagtataaaaaagttaggaaaggtatcccatatccctgcgtaatttgtgcctaagaagaaaagattgaggaaatcccccgtccgctcgccgtggactccgactcctcgcgagttcgccgccatcgccgatccccatccatcccgcgagtagagcagagcagcgccgcagtc

SEQ ID NO: 31766 - DNA, 1501 bp, Oryza sativa
tttgcaaatcaagaaaaaaatggatacgtacgggatatgtatcagagtgtatccttatatgtatatgtattcgtcggtgtatcagatactgatacgtgacatgtgtgtcatatcggggtaacgtagggtgtggagccccgatttaattaaacactactaaaattcttttggagaggttcaattattcaatattttataacttataaaatgcacaattacatccctaaacttgctaaatatatcatcgttggggcataggcgcatagcgcgcgcacactgacgtgacatacatatataatatggacaaacttctaatccaaatttgcagtactccctccgtccataatataagggattttggagggatgcctaagtgtcatatccctccaaaatctcttatattatggaacggagtattaggattctcattcaaccatttatattttaggatggagagagtggtgattaagtggagcccacctatcattttctatttttcttttgttttctctctctactatttccttcctccctcaagtaaatcgttgatggtgttctgcaatggttttggcaccttggcactgcaagtctgcgacagtatgactagggacatttaactttttatcgcttttaagatgtggcaattaattatttgtcattcgctgtctatgacatatgagccctcatgtgtttatgacatgtgggtccagtgataattcctatatcaccacttgtaagagtggcaaataattaattattcccacgagtggcaaataattaattattccctatgactaatgggtgttcgagttatatactagatccgctcgccttgtccatcaccaccgatgatgtgccatctctgacttcacaccatgaggaggaagagaaaggatgagtgagagttgagaagaaaaataaaatgaaaaaagagaaataaaaagaaatagaaaaaagtgggtaggaaagatacattgtttatggatgtaaatatacatttgacaagtttatggaaccattacccagtataaaacctcttacaagtttaataaccaatttggtttcgagaaacatagtacaaacgcaggtgctcacaacgcgcgtacccttgtctctatgaacgtccttgtattttgctcatgatttaattagttgagagttatagaaaatcaaagatttgtacaacatctacaagaaaaaaatatatttagacatagtctgacaaaaaacaaatcttattatacaattactatgcggagtagtaccatttcagaaaaaaaaagaaaaaaagaaaaggaagaaatgctagcacaaatctcgatgcacgacgaacgatgtaagatgcgtagcctttcctcctccctgtctttcatttcaaagtagacaaggcgaggaaaaaaaaattcctccttttccccgtcttcccatcgctcgccggcgaccgccatgaactccggcgagcctcctgcctcgtcctccctcggcaatgccggagaggagg

SEQ ID NO: 31767 - DNA, 235 bp, Oryza sativa
  unsure (1)..(235): unsure at all n locations
gcgcgctggaataagtacctcgtactcgcaccnngcnnantttagagtatncccagagcagcacatgtggatatttttaatggtcaatctcaattttagaatttattagagaattgaaccaactaaatcggagcttagatgtgttacttatgaagtttgggagaggaatcggattaaaacacttaaatcggtttaaattgaattatgacgcaataatgaattatttttgaaaagg

SEQ ID NO: 31768 - DNA, 1501 bp, Oryza sativa
ttgaccctaggttataccaaatggttacccaaagaagccctctgaaaaatattggaaaagtagaactgttctcctccctttctcttttaattaaccaaactaatggcacatgcacttcataattttttttttaatggttttcattaaaaatttattccagtgttattagtactgtacatctattactgtactaatggctcatttatcagcaaaagttttacaatactgttttatttaatcttgctgcaataaaataaatttagtatgttgattttataatttcctttcatctcttttgaaaccagttattcaaaattacaaaatttgtgacctcgtttccaaatgttttaatttattttgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggatttgggactgcccctttttatacccagattcctcatgatcgtcatgaagagaagtgccgagtcaaagtcaccttgaacagcaatagtgaagatattccctcagtgatgttcgaagctggaggaagaaactacatccatgcatgtcaggaggtggcaaggatcgccataggagagctccgtgatcgctacagtgatcaattggccgacactgagtatcgttaccatcctcgccaaccccagggaagtgaccgtggcagttatcttgagactgaaggaattgagaattatgttaccacaagacatttggttgagatgttgtgggctatggatgaaagtcgtgcggagactgtgttagcagctcaagatcgtgaagaccggaatcatggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcttaagtagtgatgaagaagaagaatctaagcgcaacaattccaagattgagtgggtagcaacccaagatgatgaagacgagccttcaatcgacctccgatgcttggaagaactagagtgacttgttaagtcgttgtcatagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaag

SEQ ID NO: 31769 - DNA, 1501 bp, Oryza sativa
ttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatacaaccatattatgccatcctttgttatcctgtgcacttgcatatttgctgcgtggcttgctgagtatgtcatatactcaccttgcaatcattcatcagaagaagagttctacaatgaggctgatggtgtggaggattaggtgtagccttggtcaagctacctgtggagtggagccgtctgcgccgtttatttaatttccgctgcttagaactttattgattgagaagaactatctacctctgtaatgacattttattcgcttattaattagagtattatttgtactctattatcaatttgttattgtgtgcctcggctgattcctggacgagggttcacacacatgttagcgtttggaattttggatagaaattccgggcgtgacaagttggtatcagagcccctttgaccctaggttataccaaatggttacccaaagaagccctctgaaaaatattggaaaagtagaactgttctcctccctttctcttttaattaaccaaactaatggcacatgcacttcataattttttttttaatggttttcattaaaaatttattccagtgttattagtactgtacatctattactgtactaatggctcatttatcagcaaaagttttacaatactgttttatttaatcttgctgcaataaaataaatttagtatgttgattttataatttcctttcatctcttttgaaaccagttattcaaaattacaaaatttgtgacctcgtttccaaatgttttaatttattttgcaaagcttggtttactttatttacttccctttttactttgattttctaactttattcaaattaatccaaaaacttgtgctattaattggataaaggtcttaactccctcctttcacttgtctttaga

SEQ ID NO: 31770 - DNA, 963 bp, Oryza sativa
cgcgacggcttcaagacgcacacgccgagcgccggcatctgacgatggataatgagctcgcaagaaaaaaaaacagcaagggatagcaacaacctaaccctcagtagtgccctaccaccaacgaaatcaaccaaaaaaatttcatcaaccaactgccacacgcacttattatccccttctagaacaaccctaaacctaaagcatgccaagatggagtggggaggagggagggaggaagggagggagggggagggacgcaccacggggctgcgatctcacggatcagcaccgcctatctgcgacgatcatcacctggattctccgccgtcggaagggagagaggagatgatgagaggacttgtgagggagaagagtccaacgcatggaggagaatacgacgtgtgattaatctcctgggttctctttctccacgttagatccaacctagtaagcaaaaccacctaatccatgtgccacatcagcaaagcggattgtattagattagaaaggtgaatagtgatccggttttaagaacctagggggttaagtaaaccaaattaaaggttagggggttatttgctccagggtcatacttgaggggagtaaaactgactttttccttttaataatttgagagttcagagaaaaatgttgtccaattttagagttgagggacaaaaattaagccaagttgctcttataaaaatttgttggtgtatgtgggaaaaaaaacaagtatcttttttcttgagaaagtagccaagccaagagttgagagaaaggaacagtacgcctattccatgtgcataagatatatgtatcgttgttatatctctttgtttcttgggagaacacataataactgccataaattaaagttagtatcattatgtgtttgatttctttgcactatttttcaggatgttatctgatgattctgatcagaactgcaccgtgccactt

SEQ ID NO: 31771 - DNA, 1501 bp, Oryza sativa
ctgagttttgctatatgaaaaaaaaaagttcaatcaaatatgaaaaataagtctaatgcaaacgcttggacaatatttacttggctagtttagcttgtgataaccatacagcaccgataacaaattgatttgattaagtacgtgtgcacattaggatggtttttgcaacaaattaagtaggggtgggtatttgcaacaagatgatttatggggtgaaatgttaaacttcaagtgatttatggggtggtttttgtaatttttccattacgtaataacgaaattaatcaaatatcaaatgaggtattgcacacgtgggaaagggttgggagtttaaaactcgaggatttcttatgaccgttggcacgtgcagggtgcggcgagcatctctgagcctaaggctatgttcgagaggaggtgttaggaaaattgggaaagaacacagttgaacgtcggtgatggccgccggctgggtgcacacagatcgacgacgttgctttacgttctcgtctggtttgggccatggcgactggcctgcacgtacgccacggtgatcatgccgctgcaggggtatatagaagtatatatcttctcccgtggtggccacccgcgtggtcaccgccacgcctgcatatatatataggccgatcgacgaaggacacgaatacaacgatgacctcaagtttaattgttcaggaacttaattacttgccgtgtccatgcatgaatccatatatggtaaagaactagctagagaagctagggcgccatcggcgcggcttacgtgctcgccggcacgattgtctcgtaaagtaattaatgttcgttcgttcaccgtaccgttggggttgattcggtttcggcccatgatgtcaacctacaccggcgagatcatacggttgcgaaacagggccgggctgtcatgcgagcgggcgtggcaagaacgccgtactcttatcagtcgggggcagctaatgcgcgaccagactggtcgcgcggtccgcacctgctgctgctgctaattaccactagtagtactactatactattactactactagtatctactactactattactactagtacctactattagtatactgctggtactactataaaaaaaatatatttttatatgtataaaaatatatatacatacgcgtataccaagtttatatatatatatatatatatatatatatatgatatatcaaaagtttgtatacgtcgtatacaaagtttgtatatgtcgtattaaaaacaaaaaaaaacccccccaaaaaaaatttaaaaaccccctttaaaaaagggggaaacaaacaaaaaaaataaaaaaattaatttttcccaaaacccggttaaattaaccaaaaaactttgcatacgcacatcttaaaaataaggagaaaaaagagaaactggaaaaaaactaaaacagaaagagaaaactgaaaaggtgtatacaaagttagtatacgtacgtataaaacctaaaaaatac

SEQ ID NO: 31772 - DNA, 591 bp, Oryza sativa
tgcgcctcgatactcgagcactctgtgcgagtatcgacggtcgccttcaaacttaaaatctgagtaacaacttgggtaaaactggagttttacaaaagacttggaaaacccgacacttgggtcggtgcttgcgaaccaaatgaatttccaaaaccgcggaccggggaacgtaccgggtgtacggtttcccgctcttgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtca

SEQ ID NO: 31773 - DNA, 1501 bp, Oryza sativa
gctccgctcccacaggcggctcaactggggtataagccaaacgtcttctccttctggatcctttttcttcaactgaggtttgattgattattgcaaggtgagcatataacatactcaacaagccacacagcaaatatgcaagtgcacaaggataccaaaaaatggcataatatagggctcatttgcaaaaacagcatttagcaaacatttgagaattgtaaaacagtagagtaattaatcatcaattttaatcaacaccgaacaacacacccatgctgctcaggcccaaccatcctgaacaaccatacccggctgtacagatctatctccaaaccaggaatgtaccattccaaaccaggagctaatcaaattagcagttatagcattatttattatggtgagaagtgtgggactaatcacaaaagacattgttagacccgcccataaccgcgggcacggctattcgaatagttttactctggccagaggtgtaccactgtatccacaagacacagccccacaacatgtcaccatgcgcctcaataccaccacggtacctcagaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgattaatgttttacaaccgaaactcgtgaaccggtccttaattttcacaagcatgaccatcaaaaccatgtgctcacaacccaccattatcaagttttaattggcaagtaattaattaaccaatcacgattgaccatcgtgagcttccattaaatatccataagtgatagtgaagcatgatttatcccattagtgagctattgtttctaagcatggctaagcatctattttaagcatctagctgaaccaaaccaatatataaggttctagctaatcaaattataacccataggtaaataaagtcatctccggccataattaaatgggaaaggctcaccacccagtgacattcaaaaataaatgcacagttgaaataaatagagaatttaaatataggatcaacatgctcaaaggaattgtgtttgggatctgtgtgacttgccttgcaataattggtcttcaattatcttcttgaactcttctgacacacacgcgaacctttgaaacgacggaaacgacaagctaacacgcaaaacgaggaaaaatactaataaaaaccaaataaacagaacatataaagtaaacaaacatgtagatcatgattttagatgaattatgagacttaaacggcctcattccgatttcgtatgagttaattacgaattttacaagatttaattccaattaaagcctattaaagaaaagactattccaaattaattaaacaatttaca

SEQ ID NO: 31774 - DNA, 1501 bp, Oryza sativa
cttggccagctcttggttctggtcgtccagtttgtcatcaggcctgcatatacatagcaaggaaaacaaaacattacaagtacattaatatattcagctatacaccatatgtacactgtgttactctggcaaggaaatcagaacagtacgagtttcttttgcgagattgcacgtcaattaatgtattagtagaagcagttgaaattaaagtaattcagctccaccatatatatgccttcgtcccaaaaagaaaaatccaatactgagaacatacacgttgtccacaaacatcctgacggacttttacggtacaatatactgctgcaagtatatatgatctaacggtgtagattgctttaattttttttgttaattagattgtggtataaagtttgaaagggtaattttatcttttcttcgttattctatcatcaaatcgtgctatcgccacgtgcttcatcatcaaatgacgctcaggatgctcctcccctagtgcacgataagatccaggaccgggtactcccaattagattctatctcaaccaaaaattactaaagtattattttattttctatcaaatttctaacatacccttttatatactatcagtatatactggtagcactggtggagaaaccatctttcgtcgatcggccgatttccacaatagtcccggatgcaataaaaaccgtggctaaaaatgatctttagtcccggttcaaaagggtaacgggcatatttgatctttagtcccggtttgtgttaccaaccgggactaaagatcatctttagtcccggttcgaatgctgtcaggtcatgtcaggcccccccgggatcttaccaaccgggactaaagtcgtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagatgggaggtcatgccaaaatttctattgaatttattttggtgattacatacaaatcggagatgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttattttgactcatgtaga

SEQ ID NO: 31775 - DNA, 1501 bp, Oryza sativa
cactagcttcaacaggattagtggtactagagaaaacaggcggcctcacacgaagaaattctgctaacttgttctggggaggtgcatgattattcccttggttttgctgattctgaaattgctgcatcatcatgttcataagctgtgtttgttgagcaagaacttgagcaagagtgggattctctccattgttgttattggggttgttgggaccattcccattgctacgagtgttcaccatctggcatggacagggcacaagaagagaaaacggggaaaactacttaggacagagaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagccacacacaagcaaactttaagcaagcaaactaacacaacgatctatgacaacgacttaacaagtcactctagttcttccaagcatcggaggtcgattgaaggctcgtcttcatcatcttgggttgctacccactcaatcttggaattgttgcgcttagattcttcttcttcatcactacttaagatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccatgattccggtcttcacgatcttgagctgctaacacagtctccgcacgactttcatccatagcccacaacatctcaaccaaatgtcttgtggtaacataattctcaattccttcagtctcaagataactgccacggtcacttccctggggttggcgaggatggtaacgatactcagtgtcggccaattgatcactgtagcgatcacggagctctcctatggcgatccttgccacctcctgacatgcatggatgtagtttcttcctccagcttcgaacatcactgagggaatatcttcactattgctgttcaaggtgactttgactcggcacttctcttcatgacgatcatgaggaatctgggtataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcaaagtaaaaagggaagtaaataaagtaaaccaagctttgcaaaataaattaaaacatttggaaacgaggtcacaaattttgtaattttgaataactggtttcaaaagagatgaaag

SEQ ID NO: 31776 - DNA, 347 bp, Oryza sativa
  unsure (1)..(347): unsure at all n locations
ccgagtgattgccagtgagtaatcacacttactataggcgcgcaattcgagactcggtgacccgcacagaccngctcttttggccttccggctttcgctcggtgcagtgcacctacaagcgaggtggtatgtgcttcactcctcggcgtatgtgagggccaccacccggcagtacaatcacagaccccggccatgcaaggtttttacgggggtccgccttctgcaaaccaacagtttccgatgtcacgaccaacattttagcagccagtgcagaccatgccgcccccttctatggcgggttttggcaatcaagcggcatatgcgactggggggcctcctacaggggg

SEQ ID NO: 31777 - DNA, 326 bp, Oryza sativa
  unsure (1)..(326): unsure at all n locations
cgctgcccttgaanatgaanancgatgacgnacnccgtctgaanannnganttaggaggaattgtgcaggatggtccaggaataagcttatgaagcaacacaacgcaacattactcatctttatcattaaaacttgtgtgcgaccatgcatgtgtatccttcaaccttagaggtgcgggcactggacacaagagtgtgaaacccttatcacataccttcgcttcatcgggaagaacgagcttgcgtgccttctctaatgcctggcaattctccaagcctcgtgacctggccggtagcacctctggtttaacatggcgtagcatatc

SEQ ID NO: 31778 - DNA, 1501 bp, Oryza sativa
tggcacggtctgctgtaaaagaatgttggcatatgtttcgggggggaccttatgtcccggtgggaggcaccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaagaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacgctaaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctagagttgttgcaatggaaggcaaaaaatggggttagtgacaaggcatttggcgatttattgaaactcgtcaagaacattcttccgggggaaacaaattgcccgagacaacgtacgaggctaagaagatagtctgcccgttaggattggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaagg

SEQ ID NO: 31779 - DNA, 397 bp, Oryza sativa
gatgaaacgagtgggatgccttaaagccttttctttttttctttttttctttttagaactcatacattttattaattaaaaacagagtttagaaacatatagcattgagttacagttgcatctccctttggagcattgataatgcctcttttaacagggcacatatccctttggcaaatatgagaaacattagaacagtcaagccaagcgactgctaggttgagcttgtcttgccgattttgccaaatcatctgcaactttgttgagatctctggggatccatttgatgtgaacttcccttccctgcagaaagtttttaattcttgataaagcaggtcctaaagaccagtgaccaggatccgccatgcagtcctcctttttgtgaagcacttgaata

SEQ ID NO: 31780 - DNA, 1501 bp, Oryza sativa
ttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcacttttgcagtcctccctagcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccagtcagcatacatccattgccgatccatctacatgagtcaaaataaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcatctccgatttgtatgtaatcaccaaaataaattcaatagaaattttggcatgacctcccatcttttttgaagaaattttgaagcttgctcgggcagctggaggaggaagaagac

SEQ ID NO: 31781 - DNA, 1501 bp, Oryza sativa
accgttagatcatatatacttgcagcagtatattgtaccgtaaaagtccgtcaggatgtttgtggacaacgtgtatgttctcagtattggatttttctttttgggacgaaggcatatatatggtggagctgaattactttaatttcaactgcttctactaatacattaattgacgtgcaatctcgcaaaagaaactcgtactgttctgatttccttgccagagtaacacagtgtacatatggtgtatagctgaatatattaatgtacttgtaatgttttgttttccttgctatgtatatgcaggcctgatgacaaactggacgaccagaaccaagagctggccaagagcaaggatacaccagctgatgctgatcatgaaccggtggaagcatcgtcgtcttcctcaccaaggtcgtcgtcggtgccatcgcctccagcagctggttccccaccatacattcacccggaggagcctatcctctcctgatgggagcggcaagaagatggctgtgcaacgcctgagctttgtgtgattgaggtctgaatctttttttttcttttgacatttgattgtctgaatcctccgggcttgtttggcacagctacagctccatctctcctggagctgaagcttagataaacagtttcagctccacttaaaataaaaacaaagttgagtggagcgctctcacaaaagctctatagagatgtggagctgggttttgactactccacaactttcacttcaaactcatctcctgaagctaaattttggagttgaacctctagcaaacaggaccggagaatcagagacatgatcattagtattcactagcaacatgtgtataagctactagtacttttttttttagaacagctactagttctagtttgtgcttgccaacgtattagtatccacatcatagatcgatcattaccactttatcatgttctactacagttagtcgtctttactagtactccctccctcagttttttatattataaattatttaactttttattaagtaaaattgtattaaatttgatcaggtttatagaaaaatttaacatctaaaatatcaaattagttacactaaatataacattgaagatattttaataataaaatttgttttgtattgaaaatactaataaattttcctatgaaattgatcacacttaaaaaagtttgactagaaaaaaagtcaaataacttctaatatgaaacggagtgagtacatactaatgagagctaaagagtacaatgaaaacgaatggaagaaaaaaaaagaaatgaatggaagaaagaaaaaaagagaggagctagtgtctggcggtgacaggggaagtttctgaacctcattggttgcccatattttgaaaaaccattctaattttgaaggatccaaaacggaaaaagtcttgtttgacctttataagactagcccaaaaatgtgaatcccccgctttccaataggcttgagataaaggttgtgat

SEQ ID NO: 31782 - DNA, 243 bp, Oryza sativa
cgctgccactatacatcctctatgacccatctgccgcctactttttattgtcattgggactctaaaaatcgaatataactatcgttggaatttaatttttacttatagaagtcccaccaaccatcgacgggtctgccattgtactcctgtacgacccgcccgctgcctctcatttttgttgtcattgagattttaaaaattaaatatgattatcattggggtttattttttttattttctaga

SEQ ID NO: 31783 - DNA, 1501 bp, Oryza sativa
tgacaataaataagggaggcagcgggcgagccataaaggagtacaatggcaaagccaccaacggtttggcgggacttctagaaagtaaaaagttgaactcgaacgataattatgttcgatttttaaaatcccaatgacaattaaagagaaaaaatagtgaacgggccgtagaggagtataatgatagtgtttgacggaacttctataaattataaaaatgaaacccaacgagacaataaactctaaaaactataaactataagatccaatctttaaaggtttcaaaaagaataaatagaaatagtggtagatcgagtaagcaaataaagaacaatatgatagaagtaaggggtaacagctggtgtgactttttaaaactatataattagaaatacggggataataaggtttggttttcaaaatcttaagataaccagatagctatttaataaattttaagcaaaatcatactgaaaagggattgcctacacatttgtcgggtgatttttaacaagaaatcacccagattttttttacacttagatttatatccaacggactataaaataaaataactaatacaaatttgcttattcaatatttttatcaaaattatagtgcacttacatatcatatcaactaaatttacatgtgtaattttagttatatagaactgtaattttatattttaaatacttacatgtcatatcaactgaatttacaaatgtaattttagttatataggactgtaattttatattttaaagaaaataacaaatacatatttacttacactttatttttataaaaattacagtgcacttacatgtcatatcaactgaatttacaaatgtaattttagttctataggactgtaattttatattttaaaaaaaataacaaatacatatttacttacactttagttttatcaaaattacagtgcacttacgtatcatatcaactgaatttacaaatataattttagttagtgtaattacatacaagttgcagtgtaattacactatgagtgtattgtaattacatctgtgaaatttctagaaaaaaatttatcggcaaatatatatataaaaaattgaatagaataggtttctagcgatggtagatttgttaggcatggccgcatggtggtgtaatctagtgtgggatcctagctttggcttggttcagatttatgcacaagattcaagtgcagagaaggtcgtcccgtccggcgatcgtctccactcatcatgcccaaagggacgagcacagtgcgaacaagatcatcccgaccggctgaccacgcatgcagcctccaccatcgtgcggtcagcaaatccgtgaaatcctggagaagatcacactcaatttctcccttaaaaagggcccccggggtaaaaaaaaaaaattttttcacccgggggttaaaaaaacctttttgggaaaaaaaaaaaaaaaataatttaattggaatgtcttggttataaggggtcgctag

SEQ ID NO: 31784 - DNA, 156 bp, Oryza sativa
ggatgccggctcaactacttcccggtctctctccccggtgctggtactgcggaggcggcaacctctcggatggcggcgagttcgggggaacctcctgaccaccctccccctggtccccctcccgacgacgctgccacttcctcccttctcctcagt

SEQ ID NO: 31785 - DNA, 1501 bp, Oryza sativa
gcactaaatgatattttctgatgccttggtcttcttgccaaagaaacctcctaaagaaatccattttttctttcacccctttgggtaacttgaaaaaggagatcatatacatgggaacactgcttaaactagaattgatcaagattaatctccccttattgactgaagtttcccttgccagcatcccagtttgctttccattttgttttcagcatttctccaatctttctttgtaatgcgtttctgatctattgggatccccaaatatttcatgggcaaagcacccacactgcaagtaaatatctgactgaaaacctctgccttatcagcagtctcaccaatgcagaacacctcacttttattgaagttgattttgagaccagataattgctcaaacaaacataagatgtattttagatttttttgcatgtcttattatcaaatagaagaaatatggtatcatcagcgtattgtaaaatgaccatcttgttgttatcattatcccccagtactcctatcagcagattatcctcagctctttacactagtaaagttagtacttcagctgccaaattgaataaaagaggagatagaggatctccctgcctcaaacctttatgtgttttaaagtaaggccccactctatgtgttttaaagtaaggccccacttgatcatttacctagacatcaactttactacccattatcactttctttacccaatctgaaaatgtaccgcgcatggtaactatgataaccacgtgataaacgcatggctgacgacgagattatatccacgtgagaggatgatggttcagatctaatcgatcacaaacaatgaaacaaatattgaatcagcgaatcagagtggtcaggaaaatgtaacggaaatatcgattcacgctcactcactcaagtaggtgagcagtgagctgagtcagcggtcgatggatcttcgaggacgcggttgttagtttggtcaatgagtttgaggctgtgtttagatccaaactttacatctaaacttttaactttttttatcacattaatttatcatacacatataactttttagtcacatcgtatcaatttcaacttaaacttttaactttgaaagaaactaaacacagtctaagcttcactgtgtaatgccagtccactacgcgtcaaagtgtagtgggctttcagccttgaagggctaatttcaatgggcccgggattccgtctatacaaggcctcgtctggttttgccacgtaagcgaatcacgagttttttttatttataattttttttattaaaagttttacaaaaataattttccattttgaaaattgacggaaatagtcgcctaccgccctctgggagggcgatttttagagggcggcgtaaatgacgtggcagccggccgttcgctctcgggcgacggccgtcaacgaaattagcaggcggcccccttgccgccctccgctagggcggttttctactgtgcggggggccgcc

SEQ ID NO: 31786 - DNA, 1501 bp, Oryza sativa
actccctccgtattttaatatatgacgccgttgacttttcgaccaacgtttgaccattcgttttattcaagatttttatgcaaatatgaaaatatttatgtcatgcttaaagaacatttgatgatgaaccaaatcacaataaaataaatgataattacataaattttttgaataaaacgaatggtcaaacgttggacaaaaaagtcaacggtgtcatacattaaaatatggaggtagtataatactctggaggacatggcaaagctgcgctccatatactgaccatgatatgctatcaaggtctgattcagttccaatatatatagagggacggtcgacggagattcagtgcccgtgttggtagcaagaacgtaccaccaccgctgcgcgtcgacgcggcgcggcaggcggcgatccaaaataggggtcgttttatcttgcagttttgagttttgagacgaaattgcaaaaatactatcagtactaaaatctctgatccggagaaattaaattcgtatatggaacatgcaaagctttctcgtttctcgttagggatggatcaaatcactttggcaataaaactcccaataaaactttcgattctgaacagtgaggccgtgggtggggttcggagaagaaaactccaaactcccaaggatatcttgggccgtttgatgcggcccagacgactcacactgtaatatccttggggaatccgagaaaggctgtacggttgggcttgagccggaaagtttactactccctccgtttcagaatgtaagtcattctagcatttctcacattcatatttatgctaataaatctatatgtctagatttattagcatcaatatgaatgtgtgaaatgctagaatgacttacattgtgaaacggagaaagtacaagcaaatgcattgatgtcaaattcaattggtgtgtgactggacatggctaatgaggcatatgcctgtaacgttcttctcttcttcagggagcagggttgcagcttaattggaatcttctgcacatcagcacatccacctcattgtcaaattaaattcgacttcaggtttctcaaagaaacgtagatggaccttagaatatcattacagggcatacgcatatactttattcaagcttattaattattactccctcgctcatgcagatcgtatgaagagcatactgagatacaagatggaggaaacatgaaggactacagtacatagacatgcagaaaagagaaagacaatacagactcgatggtgatcacactacactacaactgaatgattgaatccaatgaagcttaggaacggtaagatatacatgtccaaatctgaatttgatgaagaaactaaactaattaaccgatcacatcaaggagtagtaggggacgagggattaattgttccgtccagcgtatcctgcggggctgtggcgaacgccagaagcgagccggtcgatcgtgtatatatatactaatataaaatatgatagtc

SEQ ID NO: 31787 - DNA, 1501 bp, Oryza sativa
caggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgccggtactgtgtagcatccacttcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaatgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccgagaatcacaaatcccggcggctggtgcacgtagacctcctccttcaagtcgccgtttaggaacgccgacttgacgtccatgtgatggacgccccagccttcctgagcagccagcgcaaggaggagtcgcacagactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgtggcacgccatgccgcgtgtttctcggcctttgcaaaggaccgaggctcaccgtcgtcgcacgcaaggtgcaactgcgcctccaggttgcgaggcaccagtcccggcaccggctggtcgccgagaagatcctccatcgtacggtaccgtagctgctcgccatcatggtacgcgtcgatgcgctcctcgtcgtgggagagcggagtaacgaaccccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgtcggagtcggtggaggctcggggactggggtaggcacgctcggtgagaagagctgcctactcccccagctccctcgaagtggacgtactcgatggtgaagtcgtcgtacgtcggagtcgaaccatcatccaccgcc

SEQ ID NO: 31788 - DNA, 1501 bp, Oryza sativa
tttgttggagaatattatgtatatgctcagtgcttaagtggcaatatgcacgcatgtgcatgatttcagaataaaggacaggagccaatgggttaacgaactacctcgtacttaagatattttcattattgggttttctcagaattggttccattattgttgcaaatgaatttgcattttacgacttgaaagtaatgcctttaaactctattgtcaggtaagaagtggatttggtggttaccatcagcaaatcgctgcacctagtaggttggtaatgtttgtgttaacacattctgtttacattaagattttgaattgtacatagatcgaatcgtattacaacatacctgcaatgttgaaactttgagctatgaattgttataaaaaattgtgctattttaactaatgctatgatgttgcattatttataaatgaagaagcacatttcattcagtttttcattttgtcgtatcatatatgttatatttacacctataaacttacgcagtgtaaacagtaatttttatttctgttgcaatatacaattccatttactaatttcaaattgaatataactatgaaatgtgtggtaaagaactagtaaacactgtggttgcatctttctttgttttgctttgttttccttttgtcacataggttttcaattgaattgagattttatacttggaagtcataatcccgagtcattaaaaagaaaagaagattatatacttaaagcatatgcaaaaggccaaacatttgcatttctgttgcaaagttgatggagttagggagagggttggaatttactagccaaaaatcgcgatggtgttgcacatgctgtcatcactatgggtttaacaaccatgatgatcttaatttatctatgtagccgctcttctttctttaaagttttataattggcttgcttgccgattggaggatttacatgatcaaagggttcagcttgcttgctggcttaacctttgccatggagttccactagatatctaatgacgaaaatgattgaattttgaagaccacagcaaggctctctcagtgaaatgataaccaaggctcccacatgttctcgaaaaatgtgctattagttagacctcttttatttttgttttttctaactcgtggtattttcctataccctacaagcacaaaagccatatcctcccaaagaggattggatacatatttatagctgcttgtagcagccatgctagtctaagagccatgcagccatgctagtctaagagggtgctgtcctagagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaggcaccacaagaccaagaccaaccaaccaagacttattcctacattctccccctaagtcttgtgcgccgtcttgtgggaa

SEQ ID NO: 31789 - DNA, 1501 bp, Oryza sativa
tatctatgtttgagggcataaggaccaaggtttatgtgaggatacaacagaacaagagcaaagcaaaaggatggctaggtaggatatgtccaaatatcttgaagaagttgaacaagtacattgacttatctggaaactgtgaagccatttggaatggaaaagatggatttgaggtcactgataaggataagagatacacaattgaccttgagaagagaacatgttcctgtaggtattggcaattggcaggtattccttgtgcacatgctataactgcattatttgtgagctcaaagcaacctgaagattacatagcagattgctacagtgttgaggtgtataacaaaatatatgaccattgcatgatgccaatggagggtatgatgcagtggccaattactagtcatccaaagccaggaccaccaggttatgtcaagatgccaggaaggccacggaaagagaggaggagggatccattggaagtaaaaaaagggaagaagttatccaaaactgacactaaaggaagatgtagccagtgcaagcaaactacccataacattagaacatgtccgatgaaaggaaattcaggaaaaaagatatcagtacaagagagagcaagagaggcaagtaatttacatgctacatatataagtggttgagtattgacatatgtgattctgatctctacattgaatgcaggttcaggaatgtagcaggccgcagaaaaggtttaggccatctgtagctgcaggaacttcgcagcaaaagttcatgtaagttgcaactacattgcagactatattccatcacaataaaggtgtccaaaatatatgatcttttttttcatgtaaggtgcagactgatttgccatcccagagcagcagcttgtcaataacaaagaagggacaaatgatgaaagttgcaagaacaaacacaacaaagaagtgaagatttggttgcatatggctgtaggaataagtcttggctggttggtcttggtcttgtggtgccttttcctgcttttcagctttctaggacagcatctctactttcagtttggatgctctaggacagttaggacagcagtttgttgagatgctctaggacagtttgttgggatgctctgctctaggacagtttgttgggatgctctaggacagcaccctcttagactagcatggctgcatggctcttagactagcatggctgctacaagcagctataaatatgtatccaatcctctttgggaggatatggcttttgtgctttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcaccggttgctcctccttcccctttcccttccccctctccacacagcagccccccggaggtgcgcca

SEQ ID NO: 31790 - DNA, 1501 bp, Oryza sativa
atcggtcggggcgctccagatctaggtggtggaggaggcggcgagtcctcccaaaacttaccgtggcttgggttcaccgtgttggctgatggggaggcggtcggtggccagaagcagcggagggaggcgcctagggctgtgggtggcggaggagagtgggtgccattggctagggcgccgacgacggttggggtggagcacactgcagcatttcaaaacgttgtaccatactctgcacctcacaatttcgaactaagaacttacattttggctcgtggtactgcaaagcctcttgttgttaggtcagcttccaacgaagacattttgtgcatttaactccacgtgtccatcgaactgtttgaagaaacaagggcatttcttcctttagaatatagtaaaagccaataattctggaagatgtatatgccaggtgtgaaagccaaatatggcatctcagtcacagtccttacctgacgagttaactttagttgtcaccatcttcaacaattcctgggccgtggggcccactcttcagtcacataggctgccataagctcaccagtcactgcctctacggaactgctgtatatatacgcactcatcaaatggaataaagaggactgcaggagaaaaatatttcttgtgctttcactagtaaataaagaaccacttgtgggtaagaagatcaattttgaacatacagtaaaaacaaatgatgtcaatatgccaatttaccaaggaagtttgtttagtgtagtacaagtttgttgataaaatttgtgtagcatggcatagtgttaaaggagaattgctctaatagcaccacttctttttgttagttactcctatgtttttcataacacttaattcaaccacagcataacaaactcaattcatcaacacgatagatatatggttgcattgaacttggtactaacaagacatatatcaaaccatgtagctagattctaccaaaatactagataacaacaaaagcaaagatgaacagaggtggactgttctccttacaaatttattgcaaaaaaaaaagtagattctctatggagaggcatatttaacgttatagcagggctataataagaaacagatggctcaaagaaaatgataagcaacaaataacccataaaggacccatgtcatatatagataggccttgcaaacaaacaaaaaaaaggtatgcaaggaaataatagttccttcagcagttgagaaatcatataacagaagaaaaaaaacacattggtaataatttgacttctccactagaatagatatttttggatgagggaggccggcaaagaaactatttagtgacatggcaggccgctttggaacttttctcatgtatctgcactggctacctcacaccggaggttcgtaaaggcggaacggctaagggggagtgccaatgactggcacaaaaccgcatgctttggaatcccagagaacccaaccctccctttctcttttgcaaaagaat

SEQ ID NO: 31791 - DNA, 222 bp, Oryza sativa
ttgcactgtttgaccactcgtcttattcaataaatttgggaatattttttttacttactttattatcccaagtactttaagcataactttttgctttttatatttgcataaattttttgaataagatgagtggtcaaacaatacaaacaaaaacttaaaatcccttgtattatgtgatggagggagtagtataattctaatcggtagaaacaccttcaaatt

SEQ ID NO: 31792 - DNA, 1501 bp, Oryza sativa
  unsure (1)..(1501): unsure at all n locations
cgcacgcgctcgtggcgggacgccacgcggttggccgcgtgcacccgcgcgtcgcacgacgcgcacaggtacgccgcgtccgcgcggcagtacaccacgctcggcgccgccggcacccgtcgcacggccgcgcccatgggcagccgctcccctctcctcctcctcctccttcgcctccaactccaacctcctggtcgaacacgttgccaccaaaattataattcatgaacgaagtagccttgcttgtggtagtagtagctttagcttgcaccacatggacaagtctatcgatccaagctattgtgtttgtcctctctctctatgtgtcgtgtgtgtatgcgtcttctcctgttcctctacctcgcatggctcttgtggaattttgtgagtgttttttggaaggagctagggaggggaaagtcacggtgtttttgtcctggggagtttgagtgtagagtatactaatagtaagggggtgtcaagtcgaatccagcgattgacacttggcgcgatccccgggggggnggggggggggggcgagcggcggctgcaatgcctgtcttgtggttgcctttggatgtttgctgcttcagcgtttctcttctcaccccctgatgccaatcctcaatggaggggtcgttttcagataaagattttgtgcactttggcgggtcctatggagaattggcgcccttgagctaaatctaagtatctaacctgaactgatgtcaataccttttaagccaaagcaatcgcgcttttgcgcaaaaaagctttgcattttagtgatgagtacactgattctcttttgtcgtaatcatgttccattttaacttaggactgtccctaaagagattttacagggatcaatagaatcctcccatatgcattcctaggattgtccctaaacaattcaatggacatctcttagatggaactaagcccaaagggggagaattggaagccactgtgatgatgtacaaataaagggaaaaacaaaaaagagcagaggaaagatgctgcctctctctctttatgcacattcttttgcaaaagagaaagggagggttgggttctctgggattccaaagcatgcggttttgtgccagtcattggcactcccccttagccgttccgcctttacgaacctccggtgtgaggtagccagtgcagatacatgagaaaagttccaaagcggcctgccatgtcactaaatagtttctttgccggcctccctcatccaaaaatatctattctagtggagaagtcaaattattaccaatgtgttttttttcttctgttatatgatttctcaactgctgaaggaactattatttccttgcataccttttttttgtttgtttgcaaggcctatctatatatgacatgggtcctttatgggttatttgttgcttatcattttctttgagccatctgtttcttattatagccctgctataacgttaaatatgcctctccatagagaatctacttttttttt

SEQ ID NO: 31793 - DNA, 1501 bp, Oryza sativa
tcaaattatataaaatgaaacccaacgagacaataaactttaaaaactataatgtccaatttttaaaggttcgagcttctaaaaagtgaaaagataaacaccaacgataatcatttttattttaaaatctcaatgataataacaaagagaggcagcaggcgagccgcagaggagtacaatgacaaagtcgctgacgttttagcggaacttctaaaaagtaaaaaaaataaacctaaacgataattatgttcgatttttaaaatatcaatgaaaagagaagaggcagtggacgaccatagaggagtataatggtagtatttgatgggacttctagaaattataaaaacaaaaccaaggataataaactctaaaaactataagatcaaaattttaaaggttccaagaagaataaatagaaacaatagtagaccgagcaagcaaataaataaggatatgacagaagtaaggggtagtagctggtgtaactttttaaactataaaattagaattacaaggatggtaaggtttggtctttcaaagtcttaagacaatgagataaatatttaataaattttaagtaaaatcatattaaaaaaatatataattttgtatgggtgctagccgcgcaattgcgcgggccacccagctagttataaaaattgaagatgtttttgccggaattttggtacgtcatcagtatttaagtcggtttttaagctcgttcgtttttggaaatacaaatccatgtttgagtcggattttaagttcgtttgcttttggaaatataaaaaggagtcgcataagaaatttctttaaaaaaactcacatgctaacttgagatggaagtcggactcctaattgtagctcatgattttataaaaaaatatccaagcgaattcccacagcgaatttcatcgtagctaatccacataacaataataagattaaaataacattcacccattgcagcgcacgggtattttttctagttaatatacaaagcaaagcttttgcgctcctttttttaaaaaaaactataggttcttaagctgcaatttctgggtccgtgactcagtgttgaaggtctgaatttctctgccaaagacagcaccaggaacgtccagaaacgattaataaaatgcatgggagaagaataatttgatgcacctgatcttctctgaacatttttccaagattggtgaacctgaagccaccaaacactgctactactgcagagagagagagagagagagcctttgacccattagtttccatatcataatactctttactttctgcttgcttactctaccaaccacatcagagttagttcatctcctccttgaccgcgtttccatcactgatcaccatggaggcctcgcctcactttgctataaagcccatgcagagtgtgagaatctacccacaacaacatctggatcatccaaagaaaggaacagctgcaacttttttggtcagaaaatggctacaggtgttctgt

SEQ ID NO: 31794 - DNA, 1501 bp, Oryza sativa
agtgccgagttttgagcatggtgcttgtcttctatgttgctagagtttttgtgttaaggcggagtcggacctgctgcattgggtccagccgatgagccgggaaacgataacacttatcactctggctctggtttctaagaggttctacccctttgagggagtcttaggcgaaagccttatctggtcttccaggatcggcaacatcgaggcctgcgggcgctgtttcctccttagaggtgttgcattgtggactctctcccccttcgggtgaaaagcccaatcctttgggcgagcgtcggcaacggcttctgtcattgttcacctccttggaggcttcgctttgaaggtcttgctctttctttggtcacttctgtggtttgtagttttgtcgcaggcttttcgtgtcttctgtgtaaggttttgccggttttcctttagcaaactgtgcagttatatgatttttgggcccggttttccttataaacagggtcaactctcttcttctaatatatccggtagatctcctaccgtctactgtttttaaaaaaagattttattgaaaaaaaagatgtcagcacaaaaatccagtggttttcgcctctttgagcgaaggcacattcacgagtgtatgagtggtattacaagtgtagtgatgtatgcatgtctattgtataatcgcaaaagaaaaaataatatcgcgtacaaaaaatctaacagaccttgtgacttcatcacacaaacggccaagctcccaggatagaaaagaggatagagagagacagagagaaaaaaaaaagaagagtagaagaaaaacacccatggtttactgatcccgtttgctgctactccagtaggctacagcagtcaggtctcgctcagctcgggtggcatggcatcgcatcgcaggaggcatgtttgttccatccctccatttcgcgcgcgagcgaagccgagcatcagcatctctctccccttctctgccttttgtgtcatttgccccccctctgacacggccccatccccccggccctctgccattttggctttgcccccgcgtgtggtgtgactgcgcgcgcgcgcggccaagacacacagagagagagagagagagagagactagactctagtctctagagagagagagtgagaggcaacctgccactgctaatgccaatgccaagctgcatgctgctttgctttccttggcctcacgcttgttccatgttagttcgagcgcacacacacaatcacacattgcacgcgcagacgcagccactgcttcttcttcctcctcttctcccaggaaagagctcacctgacctgaccacctgaggttgtagttgctggtttgcttgctagcttcgtcgtctcctcctacctgagctcagcaatggagccgcccttcttcctcctcctgctgctgctcgtggtctcctcctcctccccttccgccgccctcctctccgccaagggcgtcaacaacgaaggtaaggttcagttc

SEQ ID NO: 31795 - DNA, 505 bp, Oryza sativa
gtgacaggtgggaccggtctccatggttgggcaaaaacccaacggtctcaaaccatgcacaccggtaatggtaatttggctgtcaataatggggcggtctcttcaagactgccacatcacctgagcggcgcacgaatctgggcgagccgatttgcctcgcctggagatacggtaatgtcgcttcggtcggcgagcgtaattaacgcgcgcacgatacgatctatctcgactgccgcaaccgcatatccatctcacgcgccgcaagcgggcgaatgggattagtggaagcgtgggcgcgagaaacgagggggcgaaataatgggtgcgagaaacgaggagccgggcacagcgttggcaagggtataaaggcactgaggatgggatttgtctccttcctttcgccatcatttcccttgccttcgccgcttgcgtcctaactccttcttccccgcgcccttctttcgccacacgcgctcgctcttcatcttctcttcgtccggcgcca

SEQ ID NO: 31796 - DNA, 299 bp, Oryza sativa
cccccccgggaaattttttatttttgttttatttgtttgatatttttttcacgcttagagacacacaagaaccaaccatagaaaaaatgaactcaaatggacgtaatatgtgacctgtagaatttttcctctcctctcctctctctctccgaactagtgcagaggagagagatgtgcaacttttttatttttattttattttttgatatttttttcacacttaggaactcacaagaactaaccatataaaaaataaactcaaacggacgaaatatgtggcctgtgaaattttccaaagc

SEQ ID NO: 31797 - DNA, 175 bp, Oryza sativa
cttactatgtaataggaaaaattgacatgtcagctctgagcatcactgaattttataggtagatgtggagacctcttggattttctcagtgtatagaaagttgtcccaaaacataaccttcttccctatttcctaagtgtgtttgttcgttcgttgggggtgggtgtggggaagc

SEQ ID NO: 31798 - DNA, 1116 bp, Oryza sativa
aaaaaagaagaaaaaagagcaatggtataaattgctactcaatactatattaataaaaccataataatccaaactttaacaagtaaagcaaaaccggggccataatgaaagcccgtaccaaaaaagttgcaggagcactcaagaattcggtgtaaaacgaacgacaaattattgcaggtataactaaaagcgataaaagatcgatcatttagtcgacttcctcgatcttgggccctggtccgctgcttccgccggcggccgccggagcatcctcgtccatgcctccggccatgtcagctccggcgccctggtacatcttggcgatgatggggttgcagacgccctccagctccttcatcttgtcctcgaactcctcggcctcggcgagctggttgctgtcgagccagctgatggcaccgtcgatggcgtcctcgatcttcttcttgtcggcctccggcagcttggacgcgatcttgtcgtccttgatggtgttccgcatgttgtaggcgtagttctcgagcgagttcttggcgtcgaccttcttcttgtgctcctcgtcctccgccttgtacttctccgcctcctgcaccatcttctcgatatcctccttgctcagacggcccttgtcgttggtgatggtgatcttgttcttctgcccggtggtcttgtcctccgccgagacgttcaggatgccgttcgcgtcaatgtcgaagcacacggtgatctgggggacacccctgggcgccggcggaatgccggagagctcgaacttgccgagcaggttgttgtccttggtccgcgtcctctcaccctcgtacacctggatgagcacgccgggctggttgtcggagtaggtggagaagacctgctccttcttggtggggatggtggtgttcctggggatcagcacggtcatgacgcctccggccgtctcgaggccctgagacagcggcgtgacgtcgaggaggagcaggtcctggaccttctcgttgccctcgccggtgaggatggcggcctgcacggcggccccgtacgcgacggcctcgtcggggttgatgctcttgcagagctccttcccgttgaagaagtcctggagcagctgctgcacgcggggga

SEQ ID NO: 31799 - DNA, 1501 bp, Oryza sativa
acaaaattaggtatggtcggcgtggtctgcaactaagatagagatacaattgtatatcagaaacaaaagagaagaggtgtacgttaatccaatctcacatttaatatcaaccatatatggagtataactacaatagggaaataggaataaaaagttgtatacaaatctaattcatcttttcaacgctaaattgcatgcatggaaacccctaggaacgaaaatgatcacggaaattcccgataaccgagtgccgtttatgcaaaagggtattgtttctgactgttactttttttgctatataaattttatttttctaatttctttatacatcgtactaatattaaccctaagtagttaaaataataaatatgatcaattaccgactgatcgagtattgttcccgaaaagatactatcatttctgactgttttcactcatagaaacccctagtttcctataggataccataaaatttgtacacatgtttcttcaaaaaaaaaatcgtacacatggaaataatttgtacagtaagcagtaatatgttcccataacacctgccaactacggagtaataataaaccactgggtgtgtttagttcacatcaaaatttgaagtttgattgaaattggtacgatgtgatggaaaagttagaagtttgtgtagaaaagtttcgatgtgatgaaaaagttagaagtttgaagaaaaagttggtaacaaagggcagttttggattgctaccaaaatttgctctaccaatattttggtagcctaaatagtacccaccatttgtttggattgatgccaacattttggtaatgcccatcctaaatttggtagcaatctagaactttcttcgctatggtatcacaatttggctacattttgatagcaaaccaaataagatgaatacaaatttattctatcaaataattgatagcaccaaaatttatctatattttgacactaccaaaaaaattgttagggcactgaaccaaataagccctaaaacaggcaaagtacataaagcggccgacttcaaccgtgcagaaaatcccggtcaaacccggcggttcgcccgcccatccgtctgatcggcatcgaacggcccaagctggcagaggccatagccccgtaccaaaacgattgatcgttaccggcccaacgggtctcaactctcaagtctctagaaccttccggagatctctggaaccgcgtctccaacgcgcggccgagtccaaactctccaaagtcgcccgtttcccacgtccgctacgaacccgccgcccctccaaccaccgtccggatcgcatccgacggtccagccggtccacggaacattctagaaccacgcagacctataaaacgatcgctgcctcgctctcgtccactcacaaatcgatctctctcctgccatcttcagatcgcatcgattttctccttttcgagtttttttccccttcgcttgagagctttcgacgagagcgagggagagggagatca

SEQ ID NO: 31800 - DNA, 1501 bp, Oryza sativa
cgtcaagtcagccacctcttttgccgaacgcaatgcaacacgcaggtagccaggtactgaaaccgaaaccaatgcctccctccatctagctaaccctctcaccggccggctgtacgttcggacagcgcggcgacaaggacagtgcttgctgttcggccggccgggccacccgcggcgtggtcggtctgtcagtctcggcgcgcgcgcgtacgcgcaagctgcacccacgcacggacgaacacgcgcgcgtgggtcacccgtggcgtagtacgtttgatcttgcagctaaccagctagctagccatggcccctatcgccacagtggttgcacacgccatgcaagggcgcgcgggaacgagatctcgattggccggcagccatggtttcaggcaggcccagtgggctagctagccatgcatgctgctgctgcagcagcatttcaccgcctagctagcgagcttgctcccccgcccggcaatcgagcttccaccatgagctaagctgcaaatgccggaaagcaatttcagcttccacgatcgtctatccttctttttccagagcttttgcaggagatgatgtacggccagctcagctggatgtgtgcatcagctgtgtgctggtagatatacagtacctgaaaaagagactgaaagactgaaagctagctagctgcagggggaatatttggtgtggaggagtgaatggtattatatcgatcttccgctgttgccgcacagtgcgagaaaacatggattttgtttgtgcgatcacgatgcgtgtgggccgcccggacgccggattggctgaagggggaggttatctgaaggggttggtagcagtgtgtgtagggctctctcagctgatggtccgccgtgcaaaagggaaggagggaataaaggcgcgagagagagagttcgtggccggccggcgcctttaggctttaagcgaccgaccgggccgccgggttcctacgcattttcgcggcgcgtcaacgtaaacctgcagtgtcgtcgcccgcgccggacctgaatttgatctgatagctaccgttagacagcgatctaaagctagcaaaccgttctctttcgaaagattattgggacagaatcttgcttaaggcgatttacatgtcacacgcacgggcatttatggaagattttatgtagtgaggcaaaactaaagtgtttgctaatttttttcacatcagttttaagcggcaataatggagcatatgcgagataaaattacggaattgctaagcttcaatcgacagaaaacctacctccaaatcttgtaaattttggttcactggatgtgcttcgcgattcgtgctccagttgcttattctccaactccgacaaactcctattcttctccggcgccagcgatgacccaaactccggcgaagagccgacgaattagggtcctggggtggggtggggtgggaactgggaagggtgggagggggaggggaagaagggggagttcgctgggcttagag

SEQ ID NO: 31801 - DNA, 220 bp, Oryza sativa
aaaggtataattaacggccctgacaacagagtttagggccaggcagaatacctgccttcccgacattaattgtacaacagtgctgcaagaagatttgatatatatcgatcgatcgtggaggtgatcaattgaagctgcagagagaaattaaagcttaatttatttccctctaacaatccagctagctaggtcaacgtacacctcgccggccggcgaaaga

SEQ ID NO: 31802 - DNA, 1501 bp, Oryza sativa
gacgttggtggacggcttaagcgagcccgtcggcggcacctagcgagcgtggaggggtgcaagggggcgatgggagctcccagatctggtacgcctctccctctccaccctctgcatcgtcattaaggactcgttttcgttggtggccagcgacgacgacaacgacatgccggggttgatctggaactccggaggatgaggacgggagctcgattcaaacatggtcgttgcgatttggcgtgaggatagaggaatatcaaatttggcattcatctctcatgtttagcggatacgttattttttaagaatgtgatgacatatctgctagaggtttatttttattttcatgcgctatttcttatacgaaggactggatagcgcatctgctgaggatgctcttagttaggacattatttgtggcaaagcaacaagaagatccacctgaaatgaatcacgggtgtagcaggtggttttgccgaatgccgatgcatgtgtcggtaaagaaacactcccgcacggccaaacctccctcttgaattgtctataatctgccagtgaattatctgacggagtagcgtcgtattggcaaatatacattttgcccttttcaactcaactgtactagtagctctctaaactctggagcacaaaaagggtggccagtggccaccgttcatgtcaaccaccgaactcggggtcacgcgataattgcaaacttgtttgtctctaccgactaccgcaatgccgcaatggtgtagtatatctacagttttttatagcctagacaaaaaccgtactacatgaaaggttaatacgatcgtcagatgttgacaatgctacgatccactttgttaacccgagcgagttcccgagtcttcaagctttgggtttgcctaatcccccacagggccggccctggccctatgcagccgaggcgaccgccgggggcccatgatggtggggggccaactctaaaaatttaaaatccttcgatgaagtagatctttggtcgcactgcaagatttttgcgaaaacatttagggcccctttgaatcaaaggattcatgtaggaatttcataggattcaaatcctataggaaactatcctatttggccctttgattcaaaggattgaagctctccaaatcctatgaaattcctatggaatggcacattgcatgtggattttagagaaaatttagcaagagctccaatctcttggaaaatttcctttgagtctatctttctcatccaattcctgtgtttttcctgcgctccaatcaaacgaccatttctgtgtttttcatgtgttttgcaatcctctgttttacacttcaattcctgccagaatcctgtgtttttcctattcctctgttttttctaccctgtgattcaaaggggcccttactcatgagaactcatccgatgtttagatcaatgatttttagtcagaatcttcgatgtccgcgcctgagattctgaagtctgttatggatacaga

SEQ ID NO: 31803 - DNA, 1501 bp, Oryza sativa
ggcaaattctcctattaaatcctaaataaactcgaaaggccataagcagaagaaatgtaatcttttaacgaccaaatatggcaacaaaacaacgagcctcaagcgagaaacgcaccagggagatcttgctaccgctgacgccgagccggaggagctccctggagtcagcgagcgcctccctgagccgccggagagcggaatacgacacatccggcagcggccgcggcccctccttggcctcctccagcatgggcgcgagcagccggatccgccgcgacaggttgcagaactgccgccggtatgcattcctgaagtccgagatggcggcgatctcttccaccaactccaccagcttctccaccaaatcccccgcctcctcctcctcctcctcctccttctcctcctccttatccttcccctccgccgactccgagctcgaaagcggcggcggagaagacgctgctgcctccgctgcagcaggcgccgcgtcggcgttagggttcggcttcgcttcctcgtccatggcggcggcgctggggctcaagccgccctagtgtgcggtggccggaggcgggtggtggtggcggcgagggcgagcgggcgatgcgccgtggggggatttggagaagtgtagacgaggttggagattagtggcttttcatcgcctcgactagtatagcctcctcctgccagtgggccacccggtctggtcccaccagtcagtgtaacccgtgaacttatacgggcttacgcaagccgccgcctccttccgcggcgccggctcggctcggctggtgcgcgggtgcaccggaggtgtagaccaagggagttggaataatctcgatgagcaatggacggtgcagatggccacaccggtgtactatgtgagatggtaatcgtgagatatgatgacccactggaggcggagatggagtggacggcgtggcttttgggctggctggagtgtttagattttggtggctttttcgttgagtggctcgttagttaatctttagagatagcctaatttggacggatagggacttcaaaagcacaatgagatgcgtgatgatctgtctgcttagctaagacaagactggacttttttttcgcctaaaaccacactctaatcagagctcaaactttgcaagttgtagcacatgtccaaaaatgattttctttttaatcgttgttttgttatactttagttacctattctatttagtatagatatttgttcgtacaagtttatttgagatgcgtttacagtgtaatggctgggcagctggcaatgcatgtatcccatcagcctggattcgaatctcctgcatgccgactatttcacctagtttgacgtgttgagacgaagtatcttattacgattgaacctttcaccggtgcctaacgattttttaagtatacaagtttatttgctctaatggtaactatatattcatatttttttaaacacaagttttttgttttatattcatgatggaca

SEQ ID NO: 31804 - DNA, 1501 bp, Oryza sativa
atttgtaattgaaagactcctttgttgctaaatactcctcaattgcaggtaataattgcatcactggtacatctacaaataaaaaatttagttagcaattatttgaatgcccatattgtatattatatatcgacaaaaagaaaaacgttgggaaaacccctcttgataggttgcggtgctctatctaaatcaagctagttaattgctaaactgcttaattattgtaatcacctccacaacaccactgatacatcttgctagattagatcttttatctttcaaggggattaatatacaatctggtactagcttttatttgtggggggagaaaagggcattaatcacaatctgctagtttatttttttttggggggttgtctggtagttataccacgcaatgatgtaatcgaaagaaatagatgctctgttcagtcactaaaaccaatcttttggatttacctctagtcgagtgacttaatttttaagctcgaatatgttctattattcatgttggataattcaaattgtactagtaatttattttataaactatacttctaccatctactcctccatcctataatatagcaacttattacgggatgtgatattttacagtgcaacgaatctggacaggaggatgtatagattcattatattataaaatgttacagcagttactaggttgctatattatgggacagagagagtaatagttttgtttcattttgcgtattactaatataccatgatgataaatctatatattgggtacaacaaagtccaaaacaacctttttttcctcatactgtaccttatccacattttttttctctcaaattgcaatcagaccacagtccacatgtgcacatgatactatatacatttccctcattttgtttacaaactagaattgttgtttgggtcgttgcacatgaaaacaatcatagatttcacaaaagctctataggcctaatttcacagcccctaccagtattcacgacacactggtccctttccatttatgcctcgatttatttggcaggtggccggtgctatagacaaatgcttggtagtgtataacacggttggctttggcttgtgaagtgtcaaataccaggacggccggcccttgcatgcgtttctccgctgtacctagcctgcaaaggtggactagtgctcgtggtggatggaagtagtactcgtacagtcgtacttggctggcatttgggtggcgaaacaactgaacccatccgatcgatctgtaaacccgagagaaagaggagtggacagtgtgtctccagcgagcacgcagtgacaccgtttttacatggtccaagtctgtgctaagccatccactgtttttccttatctgtttgattaatgattcacccgttgacaccgttgtcgacgcgtacgacagcaatttgtccccattctcctcctgagtcccgaatacacgggataaggttgatattccattaccagtctaaaaaaaagg

SEQ ID NO: 31805 - DNA, 1501 bp, Oryza sativa
tagctcaagagatccttaaatacgacaagaatgtatacgaatgtatttgctgattatttttgggagaaaatgcaaaaggtaccatgtcattcgattacaaatgtatggctgcactgagaaacagtttctggacaggttaacacataagcaaagaccatttcataatgcacatgctcttcttattcttcttgtcgaacttacatatgtcattgacaaagtggtatccaaaaatctttgatcactatcatacgttaccatgcttgtttaatttgaccaaataaaacttttttttaaggattggtttccaaaacttatgacctagtccattacgagtcacaatgtctatgatttattcagaatacggcgcaataattttatataacttgtccatcatgaatataaaacaaaaaacttgtgtttaaaaaaatatgaatatatagttaccattagagcaaataaacttgtatacttaaaaaatcgttaggcaccggtgaaaggttcaatcgtaataagatacttcgtctcaacacgtcaaactaggtgaaatagtcggcatgcaggagattcgaatccaggctgatgggatacatgcattgccagctgcccagccattacactgtaaacgcatctcaaataaacttgtacgaacaaatatctatactaaatagaataggtaactaaagtataacaaaacaacgattaaaaagaaaatcatttttggacatgtgctacaacttgcaaagtttgagctctgattagagtgtggttttaggcgaaaaaaaagtccagtcttgtcttagctaagcagacagatcatcacgcatctcattgtgcttttgaagtccctatccgtccaaattaggctatctctaaagattaactaacgagccactcaacgaaaaagccaccaaaatctaaacactccagccagcccaaaagccacgccgtccactccatctccgcctccagtgggtcatcatatctcacgattaccatctcacatagtacaccggtgtggccatctgcaccgtccattgctcatcgagattattccaactcccttggtctacacctccggtgcacccgcgcaccagccgagccgagccggcgccgcggaaggaggcggcggcttgcgtaagcccgtataagttcacgggttacactgactggtgggaccagaccgggtggcccactggcaggaggaggctatactagtcgaggcgatgaaaagccactaatctccaacctcgtctacacttctccaaatccccccacggcgcatcgcccgctcgccctcgccgccaccaccacccgcctccggccaccgcacactagggcggcttgagccccagcgccgccgccatggacgaggaagcgaagccgaaccctaacgccgacgcggcgcctgctgcagcggaggcagcagcgtcttctccgccgccgctttcgagctcggagtcggcggaggggaaggataaggaggaggagaaggaggaggagg

SEQ ID NO: 31806 - DNA, 1089 bp, Oryza sativa
aatgaaccttaattgcctgtacagagatctgcactgtttgattattatgatcctacctttttcgtctcgcttttgatctttaatttatacatctggttgcccaccacgtagttttgttccttggactgcaggttggtacttggtacttggagctctgcatgcgcttctgcgtgtcatctgcgtgtactagtgtgtacatatgcatatgattctagcccaagctaggtacacaaagctaaatgcatgcatatgaagatacacgtacggtgtcagacgggcaattatatatgcagcttatggcatggcagtatcaaattaaagttaaggtgagctactctcttgtgccaggagagagaatcggtgctttacaactgatgacccatttatggctattctactgttggagtactatgacccagttatgtatgatttaattatagcactagccaatattgtaattaattaagctgcttttatcaaaatacaaaaaattaaaaggatgggacgaaaacacctaatgttagagccacatgcatggatgttgactgtagtgcagtccaaactccagaatagatcatatccatatttgaggaaattaaacggaaccctacggcatagaaggaaattgcacacccgcatcagacaacagtgctccttccggacgatcacggaaaacatcattttagtcatgagatgtttcatgccaaacattacagtgtttgaacatcaattatcttcgcagctagtgtttttaccatacgacctaggatcatttgtatgtaacggcaagaattcgtaaatcctcatatacacatagagagattttatacaagttcaagatccctttagctagggtgattccattgggtttgtctgcattcgtatatgtacgggaacagtactacctatgtggtacatgcatggatgaatagggtatggctggctacggctaaagtacatctcttgacgatttctctagggttgaggtctgatcgacaagctcctcgatatcagcttatagaggaacatggaaggatctggcccatcctaacctcacggtctttcactactacaaaatatgtcatcagt

SEQ ID NO: 31807 - DNA, 1501 bp, Oryza sativa
tatccttcatttgacattgcacatgctttttcatgtgctgatgacacacatgttttcattgccaccatgaccgccccattggcatctacaaatcgtgattgtggcattaacatgtggcccctacatcacccatcctagtagttggttgcaacagctaaagccaatgcccctaatctagtttgactttgagtttttatatatacatttttttatggcacacggttccaacattatttggtaatacactctctgtcctacaataagtttatttatccttcctcctatttattccagaataaattcatttttgagtaatcgttgtatcaaagtttgtgaaagtatggaataaatgtattgcaagtagataaagtgaggaataatggcattgaaattcgataaagtcggggcattatagtctcttgggtttggtattggtatacatgagatgggtaaaataaacttattttgggatgacgggagtattagataagcgttttaccacaatgagaggtgcttgtattatgtgttgcagttattttccctagtaaattttaaaacttaatggagtactccctccaggttgaaaatacttatcgttttgaacaagggtgaggtcaaactttaaaatcattgaatataaatatgaataatttctaaaatatttgccgtagaagtatggagaccatatgtatagattagtcttaaaaagtacttcaaataaaccgtgtatttgttgattattttatttatactataatagaaaataacgatcaaaactgcttttaaaaaaccgtgtccttgtctaaaatattaggcaaaatttgctacagggcatcgaaaaaacgtgtaattagctcgtggacaccacaagaacgagaatttgctgatgggcatcacaaaaaatgtgtaattagctcttggacactcgaggccttattttattgtttcctgtggatttggatagagaaacactggtgagagtacgattttgcccctgccctcatatccagcaagtgattcttgcacggctcgccggcgatgtggcgccaccgccgccgccgtgatctgcagatcgcgtacacccacccgacgagcttctccatcctgcgacgcacacccaggacgtcggcgggccatgagtccatgccgccacggccggcgacgtcggcgttgtgcctttgcaggatctccctcgtatgcaacctgcagcggcagaagcgcatctgcgtgcgtgtgatccggacaacattccatcctgcagaagccgtcgcgtaaccccacccccctccaccggccattgctattgtttgccttctacgttcactgaccccgtacgcatggttcaccaactggaaaagaaaaaagaaagaatacaaagctctgcagacaagatgagaggaatgagagattgcaatggagaagaggacgagaattggtgcctgtttttttggttgatttgaatcgagatgaatcgatttgaaccatacatatacaaaattgg

SEQ ID NO: 31808 - DNA, 205 bp, Oryza sativa
cttaattaatcacgtgctaatggactgctccgtttttcgtgcggggagatgggttcccaaccttcaagtaacgaacgcctaagtatgtttaggatttgttctaaacaaaattgagttttagtctattatgatgtttatggagttaggtcaattatttagattctttgcctttttacttttgctaatgttttcacgggttcttcaa

SEQ ID NO: 31809 - DNA, 214 bp, Oryza sativa
tgcaatttgttcgattaagagaatttaattttaccgatctcgtgaagtagtgtttctactaccaatagatactactgtaaaacggtatacctttttggtggtttctagttgcatcgatctaatatgttttgtttcttaaaacctttagctgatgagctttcctctgtccttccatgaatcattgcttaatccaccgggtgacatgttcacatca

SEQ ID NO: 31810 - DNA, 554 bp, Oryza sativa
cgagggagacagggggccatgtgagccgtagcaagattcctcagttttgtgccagtgaatgagcagtttgcttaagtagggtagtagtgtccgacatgggcaatccgagctcgtgattgccattttatatggggggaacagtagtcgtcttgctccaacgactagctagacacccaaattatgccagattaatggcagatacgcccggttaggtgtgtggacttatgtttgtacctacgaatccaactgcacgcacgttcctccgttccctcaccggaactcaccccatgttcccccaactaaacacacatgtgagacagtgtcaaacgactacccccgagcagtggcgttttggcagtgtgcatcctactcctttcgttctgaaatataagagattttaaacggacgtctaaattcgtagcactaaaaagagtcacatccattcaaaatcgtttatgttttatgacggatggagtagatgatacagagaccaaagatgattaaactgatgagctatatatattttttgacatgtaggatttagcacggtgttc

SEQ ID NO: 31811 - DNA, 261 bp, Oryza sativa
gatcatgaacatttatgttattatatgtacatcattatctaaaaaaaatgttattatgtacatatgggtggcatgtgctttagtttttttttttactaaatcacgcgggaggggggagcttccccacctgaatttgtcattgcatttgggggagaaaacaatgttcattacattatattacatggaattgagagattgtagaggggaagagaaaattgctttccatacaggtattacatgtcgatcgtcaatcttgaaagg

SEQ ID NO: 31812 - DNA, 1501 bp, Oryza sativa
aaaaatattagataacacaacatcagatttgctgaaaaaattacatggtctttgcagttcttcctatatactgcacagagaaagaaatgttggcaagatgatcacgttatcacaccttagtgagattaagggatgtagattctcctccatagtaatcgttcctgtccatgtgaaggacctgtatatacacaagaacgagacaaaaacagtgacttgatagtgtacaactgtacattgttccttttgtctaaaagggcagccactaaaatatactagtaggatcttatgagatcattccattttttttataattttaactggggtcgagatttatgttgagaatctgtagaagatatgtgcgagtttttcttctttaaagagaaagaaagcaaatcctaatatttctctgatcttgccatttgtgttcctgaacaacagcaatgccatccagtctaggtacacatttcacattcgtacgcgtaaaaccatccaaattttccagcagcacgaaacaaaatctcactttcagcaccgtgagatctactaatgcggacgcacgcaccagcagcagtagaacgcattgtcgagttgcaatcagagggtgcattcgagagattggagatgggattcggtcaccttgaggccatcgacggagaggaggccgctgatgatgcactccttgagccccgtccccagcacgatcacgtcgtactcctcatccatcgccgccgctcccggctagcgcgctcctcccctaaatccgcccgccccgatctgctgcgccggccacccttcctccccctgatctcctctcctctcctccgctcgctgggcgttcgatccctgcctcccgcctcgccggtatatatggaggtggtggtcgggacaagcgcgcgcagcgcagaggcatcgccgcatcggtcgctcgctgcttcccccgcgaagatgtcgtcgaggccgatgcgcgcggcgccgcggcgcgcgcgacgcgtggtcctccggctccctcgcgcgcggtggtgggccggctcgctccgtgggccacatcattaccagggccgattcgtgtagactattttgggccagaaaatgggagctaatttagtgaccctggccgtctaatctcgcttaattttaggactaactatacatttatcgttaaattttaacttaaaaagatttagcaaatgtaaatatagtactccctatgtttcacaatgtaagtcattctaacattttccacattcatattgatgttatgtctatattcattaacattaatatgaatattggaaatgctagaatgacttacattgtgaaacagataaagtaaaattgaaatataattatattgtaagatgcatgtaactatagtataatttgtatgtatttttttaaaaatcctaggtgacatgtgtcgacgtttgatgtctcgactacggtatttggacagtatgggatcgttggtgctaggatatacgcgagactgaggtaaaagaga

SEQ ID NO: 31813 - DNA, 1501 bp, Oryza sativa
taagaaaatacttaaacccacacacatgtgaggggattcgataccattataccttctttttggcaaaatagcatgttgtcatggttatggatatcacgtacctaatagtagttgactaaatctcggcaggacccaccacataccatgtcctatacggaaactgacttcagatatggaggaagttcaggataaggaaagacaaccagagttctacatggaaacgacaagaactactcggattgtatccatattggtttccttagttctacttggataaggggacacctatgggtataaatacaagcccccctaggaggagaggggggacacccaacatgagaccatggaagacacccatgacaatcaacacacacccaccagaagccacaacatacaagccaacatacgccaagacacgccgccggatatcgacttcaggataggcatggctattcccctacggatcctccggataccgtcaggagatacgaaagcgctatctctgatctcgccgggcacggatttgaggaggaagactaccctgttgtcgactacgagtcagaccttcagaccgccatgtcgacaacagttagataggctacccacatattgtactggtgtaattatggtgaataagagcaataccggtttcggccaacaggatgtagggttattaccttactactcaggggcccgaacctgtataaaaatccctgtctccatctcttttacctcagtctcgcgtatatcctagcaccaacgatcccatactgtccaaataccgtagtcgagacatcaaacgtcgacacatgtcacctaggatttttaaaaaaatacatacaaattatactatagttacatgcatcttacaatataattatatttcaattttactttatctgtttcacaatgtaagtcattctagcatttccaatattcatattaatgttaatgaatatagacataacatcaatatgaatgtggaaaatgttagaatgacttacattgtgaaacatagggagtactatatttacatttgctaaatctttttaagttaaaatttaacgataaatgtatagttagtcctaaaattaagcgagattagacggccagggtcactaaattagctcccattttctggcccaaaatagtctacacgaatcggccctggtaatgatgtggcccacggagcgagccggcccaccaccgcgcgcgagggagccggaggaccacgcgtcgcgcgcgccgcggcgccgcgcgcatcggcctcgacgacatcttcgcgggggaagcagcgagcgaccgatgcggcgatgcctctgcgctgcgcgcgcttgtcccgaccaccacctccatatataccggcgaggcgggaggcagggatcgaacgcccagcgagcggaggagaggagaggagatcagggggaggaagggtggccggcgcagcagatcggggcgggcggatttaggggaggagcgcgctagccgggagcggcggcga

SEQ ID NO: 31814 - DNA, 1501 bp, Oryza sativa
gattatgatgaactaattcaagaaattgccataatctttggtaccttgtgcgcctggaacatgtaaatggtaccaaacaacaatatgatatgtttaccttcatgttctatttggcttaatgattatctgcgcgggaaaaaactcttaagtagatcacggttattttgttaacacgacaccagcggctatgacctgtgattaatgttttggtaatcaaaccaaatatagaccagaaaaatcatcatcgtcgcttcgaaaacagaatcaagaaaccatgaacttactcggttaaagaacaaaaaaaactgcgaacctatagtgcagtagctggatagaaacacagaaaaatacaattggtaataacacaaaatgataattaaatttttaagtaatacagtacatacgtaataatatcagctagctctgcctctactcttcgacataacgtcaacagaacattattgccgtatagcaatttttgaaaataataaggatgtaaagaggagcaagggaagtgccttcagatgatgctcggtcagcagtgcattcaggaaaaccatacggtgaaaactatatatatatatatatatatatatatatatatatatatatatatatatatatatatgcagtgcaaacttgaaaactaccgttagattgaaaaataaacgtctgagattcgtccacgtcaccatgagtaaaaaatttacttatgagtaaacctattagtaaaatttttacatttaatgacgtgaacgaacctcgtatgtctatttttcaatccaagatttgcactacacattttcccgtgcatacaacaaggaggtggatgcttcaagactttatgatattttaaggaagatggaattctttaaagaaaaagaaagaactttcagttaaatttatctaaatgaaaatatttgtctctttcttaattggatttatgttgtaccaattcaacagaaaccttttatatttttatatttagggttaattagattcatccactacgaatgtatcattttagataaatgctattattattcgtatattcgtatccatgccatttgaatatgtacaaattgaaatcatgccattgccatcatgttttctgataaactcttagctccagtcgatacgctcacggctttgattggcccgatctttcggtgagttgggataactacgatttcaaagaaacattgacaatcccactacaacagtacaagacgttgttgtgttgcgccttagcgattgatacacctctccgtgggttgttgaactagctggtgtagatcaaccttgttcctgtaagcaaatcaaagaaacagacaagaataagataaaaacaatctgaattgcgaacaggaattaaatacaaatgataagttggggtttcgaagacaaacagatgggcggtctagccgacatgcgcgctgcaagcaaatagtaatggctaaactttaatctaaacaaaatcagagaaaccctgaaggggtac

SEQ ID NO: 31815 - DNA, 765 bp, Oryza sativa
ggggaagggctttggtatgaagttcagaataaagtaggcaagcttcaagctatcatatagtactagtgtaagctgacttgtttgagctccatgcatataaagcaaagaacgaattagcgctttatggagttctttctattgtgaattatataaccgaccattaacatcatatgtggtaagcaaattgattggagtattaggtgaaaaaggatgccttaggaaaaaaaatccaaaagtatttcaaaccaagaccaaccgttaaaattagcatatggatgcagttattattttgttcagggtttagttttttttccgtacatgtaggttcttgcaatagagggcatcacagctcattaggaaaatatgaacttagctgttaatttctagtacttttttgccatatttgtattgttttcatctgtttttcttatcctttcatatcaacagtcggctaaacctgttgttgaacattgtctctgctcctttttactagacattcctagaaaaactagtttcatggattagctaggtctgccataacaggggccagggcattgaaaatctgctaagtctgctttagatgtttttgtctatgagatgcgttaaaagtgaagtaaccaaattccttacctagttgattaacatggattatgaaggaagctagaccaacatcaaagtgaacttctcatttccccaagctgttgactgcagggtgttgaactttctgaaattaacccttttggttcaatgcttatttgctctgca

SEQ ID NO: 31816 - DNA, 449 bp, Oryza sativa
tgaagctccagcatctttacttccgggtggcatagccctggatgatgatagatttgggaacatgttagcatgcgtcagctagactgaaagatcttaggcattagtgtccttgagaaaaacaatgctttgcaagtttcagaaccagcttctgcacaagcacatccctcacttttattcatcttcctaacaagagtttggttttttagtactatgcaatacttgtgcaggttaatgttaactttattgattctcagcttcacagacctatatgggctacggcctttgtgatgttgaagttgatcaaaaggaaagtgtgatgtgataatactttaagggccacgcaaatatatagataaggaaaaaagataattcaccaagcacttccacttcaaatgacatcaatataagagtcaagaaagtaaataacctgaacattttggaatatccca

SEQ ID NO: 31817 - DNA, 1501 bp, Oryza sativa
tgcaggccaccttatgttatgcttcactcccttcttatcttaattacattaaatgacctccttcggtcattccggcaaatgttatgcttcactcctgtactgatcaactgaattatcaggaatcagggtatacgtaataatagtgcttgatttgctcatctggtgtgacattttgtttctgcaccttggatggccaatgtttgttttgagagaaaaacaagaatggacacttccatgatgcttggttaccattatatgttgccttgctgtttaggttaccatgataggttgtattgctgtttttaagcaccaatgcgttccccctgcatagtttcatgacttcatctgcaccatcattcagttactccgttttctttgtgaacgaaaatgcagttactcttatcagacctagttctcctgaaataaaatgggtttttccttttgagctgtaaaactctgaaacctctctgtatcaggattcctgttttatttttaggatacttctaccttttttcgctttgagtgtttctactctgctgctatttttaagaagctggaaacgaacaaacatcagatcttgtttgttgtttgacttgattctgtgcctgcactgcacgtctggatttgttagcaaaagataacacggctgtcaatatactgaactggactattctgtaactacatataaaaaatgtctgaaataggaattatagtccaatttgtcttgacaggtttttaccgttctaaatgccaatgctgttgaacataaattactctgttttccaaacaacaacagaaaaaaaaactgaaattactcgcatatgaggcatagtatgaaattgaatttactgcctattcgtgagttggtcctcctgactctgactctggatgccactacctgctggagctatggaaatgggagtaaagctatgcacatctgatttccctgaagtttgatggtctgacgactgaaaacttgagcagtcacaatattgctgtccgataccaatcggtttaaaaggtcatgtggtagccgcggagatgacgagagattcaaatgtaaaagttaacctaatgaaaactcatcgcagaatttctttctgggattcatgtgtttcaaatgaggtttgaatctcaacagacacgcatttctcatagcacacggaattggcttgatttttctccccctcacacaccggacgatctcacaaatgcttcaccaaaagtacaagcagataagaagtacgcctccgtgcgagcaacacgtaaaagtcaaagtccatcaccccccgcgaaccccggaagcttccagaaggaacccaacaaactagcgcctccatctctcactggcagccgggccccacgagtcgtcgggcccacctgtcactcactctacgcgactactactacatcgcgcctctctctccccctcccccttcgaagcttttcctcctcctccgcgcatctcggcgccgcgccatggccgctctcagctcgcgcc

SEQ ID NO: 31818 - DNA, 1501 bp, Oryza sativa
tggacggcggcgatcgcggcaacggctcgctgcgactggcggctgggcccaggccgggtcgggcccacctggcagggagagatgtgagcacgttggtgagggtcccaggtttggttaccagacaagcatctgggggcagtcgtttggttgcaggagcagagaacatatgggtcatggagccattatgattttttcgcctcactcactcactgtggtccttgtctgaagcagttttctgtatcgacacatctgtcatcacatgagtgtacagcttctcctgtccgtagtcaccacccatcatctcaccattccgaatttcgctaaaccaaaccttttattttttttcttttgaaagcgctcaagacgtgggaacatgaaaatcgcatcaatttaaataggatttcaaaacagatgaatgaatataagaaataatgcccatggatggttcataagaaataaaacgtagtatgagttttggaggaagtttgtcaggttaagagagaatgtagagagtgcatttgacttctcaaaggaattcaggataagagtttcaaaattgcattccttcaatccaaagggcgctatcctaaggatttgaacatcctccaatccaaaggaggcctagtccaaactgaggccctgtttacattccaacttttttcttcaaacttctaacttttccgtcacatcgaactttcctacacacataaacttttaacttttccatcacatcgttccaatttcttcaaaccttcaattttagcgtggaactaaacacaccctgaatccaaatcttctcatgctggttgcctggttagtgtttgcagaagttccaagatctcatagtaggtcccagccaatggactagtagtagactaggggctactagctcttgatggctaagcaagctgttctgaatgtgtccctggttcgtcgcagcgagacgaaatgaatggcgaggcagccatcgtcgtcagcatcagtgatactggcctccatgaatgaatgcaaacagttaaaagaaaaacagatcagcttctccaatgtaccattctgcgcatccaagagcaggttctgaagctggatttttcttcagcattcatccgaccacgctgctgaatccgctgtaaatagattgccaatctgatggcgtagctttggctaattgaaattgtgtcggagctgagaaatgaagaattaaatcgatttaattctccaggagtgagcccaatggcgtcgttgccttgatgaaagctgccccacgccgccatggcggccggatgacgtcatgacgaggctggtaattggaccagccatgaatggccagtgtgagaggttaatccaaaaaaaaaaaaacataacctagtatggaattggacataatcgtatttcgaatctggtcactcctattcaaattcgttatactaaattatgtctcatcaatattaggttaagtttttttaaacggagggagtaactaataagaaaagagaagcaattt

SEQ ID NO: 31819 - DNA, 1501 bp, Oryza sativa
gcaattaggcttaaaagatttgtctcacaaattagtcgctatctatataattagttatttttttaacatatatttaatatttcatgtaggtgtttaaatgttcgatgtgacagggtgaaaaattttgaggtgggatctaaacagaccttagatatatgccaaataataggagcatagaagctaggggtcggtaggacgtagggtaagatgagaccatattctatgcacacaagttttgcatgcacaataattaaaaaatgtcacaaaaatatagaaaaaggtatattataactacatgtaaaatcttaacccaaattcattatattttagccgtgaaaaaaaagttctgaaaattttaaactacaagtctatcagatctttatcttttcttttcactcttttatgcatgatgaatttgaaaagtccatgtacatttttttttctaatttctacacgtgaatacaatactattgaaagtccatgtacacatgaagaatttatgtgtatacgatacgttcccatatacaatatccaattcacctccaaatgcctcagcatggacctcagctcttccgtagttccgtcgcgatgtcactcaaatgcaattggttgtgtttagatcaggggtaaaaagttttggcgtgttacatcggatatacagacacacatttaaagtactaaacgtagactaataacaaaataaattacagatttcacatgtaaactgcgagataaatttatgaagcctaattaatccgtcattagcaaatgtttactgtagcaccacattgttaaatcatggggcaattaggcttaaaagattcttctcgcaatttacatgcaatctgtgtaattagatatttttttcgtttatatttaatacttcatgcatgtgtccaaacattcgatgtgacaggatgaaaaattttgctaggggatctaaacatgtcctaaatataaatgtaagtaataatatgtttagttccacgctaaaattggaagtttgactaaaattgaaagtttgaagaaaaaagttaaaaatttatgtgtgtaggaaagttttgatgtgatggaaaagttaaaagttaaaagaaaaagttgagaagtaaacccggccgtactaataacatctatcctatttcatccatctcatcgtgaaattgatgatggtaggagtggcaagtcactaccactggtccctatagacatcacattgctataatagtatccgtgtcacattcattttcgttttagatttgtgtcaaatttatttttgttttgtatggcaacttcacttgctcggataaaagataataattttatgatcttaaggtatccacagtcgccctgagcgctcacatgagggtcattagtttattatcatggattacttgctcaatgtattttaaaatacgatttattaaaaactctttttccctattgtactttttagatgacttcttctaagttatttatgagatttataacatacaaatttatc

SEQ ID NO: 31820 - DNA, 1501 bp, Oryza sativa
caaaaggcagaggaagacaagaagaaagagatcagtagacttctagctcttgaggggcttgagctagatacagatgaagacgacaacataaatttcctaaagtaactacgcaaatgttctttcacaaattccatccacctctcccagcatatactagaaggtttcgccaaagttccatttagtgaatatatattgacgcaagaaaaaatgagctcaagggaaacattggatcataactgttggaaatccagaattctcccatggagcagaaagatgtggccaacggcgaaatccatctgggccaactgctgcaacctgcagcccagtgattcaatcaaagttctttatgcagatcctctattcattgtttccagcagatggactgtattgcaagggatatgactatcagatatgtatacttgttacatgcgaaattgtaattatgctagggtaattttgtaaccttcttgtttgtccgagcaaaacaaagtgcattctctgtgtggtgcctctagctctgacactttgtaaatactacagaaaacatccaaagctattgtttactgggcatgaataatgttgtttcaaatcatccatactcccttcgtactcgtaaagaaagtcgtttaggacaatgtttaagtcaaaccttaggaatataaatcatgaatgactctcaagttgttgagtttgaaaatgtaaaatttatatgaatagatttgtcttgaaaaaatacttttataaaagtatacatatatcacttttcaataaatatttttatagaaacaagaagtcaaagttgtgtttttggagaccgtgtcgctgtccaaaacgattttcttccaaacctctgaaaatcccacatgcagaagatggaaaatatgatgatgatggcatggttctaattttataaaatttaaatgacatcgttacaaatatacgaattataatggtatatctgaataagtatatttgcaatggcacatatcaaattaacccaaatttgtttcactggcctttgctggtagagcctccagcttcagcatcgcagtcatggcgtttgcagtagcttacgaattcgtaaattgccaatgaaaaatccaagtttcctctacctgactacctctcgacggcgtaacaaatcttgaggagaagcctgctattttgtacaaatggggggttttatatgcaaaagctccatccatcggccaatctgggacgctgaggtccgatccaacggtcatgaatggcccagtgctggaccgcgccatctcactgacatctggggtcaggcagtcaacggcgccacgtgacgtcactcgccctccccgtcgccggggatagacggttcggcgccgcaccatcatctccggcgagcttggcctcctcgagctcgtgagcgcaggcaagcctccacgatcgcagcaactagtgccacttccctatcccagctgttgttggaatatgaagtaaattgcttctcttttcttattagttactc

SEQ ID NO: 31821 - DNA, 1501 bp, Oryza sativa
tgtgctatagtgtactcaaatgtgaataagaaaaactatacaggacatttaaattctgttagcctcttccttttttatgaagatatatgcgagtttttgtgttctcattatcctttttaggtggttaactaagcgctcacatcatgtactttcaattgtttggcatttcattctcactgcagggtaactgggtaaggtggcctttccccagttttgagaagtacctctaattgtcgtcagctgttggttttcaatgtgtgatcttcacccaccttatttgacgccaaaaaggaaactacgaaatgagattcaatctgacagttgccattagtttgagactgagtgaatgagctgaccttggtgtcttcccaagaatagtgtattgagattggatttgcatcagtgcaattttttatttcgtctatgaaagtcaacattttaaggtactcctactccgttttttttcaagagattgaccagtgctattcgcaaaccgagatgatcaagtgactaatcttgttctgcccaaaaagaaaaaaaaaactaactagagcatgtgcccaatttattagaggcttatctcttccttttctcttttcatgtaaattgaatcatgaaatgagcctcgctaataattgggcacatgcttgcctaacaggctaacactaccaagttgcactgtccgagttcatcttgtagagtagaggcttatccacgcaaaaagagccaaagaagactcctagggttccaatctgtgcatctagccagactgcaacaaatggtgtaaggctcctgttttcactggtttccaccgaaattaggcagatgaaacaagcaaccaatatgtgatggcgatcatactagcggatctttaaattatcacatgccggcgtaaaacagtttttagtcgcatgtttggaaaggtggaaatgccacattgccagtattggaggacactttgctaccgatcgatatgttacagtaaattttgcccgtgctctttgtagatttactacctttggacttgacctagagatagaagtttatttacccttcagcgaaaagtaactttaattattctaatttactactctctttatttcaaaatataattttatatgattcaaaatttatacagcaaaataagtctttctccatctatacttctttatctcaataaattacaacaatttctcgtctcaaccttagtttctattaaaactctcagaaatgctcatatttttattgaaacagaggaagtaatttatattgcataccaaaaatgtaaacaaaatacccatcgacatagagggttgaagctgagatggacaagtctgtaatataatttaatctagaatttaataaaatggatttataggccatacacatatttcactccactccattcatatctagtactctactacgataaggacagtactacagacatagttaatgacagcatacccattcttattcgttgttataattaatctagtca

SEQ ID NO: 31822 - DNA, 541 bp, Oryza sativa
actctagaggatccattgcagtgatggtaaaattgtcctaaaaaaagttaagactaaaaaatcaatcccaatgcatatgtcccctaagatgacagttaaaaaacaaccaccatacttccacctttactataaaatgaacaaaatcaatccctatgcatgcacctacaatcccaacacgaaaatcaacctcccccatattcccacttactccacctttctgcactataataacaatcccaacgcatctgactaatatctagcaagaactgctcaaaaaaatatcaatccatcccacactacaactacttcaccaaaaaatccacacttcaaatcgagctaaatcacatacctcaaatgcccggtttcttccagcctagttgatcccagccgccttgcaatgcgccaccgtggtcgcagtggagctcgccggcctcgtcgccgtggccaccttggagcgcgccacccccgcccgcctagagcgccgcccagccccgccgcagccagcctcgccggagtcaccggaatcgccgcccattctagg

SEQ ID NO: 31823 - DNA, 323 bp, Oryza sativa
atgccagaaactatgtcatatcttagaacaattagatattagaattaaattaaattcatattacagagagcagaaattggtactagaattgttatgttgttagcattattatgttactctatattacagattgtttctgcattttctcagcactcaagtggaaaataagttggaaattcatgcatcgttttgtaattttaataaatttctaaactaataaataacccatggagatctttctcatacattgtagtgctgtcgaaactcaagtatggttgaattggtaccatgattaatcgtagcttcatgcactttcttttatt

SEQ ID NO: 31824 - DNA, 187 bp, Oryza sativa
tgattttggttgccttgaagctgcattgaggaacctttcatgtgatttttttgatgcacattgatcatccatggctgcgaaaaaccatgcgagatcccaggacttctggaggagattctggtccatgctgtcttatgcttgcagcgagctttgcttgatcatcctgctccatgtggccgcaggagca

SEQ ID NO: 31825 - DNA, 297 bp, Oryza sativa
gtggttgcatttttaccaatttttttgcggtgaaaacggtcgatcgccatgggaatttggccctcacgaaggtcatatcactggccgactttgggtcatggaccgtgatggaccaacacttttaggctgggcaattatccaaatacctaatttaaagttttttttctcctctaagatggtggttttcttaactatttgtcacttttatctatgtggcatgccaacatgacaagcaaggatagaaaataatgtgggacccagtagttagcctcacatccctttcatttcccctccagc

SEQ ID NO: 31826 - DNA, 1445 bp, Oryza sativa
ggggggggggggggtgtgccttcttggaagggttaccgtgttgttggaatgtgggggaaatcggtgaaaatgagtcggaaatcataggcaagtagtagatttgctggtgtggaatttcatcgcggtatcaggtgctactcggggttaggtacttgtggtggtggtggtagtgatcttagagcactaatctgtggctggtacaacatgttaggataagattctgccggacatcatatatgttcctcgcaaccgcatttcggtatccctggttatgcatatggaaagtttgcatgagcagatgggcttctgctatgctctaaaagctccctgtatgtgtgcaatcgattagttaagtttcttcatttttttttgggaatgtattctgctcaagtaatgagatgaacaaatgatcggcgagtatctgtgagtctggagaattttgttgtttctaaccataatgtagttgtatagcttgggcgtccattttggccttgaatttggccaattgataatttgggttggaaagttgcaattgttctggtcaggtctttaactgttacactaagctcgtccataccgtttcaagtgttcacacagatatctgctaacttaggtaggtagattagttagtatctttagctttcaactggtttctgggcactgacatcatgaacccagcttcgcatttccattaccatttcttgacaaacttaacatgcttattgtgcttaattttttcttttgtgtaatgctttgtttgtcatgagctggtttgtcctgacttgtgattttcttaagcttagtctgtaccatggttttaatcttaaacttcgcagttaagaaaaatctcagcttttgatgtgcaactaccactcatagtcttgctttgttgattttgtctgctacatgcctgtaaattatggaggctatcctgcaacctttttttacccatatgtgctaacagttaaatcttatgatgtcgctaatccacattagcttctgtttgggtatttaaacagaaattagcttttgaaaataaaaaaaatggttataaatcaacaacatcatgttgcagtgttgatctttgtaaaacaagttcgacaatctctccagagttttttagtgattaattttactcagggccatgtatccatatattttgatctatctgataacctagtgtaacctggactattagagtggtagtgtctatttttctccatgtcatatctcgcataataaaatagggttgtggtggatttgaaaattgttgctgtttcagagcaaatttgatctgcatgatatttttgtggtggataaaattatatgttgcatgtgttggtggacaagtaggcacattctgagtgaatatgagctgtggttttcatgcgttgcagtttttccccttctagtacattgattgctaatttatatgttgtatggtt

SEQ ID NO: 31827 - DNA, 1501 bp, Oryza sativa
ccaattggatcgccaatcgcttcggccgccatcaacccgagcaccacgtctggtcatctccttgttgattacagccatcgaacagttcagaccgctgtctgaagtgtccgattccattgatcaaattccgttgatcgccaccgtgctccaccttgcgtccatgtccgtccgtggatatcctgtgtagtcgtcgcggtgtggagcacctctttcgtacctctatcttggatctcccgcaggctctgataccacttgttataaaaaccagccccgaaatcgacatcggtagctaaacgcggaagaaaacgccataggagatccaaatatgatgacgacaccgaggcacgatatttgataacggagttcagccgaggcctacatctccagggcactgattacgggtgctcctccccgatccagcatatacagcgtatcagagttacaacgacatacggccggtcgccgccggcagccgctcactctcgctatggtatgtcgccatgcggttacaacagacacgcacctctatttataagagatcctaggatagagtccgactcatactctagtcctacacctagtacaactccaagtcctaaactgtaaccgactacgtacatatattcgacacaaactctaacaaactccaccttggcgaatatgccacgccaatccgaatctgttacttgctcgaaccttcgtgtaccaagacttgagttgatccttttttgccgctcacatcgagccgtcccgacaagccttcaccagactcaccgtaacaagagactccagaataaaatgaagtgttccaaataaaatgaaggtacattgctggagattgatccagaatggtttggccatggaacttgccatccaggaacaatggccctgttcacaattcagcacaaacttggcgaagaccaccgatcagctgggtgaaggcaaatactgattgggcttttgtgatggcacacaagtttagagcagtggaggtggtcatgcgaaatgacagtggaggttttatggcggcagtagcacagtatcatcccaagtattcaggacgctaccaccttggaattactagcttgtagcaggatggctgatcttgcattagttgggagtatctaaactaattattgagactggttctttggaagtaacgaggatggttgctcagaaggaagttagtagatcgatttatggatctggtacaagatctgaaattgaagctgagtcctttcaatagctttagtgtcgttcgggttaggagatcagtgaataaaattgctcatagattagctcaggcaggaatgtctttgagtagtttttctacctggctttcagttgctcaagattgtacggagtattacttcaattgtggctgtaagaattacaatcaagattaattgagtgtgagatgcatcttctcaaaaaaaaaaaaactcggtgattcaaaccattaattctctagccccatcacctagtcgagatgggaatcagg

SEQ ID NO: 31828 - DNA, 1501 bp, Oryza sativa
agctgaaaagtagaaaagtgcgctggcaaaggaccaaacggccactctttatcagggttcactgaatcttcatccataatactccgaaaaaaactctcttaccttttatgcatgctcagttgatctagaggctataaataaagcaagtctacttatgtttttcaggccactgtagcaatccatttgctcagaccacacacgagtgttgatacttctatttgactcaaatgtttctttcccttccattgtgtacctgatcataacacaataacggggaacagtactgaaaccaagaaatttaagaactggtaaaaatacgtgagcacgggataatgtcatactccatcttttggtaatggcaattggcactactcgtcgattgctcttcaaaattacacaccacatgaacctgtagagcattattgttttttgatgcaacagtaaacacaccagctccatcttgtcatgtcacattgacaatttcccacttatatagcttccttatctcagcccaaaccttcttgaacatggtcggtgtgtaaatgtgtaccacacttttctctaatgggttagcacatattgtagactagtgaatgggacagactgtgaggctctcgcatccagcttggcttcattcctacggatacgtgataagcaaaattcatagttctcaaccaaatggactagcgacatctttcgatcaagatgcctatgcagccttgagtttaaagactcgctttgttggttgctccgcattccaaggaagtgtttccttttcatatatgctacggactacttcttccttaattcgtatgtcatgcagctcataagtcattttcagtgaatctatacttgtctttatactcaatccaacttctgtcaaactcatcagcatctatattatcataaaggaatttcttgaagtatgcaagcttttgccaacgaaggtgacgtttcatattctcctcaatgtgccaactacacaatctattatcagtattgggcataaccttcataattgccttcgccgttgatgcatccccgtcagtgatcaatgactttcgatgtttttggtgcattgcctccaaaagagtttgccacagccaaacatatgaagaaattgtctcatttgacaaaataccacacccaaaaataattgtgttgcaatgatggttagcttcaacaaaaggtacaaatggaatattgtaccagttcacacaacatatactgtcaaatattaccatgtcaccgaatgcttcatagacaagctgtgattgactgtttgtcaaaataaattccttagacgccccttttttgtttatgctatatctaaagaagacctgggtcttcttattgctgagccatcagatggtccaccatgagatcagcaaattgggtgccttcaagaatagcagagagaggatgtggacaaaagtttcaggttttaaagggcagggtttatcgaatgcaggaaaagatgtgtaaaaaaaatcagtcctat

SEQ ID NO: 31829 - DNA, 1501 bp, Oryza sativa
aactatttcctccgtttcatattataagactttctagcattgtccacattcatatgcatgttaatgaatctagacgacatatatgtgtgcctagatttactaacatcaatatgaatgtgagtaatgctagaaagttttataatctgaaatggaggtaatacagtttgacagatcaaggatatgtcttgatgtcataatgttagtattgatttattgtcgatgtgcatcccttgcatctaattttgctcaatcaacaactttggttttaactcgcacaatgcttgattcaagaaagagattaacaaatagaaaatgcttttgtaaaaggttaatgctagcatcctctatttaccaggaggagtatcactagaggtgctatatttaattgaaatgaacaagtcagccatactatcatgcgaatcaagttgaagttgactcctccaaaaattattccattagataaaggaagaattaatccatcaaaacaaattgcatgccgtacaagaaaaggtcaattgaaagaggtcattttaatcaatccatttgtcctctttccatgttcaatggccatccccgattcccctctttaactaatgtttgaataatttcttatttacacttttacataaaataatattccattttctctattattataattctaaaaatacctccaacaacacaagtaatcagaattacatacatcgtcccttaactcaacgggagacgataaaaagatcaacaataacaagagaagatgtttactgcaatgcttacagtcagcgttggatttaaattttagaatctaatatcgaagaaaagttactagataaactattaacccataacctcatcgatatttactctcttattatacagtaataatacaatcttaattcatcataccgagttatccaaaaaaaaatcatcatacggtagaagatcatcatcattttataattcttaaaagacacacacagacaaaaaaaaaaaaaggataaacagagaaagtaaaagttgtccaaactcgacagggaaaatttgcaaataggtcccacaacttttttcaaaatttcctcgtgcgcgaaaacaacctcaccagacacaaaaaatactccctcgctccatttccagcactacggcactacccatttctattcctcttcacctcgcggcggcggcgcggcgagcaatcggcgcctctcctctcggtctactctcctccggccatccccgttcatctctactcttcactccatcctcctccactccaccgtactgccctggggtgcagatcaatcgagacttggggctgatttctcgagttggtgacgaaccctaatttcgtttggattgttgcaagaggtttgtcccgccctctctcttagctgcgagcgatcaaattggcatcgttatcactgggatgagcgcaccgatccatcgagttcgtcgcggatttgattggttcgcggcggagcacgagtagcagttcatttccccc

SEQ ID NO: 31830 - DNA, 1501 bp, Oryza sativa
ctaggaaggccttccaagaaggaaaggagaagagagccacatgaaaagcccaaagcaacaagggtgtcaagggtagggtcagtgatgacttgaaggttgtgcaaactccctgggcacaacaaggcttcatgtcacaagaggagacagcaatagcagggcaatgtgcaggtactaacttgttcatgcagattttgcttcaatttattactagcacagcatcataactgatattttctctcaaccttacaggctcaaggatctcagccaagctctacacaggattaggcacatgttgcagccaaggtaataatggcttgcttcctgtttgcacttgcttcagtcatatgtctaactgctaccacttgctgttgaaagcttcatcatctcgaaagaggcagctaaaagcttcaacatctgcaagggcagctggaatggttggggttgagcagccaagaaagaagttggaagttaggagatctcctcggctaaacagaggatgaataggatattaggttcataatacttttggacatgcttactggattagcaataggcagaagatcaccaccttttgtagagtaacatgtggtatgaaacttctgtaatatgatatctgtggcatctaataggccatcttttgtgtagtaactgaaggaattacagtgctctaaagtttgaagcaacctgtgacatttactgccaccactcttgtttacttgctgatgtaatcagatacaatgggttccagatgtggcaatatatgtcattattcatcatcacttttgctgtttccattatctccaattgccataacatgcattgattcccagtcacccaatatggctggtccatttgccagtacaggtcatcaaatcagctgatttttaactgtcatctcaaacaaaaccacaattttgcattcattccaatttgcaattacagattctagtagaacagctgacaacacaacaattccattcattccagtacccattacagattataatagaacacctgacattttcttaactccacactgaccacctaaaccctaactttcatcacaacctacaattttagatacatagttccaaccaagagaacaacaacagctactaaaacatacaccaacatcatgatacatgtctgttgtttgttaatcctatcaactaaaacacaatttgcagcttccatcttctctacagcagctcttagaccctgaacctcattgctttctttcttgggggtagactgcaagttgtgctgggctactgtcctgtcccaaagtgcagcctccaggccattcacctgctcacgtgcagaccacacagcattcctcaaatcaagcaacagttgcttcatatatggttttgcctcaacagttgcttcatatatggttctgcctcatcatcacaccactcccaaaatccgcagcccccagacttcacaaaaaaaggggaagtgaaagagtcaatcccttgaaaacaaatctaaaatgcaa

SEQ ID NO: 31831 - DNA, 1501 bp, Oryza sativa
aacatcttttcataggcagacaaatgaggccctcgctgggctttcccaagaaagcgacttgaacttgaattcactaattcgatgtccatctagttggaaataaattttgactactctgtgccctgggactagtatatacgttcagagttgttctggttttagaaaggggcaccttagtggagtacaagaattgttggtttgaactttatttcgtcaagacaagatgccgactactataaatcctccgactagtctcttttactcggaccaattgctctaatctcctatacaaattgggcactttctacgagctttgtcgtaaaccaaaaaatatgaccatttattatgttattcgaacaatcatgaccttagattaatagatcttacattacaggcatagtacgtacatatatcaatccatgtgcagcatagtacgtacgcaacaaccaaaacctctcagatatatctcctaatctcgatcagccacagtacataacaaaaaagtctgtcaaatagatctccatatcaatctgatattacgacttccacgacttcaatctgatattacgacttccacgacttccactagtatgactatgccaggagcagctcttggaatagagacaacagggtacatcatgcatatgacgtccataattctccagtgtagggcatgacgggatttttttcagttccaattatactttattaactagaaaggtctggttaaaacttagaagcatgttgcaaccatgatacctctcttttcaatgaaagatccaaatagaattttataattttaattatgttgtttaattaaacgtttcctatctgaaaataggtcgaccaagtttcagatcctatctgatgcacgatgcaaagcacattgatacatgcctacatggtactacaaagaaatttcagtccattagtctcacaggaacaactttcgagatttcttcagttggacagcatcgtccagttgacaatgacgagaaaaaaattacaagttttcttaaacgttagcaacgttcctaaatcagaacatgcggagtccattaaacatagcaaaactggggacctatatgaattttcaagcattgatgtttttttccaagagaataaatagcaaaacatacttatcaggtaagatgttgtttgctagactatttcctgccagcaaaattaattacttcagttgcttcatattaactccatgtttttgtttttagatgtcattggcttcgcaccatatgtagtaggacatatggaagaaatatgataagtcatggaataaggaaactcagtgacactatactctgaattttgtgagttaaattaaaaccagttatagctgcaatttttttactctcaacatatgtagtgattaattagagatcaatgaaaaggatatgatgcaactctctttgaaaaaatatgcttcagaaaacactattgtaagcgaataaggagagttgttaaaagctgggaacgattgaag

SEQ ID NO: 31832 - DNA, 385 bp, Oryza sativa
caagtctatagtcctggcagactatagtcggaaaaagaaaaagacagtcacaccacgtgtctacgtctgatcctgctgctgaaaaacaaaaacatgcactcaacacccggaatggttcttctaaatgacgcctccaaggaggaaatgacgccaagagcaccgccgccgcccttcctagagaacaagaacgtggttttcacttgaagaaaccattgggagaatagagaaaaatgcaacaacgccccaggaggaaagaggcgcccgcaagcgtcaccgttgccagcccgaacactaggctttcacccgtagtttcatactctcccacgtcattgagtgcatgtcagattcagcaataaccaccagctaatccccttcaacgcgtagg

SEQ ID NO: 31833 - DNA, 1501 bp, Oryza sativa
ggccatcggcgcaactcgacaaggagggcgacggagccggtgtgcaccatcgacggcaagggagggagggcgcgacggtgagggaggctagcaaggagttgatcccgtcatcgcctcatgtgctcgtagtcgtctagcgtcggccatcgtcgcgtgaaacagcagtggcgccgccggctccccatccactcgccccctagccttgagccgccgcctcctcatgcactggttgggaagagggccgtcgggtgggtggggatggggaaggggaaagatgtggactgtggagaaagagaagggaagaagaaggtagatattggcatgtgggatccactgccagattggagaccccccggcgctgctacccctattcaacatgtacatacggtaatatgatgaacaatactcttgtgcgatctgaatctttgttattcaatctaatgatggttagagcaagattaataatgaagtaagcagcaggctataattttcatccgcatcagatagagataatttaccgtctctaaggtactactataatagctaactgcaatagcacgatcaaaatttttattttactcatgttaatctctctcctatgctttcttccttgttcctattcgttgggcccacattgctgcgttgaatgcgttggagtagtagagttcactacccgctattagtccatcttaaaaccaatatatatataataaattaactatattattgtttctatattttcttctcactatctctctcacctactgtatttaaagtatttgtcctgaagcacgtgttagctagattttgcattagagccaacaccttttatttttggttgtttcactatttcgtataaatttatagtcagtttatagctcgttattatttttgctcttagtcacccacacatctctcttcttaagttctctctcttccatctcgacaaaaatctaacttggcaattgctatcatcgactgatgtaataatcctattacacttgctcctatatgaatgcaaaagttgcatttatactgccatgtgtttgtgatctcaattcaagtctgtgtttggcagctgagtttcccagctcatctttttttttacatgcatgtttttcaaatagtaaaacacgaatatcagggaaggatctaatattaaaaaattataaggggtgagacttcaaacccaggtcgtctagcccaccatcttattgagctagctggaagacctctgggcgtttctcgttttttaaatagttaaactgttaaaagaaagttaatacttgattaattaggtgcttcttgtacggtaggttatttcccaactgcaaggaacgaactcagccgagtagccgaccaaaccggctgagctgagctgagctgagcttgtgccggtactacgcgtcactggagctagctagcctgtccgaatcacggccgcccaaccgttggatgcagccgtgcagggggacagatcgatccatactttattatactc

SEQ ID NO: 31834 - DNA, 182 bp, Oryza sativa
gcttatttaggtgcttatgatcttttttgttaggcatatatgtagctggtattagacagaatattgaggctttaggtctggactttagcagcaatagagaggtttttgggctgcaattatttatagttgaaagagaaacatatataacatttttttattctaccgaactttcatgtgacagc

SEQ ID NO: 31835 - DNA, 331 bp, Oryza sativa
  unsure (1)..(331): unsure at all n locations
agcgacgggagggaggaggcgctcggcgtggttcgggcacgcgcgggcagagcgagggagagagagagagagagacgggaagggagatgggccgagagggattcggcccatcgaacccgggggaggcgaaatagacttttgcggagggattaatttggaaggatttggattcgggattgaattcgatgatagatcggggatttgagatctgagatggcacggacactagaccacaagcaaagaaacagctttcgcaaatagggtttttaagaatagtcctcccgccaggcgccacgacggaacgggcgccacatnctgctttnttcacagt

SEQ ID NO: 31836 - DNA, 455 bp, Oryza sativa
atgagccctacaccatttgacaactggaggagaccgccattgccatgaaatactttaggagttatatggcggcaactggaggacaatgcaagttcgataatgcttcatgtcagacgcaagaacaatcggacgcccatcgacatgaaatctgattaggcccaatcctactcaccaacagagtcatgagagagaggatgggaatgtgggctcgctcgattacttgttgatagcatgcatattatgattcttccaaatgattttccttcaaaaccatcaatccaatttatgatctgattataccgttatattcattgtaatcaaatctttacaataagatctcacattattagtctgataaaaaaactttatcattgtttcatcgccattatagtccaggctcaccagccgctcttcgcccatctcgcatcggcgtcctgcccttccctcttaagcaa

SEQ ID NO: 31837 - DNA, 1501 bp, Oryza sativa
cacgtagtgagcaccggaccagtgcaggggcacgaccgcgcctcctggcggcgccgccgtcgcgtcggcgaggatccggccgcgcatgccttgctggtctagacctcgccggaggccgtgcgcggcggcgcacgtcgtcacggagatcaagcagagcacgagcagttgcattggcgccagccttcccatgattatgctactgttagtgagtggattaatgagtggattaatgaccatggttatcttcttcctcgagattacacaacacaatccatgcaactccaggctctcgatgtatggtttgtataaaaagtttaaaaccaggatcagatcaccaatgtcaaataggcgttttttttaatcaaagtcaataggtgttgacagtgtaaatatgagccatttgagccttcatggagtcatcatctccatttcaatattcattaacgtttccatccaaaagaaaaaagactgaatctgttcatgcatggagctagccaggtaggaaattatcagaaaccatcgaaacagcaccatggtgaacgaacgtaccattcaaacgtcagtgatattggtatctatatttttttaaaaaaattgaaccttcctctaataaaaatttaaaaataagcctctaccctctctatcccataatataaggcgtgacatatttcaagattcaactacaaaagtatttgaccaacaattattgtgtcacgccccgaactagtcccgaacggaactagctcgtgacactctaaattaacctgttaatcgataccagtcctaggaaacagtgctggtatcacaggaagacagaatatcacagcaacagaggtctctttattacagagtaggagtacagtcatgttgggctgcggacagatcccgagctcacaactgcattacaaaagcgaaagcggaagccaagacttagaccaatcatcacatgcgtgacttgggaatagaccgaaaccctaaaactcatcatagctgacttactcctggaagaactcctcatcagcgggatccactccatcttctccagcaactggaggggggtattatttatatagagcaagggtgagtataggagtactcagcaagccatgggaattaagtgtttaatgcaggcttcaaaggaaaggctgttgtttttgcaattgattttatttaaactcctttttgaaacaactaagcgagtgcttctcaaacgacacgaatgagacagtgcgtctcgtccggtcggagtatgtgcagtgtatcagtctttgaattgatcaaggttggcacccggccaacagctttcaaatggccacccgggcctagctgatcccatcagccgcagattttctaaacatcgatcccattccacaacagcaatttcacaaagtagtagtcaaacaaaactacgctaggaatcacctcacatctgcccatgaccgtgggcacggctgttcgaacagtttaataacctctgcagagggggtacactttacccaca

SEQ ID NO: 31838 - DNA, 199 bp, Oryza sativa
aaggtgtcccctcccctcccctcccctccccgggggcgacgggagcacgtagccgccggatccggcgggcgggcgggcaggcaacgacgggtggctcgcggccgtccccgcacggatccggcagcagcggccgtccccgcccggatccggcggcagcgtccctctcccacccttccccgctcgagggcgacgacgacga

SEQ ID NO: 31839 - DNA, 1501 bp, Oryza sativa
ttcatcctctattggtgtggccccacatgtatatatatatatatatattaaaacaatctgaacatgaacttcatcgaaagttttagaatttttctgagaatagttgtgagaagaaaaatagttatgactacatgtagatatttaacttaaaatttcacctaaattacaaccttattaagcagccagtactaagaactggagttcaaaagataggcaatactaaaatatgtaattgctctcgattgatgctattgtttttgttttcttcgctttattcaggtttcctgtatggtctaacatttaataagaccacaccattatattagcgtgatttcatggtacttgacgaggtactagcaggtggtatcaaccttcctaatgaaaatttcattacatcttcacaaccattgtggtagatgtgctatatatggcttaggtgtgtcatgttaaacagaacgggtagagcctgtgagcgtgttgcatgcacctttcagtgttatactttgtcatgacaaggatatataatgataatctcccatgttgaacagtaatcagcctgccaaccggaggaagagcacagcgacaacaactcaacttgaacaagtatatatatcattccagatgtacatacaaccatccccaataggacagggaggcaacgggagtttgatgcctactcactgtaagattaaagtgtgttttgattcttattctgtgatgaacaattggcatctatgattattggttttgatatttggagattatcgtcgaaagtggttttgagataatcaattttcaggtgatgatcgaattcactgttattttatgtgaccggtccgaccgggtggtgtatgccggtcagaccggtggtgatcgagcggtcagaccagccggcccgcggtctgaccggccgacgctgtgtcggtttcggtttcgggttgtttctttggatatctgtgattgtttcatggttatagcttctagatggatactatacgtatgtaatactgttgtttgctaacaatgagtcaagttggggatagcttggtcttagaatatgttttctttgtttatttcatgtgtaggtgacccgatgcctcgggagagtatttgcggtgatggaccgggagtcggcttggtggtaagacaatgtccgtggtggtcagatatcatgcgggatactaaggctagagttgatgcacgtggttggtgaagattccatatggcatacgatggaggtattgtgtgcgtatgggatgcggagtcgaatttggaaggagtccaaatttggtacaattggttatgtaaagtttgtgtcttgtactagagggtttcctaaggtgtttaggacacttagtatgagtttagttcatggctttaggctgcctacctcatgtataaatagagggggagcgtgaggcttcccggtatcgcttttgagagcaattgagttgctagtttagttagggtttcgagtttagtcgagatttttgtaaggagt

SEQ ID NO: 31840 - DNA, 1501 bp, Oryza sativa
aagcaaaattgagtttctcgactagctaacataaccctgtcaaaagaaaaggattgctttatttggtcgctacataaaatggcaatttttcggtcaaattaatccatgtataatgcgatcatcaattccaatggaagaatccataagaggatcttatgggaggtaaaggtaccactaaaaatcaaagcatttatgtggtttcttcaaaaaaaaagtaattttgacgaaatataacctcataaagagaaaatagagggaaaacaagcaatgttgttttttaatacacaagaaaccatccaacatttttttctttgactgtcatgttgcatgttttgcttggcgatgtgtcttctttgccttcaatattccctctccccacaatgcaaaagatatttttggtaactggctaaggggagtgcctagacccacaaaaaaatgattttatttggagctagtgctctatgttggtcaatttggcgttgccgtaatgatatggtttttaaccataaaaaaatgcctaacatcatgcaggctatcttcatgtgttccaattggctccactcttggtgtatgatgctttcacaggaacaacaagatactatgtgcaatggtgctacacgcttggaattggtagccaaggaacttttactcaagtttggatggcgtagtacctacagaatttcgtgatagaatctacataattttaaaaaacattattttagtagatcatattatctgcagaagttgggagtttgtcccatctcgccttttttaagctcttttctattcacttctggactttttggctgtgtgcctacggacagaggccagatatgtaacccattttcattatctagacatggtttgatatcccgcaaatgcaatgcactagcttaaatggtttggcttaaaattcttttgtaatactacctgtcatacaatacaattaaacatgttaatatgttatatatagccgtcgttagttcattggtacgttcggttgcttggggcagtgaaaaactctacacagtttagctcaaatggatacgatcgataaatgtaagctagggatgcctctcctgcaggtagctttgatgctttcttgaacagatcgcgtggaaaaactctcgcactaattaacagaactagaacctacggcgcgcttcgcggtgcccttgctgtgtaaatgaggaaaataaataaggaggccctgaagagcctattcagtggattggctgtagcaccgctagctatagcattcaggttgtgaggaaaaccattgatggattaagtagacataaaatacatagaccgaatgttaacattgtttgtggagaacaatgcataatctagagtacattatacatcacagatacaaccattggaactaacatcgataaataggcaggaaattatggggtagattggtgagggccacgcctgcgaaattcgagaggaagacggcgtggaagcgtggctgggggaccaccctagaggtgtg

SEQ ID NO: 31841 - DNA, 807 bp, Oryza sativa
accgggatcttggtacagagccatttgctaaattcatgaacaactgctatggtagctatagccagtaacaaaggacacagactggaagagtgtggtggagagtttctgaccagagcttgtccatggcaacacagtttctcctgttctggctgttgaggaccttgtacaaccacgggctcatcacgaaccaagttgatggctcttacaaattaaattgcattatagaaaaatcagagacgtgaaaggaagaaacgaagagatcatgatgagacatattcgaaatgccagatcagccggctccattcaacacagccgtaaatggcagtctatgtcctcctctactgaaccaaattgctccagcttctcactcctttgaattcatgtatatataatagtcccacaaaacagaacacaacttgcttctcatccatctctctcatcaaattcttggacggcatgcagtatatgaggaggatatatggtgaattggtgataggccaatgtttgcaagtctcaagctagatagacaatcgtgtccaataggaaagggaggcaccgggagtttaatgaagacacaatctgttctaagcaagcatgtgcttccttcagtttgcagccgtgtgtgcttcgtcctgttagggcagtacgtagcagtacagcttctcatctgttggatcccactagccagctaggctcaagttcctaaaaggacataggtcttatagtgctatgtagcaacagtgatttatgaaccttggacgcaggcaattagttacgataggacatgaccttcacagtgcggccgga

SEQ ID NO: 31842 - DNA, 1501 bp, Oryza sativa
ttgtgctttcagtggtaggcgacgtgcccgtcgacagcgagacgcctgtggtgactttgtcattctcgaggatttgccggcccagtctacaaaaatactcataggggtagggtttgcgtgcgtgcgttcataggggtgagtgcgcgtgcgctgtgagtgtctgtattgtactgtgtaattctcaaaaaaaaatgtgtatgtaagacactcttttgtccacaacagatcaaacgcgtccttagcttgtgcatgagtacaacatatgggaaggggtagcaaacacatgactctccgccaaaaatggaagttaacacatgactgttgcattgatctggaattacacacgtagcaaaggatgcaagaatgtttacagaagacatgaacttgatcgaaaacaaaaacatctaacaagagtagagcagcattgcaacagaccattgggtttgatttgcttctgaaaacaaaacaagtgtttgcagcaacatctgttcaatatgtttgtgttgcgttaaaacaacagtgcaacacacgatggattctcaaacaacttgttttatatggatttcattctttattctatttgagattagcacttcaatttccttatgatttaagattattacattattttcattgttttcacagggaatctccttatagcttggactcgagctttgttggttggttgtacatgcccttagaagttaccctataatgtataatgcaaagatcttgaagcacctatacaaatcgtgtagcttaattgcctgttaattgatatgaataatcattgggtttaaataaagtagttattggtctaaattcaaatttggtgcttttaatagttgtagtagtctatctacctctatcctatagttcaacgaatggttttactcattcatcatccatcatgtgacacatcaaacgatccaaaattatccaatgacttacatccgacggcagcagaggcgcacctctcctccgccccagtctcctccccatcccctcacacgacgcgaatctctgccaaacctcctgcaaggcttgcaaccccgtcgcctcgctctcacggtcgcgctgcatcgtccgattcgacgccgccaagatcgctgtcgcttgaagtccgcggcccccatcggaccagaccacctcaaacgctagctcctctttctcaagcaccgttgtcaccagtcaccaggcccgatggaagtggcagccccgtccgtgtccctccgtgcgcccggccgccgcttcgcatcctggcgagaaaaaaaagtggtaagcttcctattccacggtgaaagtttggatgttgattctaaaaaggaagaacacttttctctcccttgttcctaagaaatcctgttccgattagacaattttatcttttctaagaaccgtgagatactgattcttggagatgtaagatgttcaatagtaaattagtccatagattatactctagattaaaattaggtttaggagactcctccacggattg

SEQ ID NO: 31843 - DNA, 1501 bp, Oryza sativa
ggacagtgcaggtgatgctcgacgatggcgggcacgccgggcgcacgacgttgaaggcgatgctgatcagtttaagccttaaggcacagggagaacaccgtcgtggagctagcaagacgccgttggaaaacgacgtagaattcctgcttggccactcaggtcctccatccttggaagaattaatcaatgactctcttttttatgtgaagcctcttctttgctgcagtagtatgagctaggccacatgtgcgctcgtgatctgaagttatttgcagatgatgaggcatctcaatgttgtctcttagggaggatagtttggcgaatgaatagatacgattatcaatcatcctgctgctgttgatgctctctataagaatgttgccgagctggagtttaggcaagagtatgcgtcatctacaagaaggttcattttactaacaaggaaagctagatcaacggggtggcacgtgatgacaactctgcacatccattgtaatcagctcggttggactagttttgtcaccgacttgaaggcagttagttttcatccctttaggaggtggtgatgttgtactaaaagcaattagtaagtgaagtgttaaggcctagaaattagtgagttccggagttaccacaccaaagggaccatttcttcatgaatctatctcttaccttagatccatttggtagagctctaactcctaagttaatttcttcatgaatctatctcttaccttagatccatttggttgagctctaactcctaaatttagatttgaatcaggggtggagttgtgaagccctctaattcacaactcaaaaccaagcttcaccttcacctttctaattcattttgttagagcactttaggtagttagatgctaagtatgcccactatttttgaaaactcaaaaccaaacaatcgattaggggaaagtgcatttccatccctcgttaattggataccccaaaatactttcggatgaaagctaccacgatatccataagctcgagtgtggagattatggataccccatacccacacggcatatatatccgactaggtatgggggtaccatatatagatagaatatctttaggggactcaggttaaattcctaacttatgtattaaggaaatacctaggatactagtcggttacgattgtactttatctttacttgcctattccgttaagaatatgggctatatgttgtaatacgggctcctcccactatataaggaggggttcgggtgcctcttggggcataacttttctcccagatcatacgatcgataatacactcggcggatcaatcctcggacaggagtagggtattacttctcgttgagagggcctgaacctgtataaatctcttgtctccaaacccatccacttttcctgcttgatagccaccccctttttgtattgccgaaatcttgtttcgacagttggcgcgccaggtaggggctgcgtcaagcttctcgccgattagtgcga

SEQ ID NO: 31844 - DNA, 1501 bp, Oryza sativa
tatagtgtatcggtttcacacctgctttacactggaagaattttagagcgttttggtataaattgcctacgagattttataaaatttgtgtgttccaaagaaatcctcttatattggtgcaagtaatacatggtttcacctgcgcttgatcgttcttctattttgccatataagagtattgttcttgtgttgatttggcccctataggctgacaagggcgctgactaaatgaaatgggcagggtgataagaattaagaatacaacagttggaaaagaggcaaaggaattaagaggaagcagaacataaacggcgggatctggtgttcgcgatgagtatttgtattcactggagtccgatcacaactactaccactgatcactaggcccatgttattaccaacatgcgagataaacattgcgcatgtcctaactgaactttttgttgggatcggtaaaaaaatgctcaataaatcaaccaacctcaacaaatttaaatttttattatataaaaattgggaaactgtgcgttgtagttgtagatggtcgattactagtctaaaaatgatagaattgaacgctcctttcatttgttaatttctctataatcagaactgttcaacttgagttgctaacaaacacaaatctcaaccatgtaatttttaagaaaaacaagctggttaaccggccagctcccacgagttgagtttcgttataaatttatgagttgctacgagtatttttaaccttttccaattatggtttggaaatattccagcaacttactatcgaaatttaacttttgtgacacatcactctctttttttcgcctaaacgataccactctggcactatatacaccacgcataatataagcctcgacaatggctgtggcgtggtaccaacaccatatttgccacaccgttgatttttggaaaaactattagaggtttatttttaaaatttctattagaaggttcactttttttaaaaaaaatatatccttattgcataagtgacgttagattgatgtatcagttcaggattgaagctaccatttgagtggtttctgacaatttcctatatctagcaccatgatcagatatctaacaaacgctactgaatcccattttgagttcatgaatattcaaactgatggagatgatgactaaaaagtggccagtaattacagtgtcattgtctgtcttaaatcttaattggtcctggtcattgcatgaaccagctatagcccctatataatcactattcactaccaccgatcgtgtgatcttgaggaagaacataatcacggtagctaatccttccctgtcgaagtaaccatgggaaggccagtggcaacactgttcgtgctgtgcttcatctctgtgacggcgtgctcgctctcggagcaggccacgcgcggccgcctcctcgccggcgtcgacgcgacaccgccggcggccggaggcgcagtggccgtgcccatctacctgtcgtcccagg

SEQ ID NO: 31845 - DNA, 367 bp, Oryza sativa
taatgaatagtttttggttggtaactttgaggcatgtctctcgggagcagaatgttgaagctaatgatttggctcagggggcgttagggtacaagccgatggtacaagatattgaagttgaaattgttgccattacaaccgatgattgaagatatgatgtgtgtcgacgtttgagatcgcgactatggtatttggatagtatgaggatcgttggtaccagggtatatgcgagattgaggtaaaagagatggagacataaatttttatataggttcgggccccttatctgacaggtaatagccctacatcttgttggccgaagccggtgttgctctttattcatctggatcacacaaatacaatatat

SEQ ID NO: 31846 - DNA, 1501 bp, Oryza sativa
ctggttgtagatcacgttgatgacctcgtggtacgtcttaagcctgtacagctccttgaagtagtccgaggagaggatgttcactgacaggaccttctccaggagcacttcgggacttcaatgggcctcccagatgactgtatctccatcaccctctcggaaattaacaatcaatccatcaatccgtggaggagtctcctaaacctaattttaatctagagtataatctatggactaatttactattgaacatcttacatctccaagaatcagtatctcacggttcttagaaaagataaaattgtctaatcggaacaggatttcttaggaacaagggagagaaaagtgttcttcctttttagaatcaacatccaaactttcaccgtggaataggaagcttaccacttttttttctcgccaggatgcgaagcggcggccgggcgcacggagggacacggacggggctgccacttccatcgggcctggtgactggtgacaacggtgcttgagaaagaggagctagcgtttgaggtggtctggtccgatgggggccgcggacttcaagcgacagcgatcttggcggcgtcgaatcggacgatgcagcgcgaccgtgagagcgaggcgacggggttgcaagccttgcaggaggtttggcagagattcgcgtcgtgtgaggggatggggaggagactggggcggaggagaggtgcgcctctgctgccgtcggatgtaagtcattggataattttggatcgtttgatgtgtcacatgatggatgatgaatgagtaaaaccattcgttgaactataggatagaggtagatagactactacaactattaaaagcaccaaatttgaatttagaccaataactactttatttaaacccaatgattattcatatcaattaacaggcaattaagctacacgatttgtataggtgcttcaagatctttgcattatacattatagggtaacttctaagggcatgtacaaccaaccaacaaagctcgagtccaagctataaggagattccctgtgaaaacaatgaaaataatgtaataatcttaaatcataaggaaattgaagtgctaatctcaaatagaataaagaatgaaatccatataaaacaagttgtttgagaatccatcgtgtgttgcactgttgttttaacgcaacacaaacatattgaacagatgttgctgcaaacacttgttttgttttcagaagcaaatcaaacccaatggtctgttgcaatgctgctctactcttgttagatgtttttgttttcgatcaagttcatgtcttctgtaaacattcttgcatcctttgctacgtgtgtaattccagatcaatgcaacagtcatgtgttaacttccatttttggcggagagtcatgtgtttgctaccccttcccatatgttgtactcatgcacaagctaaggacgcgtttgatctgttgtggacaaaagagtgtcttacatacacatttttttttgaga

SEQ ID NO: 31847 - DNA, 1501 bp, Oryza sativa
gacattatcagatggcgtggggcttattcaagggcatgcccaccatgattcaagggtattcagacgtatatcaagaattatataaataaaaaaataagcatatatactatgtattacacgtatctatatatttttaactctactattataaaaattaaagatgtttttgtcaagattttgatacgtcatccatgtttgagtaggttttttaattatatctgtcgtggctcatgtgggaaccaacaagcttttaaacttagtccgactccaattttggtccatatgtccatcgtccgtatgtatcccgctcacgctcctgtccgtcttgccgatttttctttctttcatgtgcgttaaggattcagctttgtggagattatgggtaccccatacccacacggcatggttatccgagtagtgtagggggtaacttatatttatgaaatatgtaacagatcatgacttgggtattacgtttccttgtatattatggaacggactaaagttctggtttgataagattgtaaagtagatttaggaaaccgacaccgtgttggttaaggtttctatcttgtaatcctgccccccatcctatataaggtagcaggaggccctctaaggggcatgaggatataagatcgtcagatctatactatactcggcggattcaaatccccaaacaggagtatggtgttacctctcattgagagggcctgaacctgtctaaatcccatgtctccgcatccatccacttttaggtctcgtgcgctacccccttttattattgccgaattcatgtttcgatagttggcgcgccaggtaggggttgcgtcgagtttttcgtcgagaagtgcaatggaatcaatttgtctggagatgtgatgagatcgatctcaatgagttcgacggtttcaattttccactcgggtttgccgttccaatcaaacttttatcagattagtttttcattactatttgatctcttgatactttctggttctttatatgcaactatgagatcaaggctaagcggtcggtgacctcgcccatccggccgctgatccgaacaccgtcacgtggtccagcagttgtccctgcacgcggagcagtgctgaacatcaagctgtcatcggctacagggggttatacacgctgcatggcgcgtcgtcggctgtcactcatgattcagcctcattgctcgatccgagtttttcgtttcctatccatatatattatatttatttctaattgcagattgatctgttctagcactactttttttttacagtaccgtcgatgccaagtgatagcttatttttgggcagtactcgtgcgtactccacctcggctatggaggctcaacggccacgtcatcaagttgttacaagttgtacatgtatatatgcacaaatatatatatatgcttgggctagcatacgaacacatggatctgcatctggagtacatgtactccctaatggcggttgtttatctaatcgcc

SEQ ID NO: 31848 - DNA, 726 bp, Oryza sativa
ctggctcgcggggcagggcgcggtagagcagcggctaggcggcgcaggcgcggcacgggcggcaccggcgggcgcgcgcgcgaggcaacggtgtgcggggaactcgaaaacgcggcggggagcttgccagggatggagcggagagagagaacgagagagggggagagcgctcggctcggcgtcggctcacgcgcacgcgcacgcgcgtgcggcgcacgggcagagcgaggggaaggctgtgtgagagagagagagagagagatgggccgagaggggaattggcccaccgaacctgagggaggcaaactagacttttgcggaggaatttgaatttagaaagatttggattcggaatttgaattcgacgatgggtagggaattcaagatcagagattggcgcggagactgacaacaagcaaagaaacaaatttcgtaattagggttttttaagaattaaattttcccgctaggcgccacgacggaacgggcgctatatattgtaatataaattaaattttatttgctaaacttaatatcattatattgacatttaaatttactttaagtcaattataattttgttgcaataaaccttatagtacatgaaaaattataagtcaaagattagttttgaagactgtaccaagtttaagtttaaccatatcttatattatattatgagatggtgggagtaatatttttttccaaccaacggtgtggtagaca

SEQ ID NO: 31849 - DNA, 1501 bp, Oryza sativa
tcttcacggttggcctactacgcaactgctgagagaggacctcatcgtaatcatggttctactttctatgcttgaagactggatcaatcattattccccgtaaaagctatcaaccgaatagttgcgccagtcgggattcgattttatatctattttggagtatcccataagggataatcactcagatcagaagctattcatatgagctacacttggtctatatcacccggaagatttattactcgggagcatgttacatgcgtcatcctttaaagggtgccgaaggcatattttttggcctaggcctaatatgtctgcagcccatattttcaggtgtggcctgtcacattcttttagggacttaggcactttttgcttaggccaaagtgcgcgtgatcaagtgcccaataccttaaaatccttttattccgcagttactcaactttttaggagttggtacaatgcattttaaaaggtgcctaatagtgatgtttttcatagctgccccgctgacttttttatatagtcaaggcgttgtttgggtttataaagcaattgattggatacaatatcgttgatttttgctacgtaagtgtgtgtttttgttgaccaatattatggcttaggctgattatatactgtggtcattttccaggtggttggtaaatcctttatgagtttatttactcggattttataccacatatgccatatatttctaggtgtggtgaaaccatgtgtcttttagggacttaagcacatctgttaaagcagtgtgcgcacgatgtgtgcccaatactttggaaatttctttactcacagcatataagcttctttatagctattttgctatgtgaatttcaatgatgtagtcaactttacaaagcaaacggtatatcacttggatcatattattcagggattcacaccacatatgctatatattaatattaagtcactcggttgactacaattattaaaaccactcatttggttagattatttactccttgactatatgtttagtttgttcaactatccacatagtcgggggctacacctaataggtgcatctagtcgatgcacctaagactacattcaattatttttcagccctccacagtcttcagatttggtaaaagtactcgagagatcatggcaaagatgattgaagcacttggctttggagtaatctagttcgagagaagattatctttttgactgtgaaggtctcaggggctactgtggagattatgggcaccccatacccatacggcatggttatccgactggtgtagggggtaacttatatttatgaaatatgtagcagatcatgacttgggtattacgtttccttgtatattatgaaacggactaaagttctggtttgataaaattgtaaagtagatttaggaaaccgacaccgtattggttaaggtttctatcttataatcctaccccccatcctatataaggtgggcaggaggccctctagggggca

SEQ ID NO: 31850 - DNA, 511 bp, Oryza sativa
ctcttccctccatcatctgcaattcgtagttgttttgcctcaggctttttgtgtcttctgtgtaaggttttcgccggtttcactttaacaaaccgtgcagttgtatggttatgtataaaacctttgctatagtggaaagattctcttagtacacctcttaattcctacattcctacattgcagatgcttttagcgcagaatcgctacctataagtacgcgcatgtatccatgcttaatttttcaagttgtaccataacattgtgagatccatgcttaatgttttcaaattgtatcctaacattgtggaaccagtatggtactaattcatctgatcccgttgctaggaggaagagaaatgctcaaatagtatgatcccgttgctaggaggaagagaaatgctcaaatagtatggtgataccgcgttgttgggaggaagaaaaatgttcaaatagtatggtgaagtagtttataaccgtggctagctgcccagctgtctatgttaaccttcta

SEQ ID NO: 31851 - DNA, 191 bp, Oryza sativa
ggctgctcggcccggcggggaacaccggcgggaggttcaaggtgaggagcctgcacgtcggcggcgtgcagctgcggtgcccggtgggaggcggcgccggcggcggccgcgcgagctggggcgcggagaggcagaagctgacggcaatgcagtgggcgctcgcgcacgggccggcgcgcgccgcgggcagg

SEQ ID NO: 31852 - DNA, 1501 bp, Oryza sativa
tttttcttcttcttcttcttcctcctcttttcgccggggcgatgaaacctgttgtcgaaactagatttcggcaataataaaagggggtggctatcaagctggaaaagtgtatgggttttgagacaaaggatttatacaggttcaggccttcttataaaagaagtaataccctactcctgtccggggatgaatccgccgagtgtattattgattgtatgattcgagaaaaatcaacatatgcccctagaggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagaaattctatctacattaggtatcctgtgcccagctcgaataccatcgccgtgtagatatgggatacccatgatctccacagtagcccccgagtcctttgcagtcgaccatcgtagccttctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcgtacgcggcgcctaaataggcatgctagccgactgctttttagccacaataaaagaaatccgagtggtttacactctaaaaggttcacgaatgaacacacttgacaggcatccgaataaaaactctaaagattactcatcaagtattataaagattatggtaataaataagtcaaatagcctaggccatgactatttaccataaaaacaggcatataagacgccaaggaaatgactataataaaaacaagtcattcctagttaacccaaacagtttttgtagcctaaaaaagcttgcaaaaacagcataacgcctttctgtcgggcacctttttaatttgcattgcaataattccaaagaattatatgaccgcataaaaaggattttatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgcaaagctgcgcctgcgaactagggttcacaactccgaccaaatccacctccgaaaagtgcatcaaaatccttctcgtgatccaccgcctcaatccctcacctctcccaagccatccctcgaatcaaatcagcacatttgagtgaaaccga

SEQ ID NO: 31853 - DNA, 1501 bp, Oryza sativa
cacgtacgtcaacttcatcgccagggccattggcggcggcagctcgtgcgaccagcggctcttcttcgccgaggtgcgcaaggacaagaaacggtatatcccgacgtgcctctggtccctggacgacgaggccgaccgagtcggcggcgccggcgccgacccgcaggtggacctgccggagatcacctcgccgtcgcggaggaactactggttcagctgtgacgacgagatgaagcatcccaaggacggaacatcctaccatgccggacacttcctgtagccatctactacgtccattccaaaatataacaatttttatctataaatctagacatataatttttatctataaatctggacatacagttatatagattcatagttaaaaatatttacattttgggacaaagggagtagctagctagctacttcaactacaactgcatgtattataggccctgtttagattttaacttttttcttcaaactttcaacttttcaactttttcgtcagatcgaactttcctatacataaatttttcaactttttcatgctgcatacgtaggtggtgtgatgatgcacggcgtccgatatttgacgtcctacgcggagtcttttccgaagaaacgcattgtcgttcgcgcgttccgctgttccgcacgcgtgacctgatgcgacgcggacaccgacaccgagacggtttgggactggatcagagtatccgtctatatatttcattcgtcgccacgcgtcatcagatcgatcttcctagtagtgctgatccagagacgatcgatccatggagcaggtcgcgccgccgccggtgcgatactgcggcgtcacggaagactacgagcagcagttggacgaggagccaccctcaccgctgtccccgagccgggtctcttccccgctgccgctgccggagcagaaactgtccaccgcatatcttgtggagctccggccgcggcgcaagaacgccctcataaacaacggcccacgctacaggtgtggagatcatgggtatcccatatctacacggcgatggtattcgagctgggcacaggatacctaatgtagatagaatttcttatttgtatcttgggtttgtttcttaacttgtgtatcaaggaaacaccctgaaacttagtcggttacgactgtatcttacctatattttcatattccgttagggatatagattatcttttgtaacccggactccttcccatatataaggggggtccgggcgcctctaggggcatatgttgatttttctcgaatcatacaatcaataatacactcggcggattcatccccggacaggagtagggtattacttcttttataagaaggcctgaacctgtataaatcctttgtctcaaaacccatacacttttccagcttgatagccacccccttttattattgccgaaatctagtttcgacagttggcgcgccaggtaggggtagcgtcaagcttttcgccgatcagtgcaa

SEQ ID NO: 31854 - DNA, 1501 bp, Oryza sativa
acataaagtactattcatgttttatcatctaatagcaataaaaatactaatcataaaaaattttcaaataagacgagcagtaaaacgttgaacgtgaatagtgcaaaactgcacttattttgggacggagggagtagatgcaaccagaagatactttttttttagcacggtgagttactccggtggttggccggggttgatatcgtgtctcagcgtctcccgaagcaatggcggagcgtttcctccaaaaattgggtttcaccaaatgaaggtttcttcgtcgagtgcatcagcaatgtggaatgtggaaacagagatcttaagctgtgcatatatacacatcatgggagtgatctttataaggatcatttggatgagctagcattatacctgagacaataccgtatccctatgaacaaaaaaaagttactaaatatgttcttcctataaaaacttcaatattgtatttaaaaaatggtaccgaccaaaaaaaatcgaatcacaagtcacaagtcacaactgcttgttgaaaaccaatgcattgctcaatacactgtaatccactatttttttggttgatagcagtagtacatttcggtttcctggagatgtgtgacctgtcggctgcaccgctatttcgttgacagtatgtgttagattgctgacagtgaccaggcgtggtgacctgctgagaacacttcaaatttgcactccctctgaatcctatcattgggagcaaaccttaaaaaagaaagcaaaattatcttgtttatttacaagtcagtttctttgaaaaagcgagatcaatatgtgcatgtgcagccatgaagcatggtagtagcacagaattcatcaccatgttgcagatgttaccttactgcctaaattaacggttcctgatcgacaaggacaggtcatgccacatttgccatatacagtgtatgtcaagcaggttggaaatgtatgcataaaaccatgaattactcgcaacattgcattgctgtgcaacttgaaatcttgcatactcctaaaatcctattcctggtttgaaagaagcttgcacactgacttggactgagcacacaggctcgctgaatggctgactgggtgatgactccagtgctatcaacctcctattgcaattgaaggatgtcagaatctctcgcgttttctggtgtttttggcaattgaaggttcttatttgaacaacgccatatgaacaacggataaggttaatgcctactggtgggggagcctaaatgtatgctaatcaatacactgtaccccacttgttttttaacagtagagatctctacacccttgaatttttaaggaatgcatgtgtgcacagttgttcagaggctgcatctgccacgaagttcaagcttcaaaaacctgttatccaaagaagtacacttttctttactggatccagaaaccactgaccagtatggattcttataataagttaacagcaacgcttgaaagacgaacacctgct

SEQ ID NO: 31855 - DNA, 1501 bp, Oryza sativa
tagtaatatataggacttttacatgaataatttagttctactgaatattttttataaaaatcacacatttcacaaatctcttcattgaggtttaacttctatatttgtaaaaaggtgcggaaagcatagtaacaaggaatgtgacaaactagttgtacctactatggacggcttacctttcattcatgataaatagaacatgcatcacatccctttcagtagtctctctctctctctctatatatatatatatatatatatatatatatatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgattcataccctatacttatcaacaaaacaactcaaatttaactttatttcacaatccatgattacatacctaactaattatatgtatggatgctatatacctagaatcaaaatctaacaaaaacaagttcaaattcagttcaaacttgctttaaacaagttagtaaagtagttaatgttaatacctaagtaattgaaaaagtttcatactcatttgaattgggtatatactcaatttcaacaatggtgcccgggcaccatggagcaccaaacaaatttaccatatatatatatatatgtatatatatatatatatataattcctcaaaataaaataagaatagataccctcctgttgaattgtaggcaataatcaggctgccaatcgatgaccgtgacaagtccttcataatcctagacgacgtatgtataaccatatccaataggagagggaggcaccaggattcgattcgaagtcaaggatatcgaactgggggaagtgaggtaggtataccgattccctgacgtggagaagctacgacacgcacgtagtgcagtcttaccaccatgccatgcatttccatccaattgtgtaatcctaccgctcttatatatatatcttttggctgccagcttggtgaggttactaataagctgcggggtagagggtagacaatcggagatattaaagaccatcgcagaatgctcgcaccatagcgattttgcggttttttggctggcgtgttcgcttcgcaccatagcgattttgcggttttttggctggcgtgttcgcttccggtggtatccacatcgccccgcgttggaactggtcatcttgcaaaaaagtcctcgattaacttgataattactcttacgtccctcaccctatgttcctgtgttttgtactctttcgtaacagccctcaatgtcttggtatatactacgtgaaggagacgaaattctagatataggaccgcgctctgaaaaaagggaaataagggtgttttctgcaaaagagaacatccctattctatcctctccattcccctgaaaccctacccatcactgttctcccg

SEQ ID NO: 31856 - DNA, 1501 bp, Oryza sativa
tccgcagcggcagcggggaagagacccggctgggcgacttgggcgagggtggctcctcgtccacctgttgctcgtagtcttccagaacgccgcagtatcgcaccggcggcggcagcggggaaggcgcgtccttctgcatggatgtcgcgcctctcgatcgatccgttgcgtgcgctttaatttcctcgtggcaacgaatggaagcagcttctggcctcgcctcggcccacggtccaccccgccaatatatagaccgatcgattatggatccaattccaaaccggcttggcgtcggagtccgcattgcattaggtggcctagcgttgacggacgcgtttctttcccttctgtctccctcctcctttgccgcgccagggtttgcagttacaaaacgtttttttttctgggcgaaagaaccgaaatttcggaattttttcttccgaaatttttttaattcaaatatgaaaatttcgatcgaaaatttggagtataaaaacttggggcgctccgagcacaattttgcagtcagataattcatgattttcaaaaaaaaaaataagtcatcttgcaaatcaatcagtccattacaattgcatacaccaataaatccattacaagttcatcacatagctttgacagtccattacaaaggtttcaaacattccaaatgtgcttaacaatatatcaccagtccaaaaattgtctcaacaagtcaacatagcaaaataacatcatccaacaggtagtttgtacagtccgttacatagtaaaataacataatccaacagatagtttcaacatcttccaaaagtgctccctccgtcagaaaaaaaaaaaagccaaatcctgagttttcgtgtccaacgtttgactgtccgtcttatatgaaatttttttataattagtattttcattgttgttagatgataaaacatgattaatactttatgcgtgacttgtcttttttaattttttttcttaattttttcaaataagacggatagttaaacgttggacacggaaactcagggtttgtcttttttttggatggagagagtagttattcatggacatccatctcctcattctcagtaaattcgtgttggagttactctttctttgtctgatctgaaacaattaaataaagtatatatgtactagtcagtgcacattccatgtgatttgttacaagcaacatcatatggtgtttttttcttctaaagatgaagataaagattaagttttttacgcaaaataaagtggtattaacgtttgattgattgggttttaattattaaaaacttgaaaaatatattaatataatattttagagtaactttcatatagaaagttttcacacaaaacataccatttaacagtttgaaaagtgtgccacgaaaatctttatcttcatccaactcttgttggagaaatgaacgggacatgtaggtttctaatttgtccatcacagagctagtgtaaaatacaagttttatttctt

SEQ ID NO: 31857 - DNA, 1501 bp, Oryza sativa
ctcctagagcaatgttaaatctttgcttccatccaagtaaggcctgtgagcccttagcaccaaataatattttatccaatgatccattctcgacatactctgaaatcaacatcctgtgtggatcatcagaacagaatccccaaaccctcactagattcatgtggtagatcctgccaatcacactcagttcatgcttgaattcttcctcgccctggtttatgtctaacaactttttcacggctactgctctcatgtcctttaagatccccttgtatacaatgcctgatgctcctcgtccaatctcatcctgaaactttctggtggctatcatcagctctctgtaggtgtacctacggaaatggtttgttaccatttcatagccaacctcagatattcctcttgctagtttgccctcccttcgcaaaataaaccatccgaatacaataaatgttacctctgcaagaaatattgctgataagaaaccatagaagtacaaatacttcgattcattttgaccactcttatgctcgtccaaatttttgttagcattgcagtcaggaccgtattttggaccaaaaggctgtgactgtgggattgaagtcattgaatgctccgacagttgtaattcctccaacacttcttccatagggagcttgagatacatggtgccagtactaccaatgtgaggtaagcttacaccactaagaagaacggactttggatagcacttaccaattccttgccaatatacaaaccccatacaattgcagtccttcaagcatatgttctcgcaagctccaagagaaacataacgaagaggacttaaatcagaatctaggaattgagtgtttggaaggctaacaaacattaccttctgttgtacatcacaagtgatattgactcttgggctgcagcctttgctctgatcacttggatcaatgaagtcataaccgggaggacacgcacaggcaggcacaggtgtgtacacacatatgccatttataccacacacaccacgtacattgcagagctgaggaaatgccatccatgtgactgaccatgttccgcttgaattgttcagactgtataacctgagattgccgtcataatctagtgttaatctcctcataatcccaagaccccaatcagcagccatgaaagttaaattttcactttcaagaaaatgccccgagctattaagagtaccggtcggtatgatattatacaacatcctttccctccccgagatagtccgagtcggatttggccagtaaataaaagggatatcattctcttcataaaacagtgaaagctggaattgatcattaaagtggaaactatagcgaccgggaacaagtaatctgttagtagatgtgagcttaattcgaacagtaatgttttgagtgggtaacaaggtatcggtaggagaatcaaaactttgccataaaatggtgtcacctttgcccttcacaatgaggtttccagtattcaagagctgagc

SEQ ID NO: 31858 - DNA, 1501 bp, Oryza sativa
taactgctgcaacgggtggcgaggagaaacgggcggagagtgcttgagggtgcggcaggagatgggcaggacatggaagagcgtgagggggaggccgtcgccggcaaaactccatcaccgcacccaaatccaacgctgcgccatccagtccctaaatccccttgctctactgggaggggggtgatggagggagcgccaagaaaggaggagggtacgggagagcgtgaggggaaagccgtcgtcggcgaggagaagccggggaggtaaggcaaggcggcggcggcgcaagggcaggggaaaggaagagaaagggcgggagaacagtgatgggtagggtttcaggggaatggagaggatagaatagggatgttctcttttgcagaaaacacccttatttcccttttttcagagcgcggtcctatatctagaatttcgtctccttcacgtagtatataccaagacattgagggctgttacgaaagagtacaaaacacaggaacatagggtgagggacgtaagagtaattatcaagttaatcgaggacttttttgcaagatgaccagttccaacgcggggcgatgtggataccaccggaagcgaacacgccagccaaaaaaccgcaaaatcgctatggtgcgaagcgaacacgccagccaaaaaaccgcaaaatcgctatggtgcgagcattctgcgatggtctttaatatctccgattgtctaccctctaccccgcagcttattagtaacctcaccaagctggcagccaaaagatatatatataagagcggtaggattacacaattggatggaaatgcatggcatggtggtaagactgcactacgtgcgtgtcgtagcttctccacgtcagggaatcggtatacctacctcacttcccccagttcgatatccttgacttcgaatcgaatcctggtgcctccctctcctattggatatggttatacatacgtcgtctaggattatgaaggacttgtcacggtcatcgattggcagcctgattattgcctacaattcaacaggagggtatctattcttattttattttgaggaattatatatatatatatatatacatatatatatatatatggtaaatttgtttggtgctccatggtgcccgggcaccattgttgaaattgagtatatacccaattcaaatgagtatgaaactttttcaattacttaggtattaacattaactactttactaacttgtttaaagcaagtttgaactgaatttgaacttgtttttgttagattttgattctaggtatatagcatccatacatataattagttaggtatgtaatcatggattgtgaaataaagttaaatttgagttgttttgttgataagtatagggtatgaatcaaattattataactaggtatatactcacaatttgaaaattttgaaaaatttgagtgattttgtgcattagataccatggtgcccgggcaccatggtgccccatatgagtgtc

SEQ ID NO: 31859 - DNA, 1501 bp, Oryza sativa
catttataccacacacaccacgtacattgcagagctgaggaaatgccatccatgtgactgaccatgttccgcttgaattgttcagactgtataacctgagattgccgtcataatctagtgttaatctcctcataatcccaagaccccaatcagcagccatgaaagttaaattttcactttcaagaaaatgccccgagctattaagagtaccggtcggtatgatattatacaacatcctttccctccccgagatagtccgagtcggatttggccagtaaataaaagggatatcattctcttcataaaacagtgaaagctggaattgatcattaaagtggaaactatagcgaccgggaacaagtaatctgttagtagatgtgagcttaattcgaacagtaatgttttgagtgggtaacaaggtatcggtaggagaatcaaaactttgccataaaatggtgtcacctttgcccttcacaatgaggtttccagtattcaagagctgagcttgaacttgttcaccatttgaagagctcacgttgttggtccaaacaatctggccactattatctgtcaaaaccatgctgccatcggatttcaactccattttggatccctgagtgtagacagggtggagaggatttgcgctccagacaactgttttgtcagccgagttggtgaaccagatagagaaggtgcaggaattgggggagatcttgtagaggccgcaggcgaaatcgccattcggcgaatagagcacatcgtcttcagatagagatgcgcctggcgagaggaaatcatgtgctgatatgcacaaaagaggatgaatcaggagaaggagcagagaggcagagcttgcaaccatttttgctggagctggagagcaggtgttcgtctttcaagcgttgctgttaacttattataagaatccatactggtcagtggtttctggatccagtaaagaaaagtgtacttctttggataacaggtttttgaagcttgaacttcgtggcagatgcagcctctgaacaactgtgcacacatgcattccttaaaaattcaagggtgtagagatctctactgttaaaaaacaagtggggtacagtgtattgattagcatacatttaggctcccccaccagtaggcattaaccttatccgttgttcatatggcgttgttcaaataagaaccttcaattgccaaaaacaccagaaaacgcgagagattctgacatccttcaattgcaataggaggttgatagcactggagtcatcacccagtcagccattcagcgagcctgtgtgctcagtccaagtcagtgtgcaagcttctttcaaaccaggaataggattttaggagtatgcaagatttcaagttgcacagcaatgcaatgttgcgagtaattcatggttttatgcatacatttccaacctgcttgacatacactgtatatggcaaatgtggcatgacctgtccttgtcgatcaggaaccgttaatttaggc

SEQ ID NO: 31860 - DNA, 1501 bp, Oryza sativa
ggtaacatctgcaacatggtgatgaattctgtgctactaccatgcttcatggctgcacatgcacatattgatctcgctttttcaaagaaactgacttgtaaataaacaagataattttgctttcttttttaaggtttgctcccaatgataggattcagagggagtgcaaatttgaagtgttctcagcaggtcaccacgcctggtcactgtcagcaatctaacacatactgtcaacgaaatagcggtgcagccgacaggtcacacatctccaggaaaccgaaatgtactactgctatcaaccaaaaaaatagtggattacagtgtattgagcaatgcattggttttcaacaagcagttgtgacttgtgacttgtgattcgattttttttggtcggtaccattttttaaatacaatattgaagtttttataggaagaacatatttagtaacttttttttgttcatagggatacggtattgtctcaggtataatgctagctcatccaaatgatccttataaagatcactcccatgatgtgtatatatgcacagcttaagatctctgtttccacattccacattgctgatgcactcgacgaagaaaccttcatttggtgaaacccaatttttggaggaaacgctccgccattgcttcgggagacgctgagacacgatatcaaccccggccaaccaccggagtaactcaccgtgctaaaaaaaaagtatcttctggttgcatctactccctccgtcccaaaataagtgcagttttgcactattcacgttcaacgttttactgctcgtcttatttgaaaattttttatgattagtatttttattgctattagatgataaaacatgaatagtactttatgtgtgactaaatatttttaattttttcacaaaattttcaaataagacggacggtcaaacgttgggcacggatattcacagctgcacttattttgggacggaggtagtacacaataattataattaattaacttcatattttcttacaaactttagtgaattaagatattgatatatatactccatctgtcaaaaagaaataatcatgggtttatatccatattcaaatttaggattgggtttttttttctggatagatgaagtatatgtcacaattctcgtgacatgtatgtgtgcatccccaacataattttttttgggtctggccatggtttgaaagcaccattttgtagttccgggcgtccgtcgtcagtttaagatcaatgcggttagagtgggattagagcgaccatcacacctttggtagagctgacactttcatgtaccagttgcatgtatctagcacagccatttcttaaacgatacgagtgactgtgaagtcgaagcttgcagcattggaagacgtgatgtgtgatgtgtggcaacaatggcatgagtttagttttttttaagaaaaaaagggtaaaagctttgcctcatatatattttgatagagcaaaaagagaaaaa

SEQ ID NO: 31861 - DNA, 1501 bp, Oryza sativa
acgaaagaatcagggaaaagccctcgagccaaagccgaatcgagaggaggagagggcagccgtactgagggcgatgatggagaggacgaaggcgaaggcgaggagcggccggaggacggaagacgacggcgatctcccacgctgccgccgccagcgtggctcctcctccggccatggtgccgcggcggcgcttcgtcggcggaaggggactatgcgcgtgggaggcggcgccggacttgagcgccatgcgtggagggcctcgccgtggcaggggcaggaggaccgccggcggaggagctcctcctgcttctccgcgccgccgactgaggggtaaagatggaaacggtatcggccggtgtactacgacgtcaaacattttgactctttttgaaatgagctacagcgacaaacaaaacgaaacggagggagtatatgttaatgaatctagaaatactagaaagtcttataatataaaatgaagaaagtaactattttgggcttgcacattacacacctctaggatacacacctgcatgctattttcctgagctgcatgccttgattctttgtatgcttgttcccatcttcatgtgtgtactttcctgcatgcgtctgcgataaaacagtttcatattttgcaattcttattttcacattaaatttgtagggtgacgaagaaattttggagtcatatgccaaatcatggacttctgatgtccttgacaaagcttttcagcaggattgtatgtcattcacaatagcaaggcatatggcttcgttttccagtgcagcggttctatcaaagtgcgaaataagctggttaaatcgcttatcccggtgctatgcccagaagcgtcatcgatcatgaggtaaatgctctcctgctttcaggaatattacttgtatatctttgtgttgtatttcttaaattgatcatgtgccatccttgatgttcggaaaaaaaaatcataccgcaggacgtgctcaaaggttttgttctgcaaattgcacaagattcacaatgtagtgatgaagttagctgaagatttgaaatcttgaagaattctagcttgcgagatgcatgaattcttctcttttaggtgagaatccagagattaaagacatcgattgatcgatcgataaatggcccaattaaaaacgtttcacatgcgctaaggcgcaaaagtcttggcgatcgtacataacataatatgtgccaacgacaaattaaacaactagagaatcatagttgcggttgacgagtacaaacctggcgctacaaataaaactgacaacaacatgctgaaggcctagctagaactgttacatggacgcttggcccatttcgccccatcagaattatggatttgtggattacattttgaggacaagaaccatcaattggtgtcgctggtggtaatcctgatgcagtaccgaacactttttcttgtttttgaaaaattgtcgtctcgtctgttagcatgcctgtctcatttcattc

SEQ ID NO: 31862 - DNA, 267 bp, Oryza sativa
cctgcagcccgatgtagggctattatccaacctggaggcctgaaccagtataaaatccttgtgtctttcgcctttttacttatgtgaatgataaatcgtggaaaaaccctaaggcaaacgcctgatcagcgaaagcaccggggggcgaaagaaatcggccgaagcatcgctcaccgaacgttgaaaccgcgacagcttgtttcgggaaataagtaaccgaacaccgcaatactcgagttatgtgaaaacacaagcgcttcttttagc

SEQ ID NO: 31863 - DNA, 1501 bp, Oryza sativa
ccgacagcgccgagaggttgccaagtgattgcgggatgatcccggtgaagatgttcttccctactgaaatggaattgagcttcagaaaacctccaaaccaatcagggatttttccgttcaggctgtttaagtcaagtttgatgctagcaaggttagtgcagttccttagttcatcagtgatctcgccttgaagtgaattgtttgacaggtacaggtaggataactgtggtagctggccaattgtcctaggaatttcaccttggaatgaattgtttgacaagtcgagatatgacaacttcgacagccaaccaatcgtcaaagggatttcaccataaagttgattgcaactaagatctagacttctcaaatatgtgagattcccaatggaagcggatatgtagccatggagcccagtcgaggtgagattcagtgctaataccctttgcttatgcctatgactgcagatgacaccagaccactgacagtagcttgttgttgtgttccatgaagccagtgcatctgactgatggcttagacctgccttgaatcctagcaaggcatccagatcagtgttattgctgaaaggcaatccttgagtacatgaagctgatgccagtaggagcagatatggcaagagaagcaattttagggcagtaaacattttgaagcacttttctggcagctaaaaacaaaaaagaattagtcttcaattccatgcccaggtaagtttcacttggaataataagtgtgccagaaaaaactcccatcggtcacaactcagaaatacgccattttggacattgacatggtctcccaaataaaactttgatatctgatctttatataaaatactatttataaagctcattagtgttataatgctatgaaagtactcaagcaaatctacatgtatcaatctaaacttttgaaagtttaaaggttggaaacttaaccgcctgcatgatacagtggtttggcctacttaacctcctggaacatgaaatcgagaattccaccctccaaaatatgaggacatgtgcaaataatccctgttgtagttttgtaaacagttcttgtcatgtgtgcattatgactgaggacaatgacatggtgatgcatttgtttaaatatattttttaactggtatgatggtttggagaagaagtacaacagcggtggttgttcgccgaataggttgttattatgcatgataggttgcatctatttttgtcgataatctccatggctagttaagagttattcagctaaatccttacattttatttttctaatcataaaaatgatctccgctctctttaaaataagtaaacatgctctggtattgtccaaaacgaatgagtgtttcattaaatatgccattcacgtgttctcatatatgtggcaatttggtcacaccttgaacctttcttcgttgaaattgaatttctaaaagcaaagcaggaaaaacaagacgtgaattaaattttcaatctgtttgtac

SEQ ID NO: 31864 - DNA, 1501 bp, Oryza sativa
atttatgaataaactttttatattttatctttaacgatttaaaagtatgctgaaaaataaactacgaaaaaaaaatctcgaaatcaactacaaagttcaaattttggctatggctcatgagccaaaattcaaaaggctaacgttggcaacttttacatcgagatgtcgacaggatcgatatgaatatcttttcttgaggcttaaaatccaagctacggagtcgccgtgaacttgcgggtgaaaggacgtacaggtgccgacttgatgatccatgtccggcaccatcatttaaggagagcactgtccaatagaagctgtccatatataccatcagacattcagagtttcagacggcacaagttttcattccatatcatcaggagaacttcaggtacaaactgcactttctttgtttccgttcatattttgccaggccggttactgttcatgttcctcagaaagtaacatcatgcatgatctagggcataatgatctcctgttgaacctggtaggctatgcttctatttttgatataagctaccaagtcattatattataatagacaaaaaaaatggcaaaaccaaccagaggttaatcgactggagattctgagttcctgacctgatttttcttatacctgtacaaacagattgaaaatttaattcacgtcttgtttttcctgctttgcttttagaaattcaatttcaacgaagaaaggttcaaggtgtgaccaaattgccacatatatgagaacacgtgaatggcatatttaatgaaacactcattcgttttggacaataccagagcatgtttacttattttaaagagagcggagatcatttttatgattagaaaaataaaatgtaaggatttagctgaataactcttaactagccatggagattatcgacaaaaatagatgcaacctatcatgcataataacaacctattcggcgaacaaccaccgctgttgtacttcttctccaaaccatcataccagttaaaaaatatatttaaacaaatgcatcaccatgtcattgtcctcagtcataatgcacacatgacaagaactgtttacaaaactacaacagggattatttgcacatgtcctcatattttggagggtggaattctcgatttcatgttccaggaggttaagtaggccaaaccactgtatcatgcaggcggttaagtttccaacctttaaactttcaaaagtttagattgatacatgtagatttgcttgagtactttcatagcattataacactaatgagctttataaatagtattttatataaagatcagatatcaaagttttatttgggagaccatgtcaatgtccaaaatggcgtatttctgagttgtgaccgatgggagttttttctggcacacttattattccaagtgaaacttacctgggcatggaattgaagactaattcttttttgtttttagctgccagaaaagtgcttcaaaatgtttactgccctaaaattgc

SEQ ID NO: 31865 - DNA, 573 bp, Oryza sativa
ctgatgagcttatttatatgtctcaactgactttagagaagtgtttaaaggatgagaactgattgagatttgagaaatgaattcaccatttttgttgagttgcataattttttgtatcgctatttaccagaatcataaaccattgaaaagctcatagttgtccctggaggtggcaagtggcaacagaaactgcggaagagttctgctttccatgcccattgggagatgcagacagcattaagaaggaaacaattagacatgtggaaattgttactgttattgttcttttcctgggaatgtggttgggaaaagcttgggataatccaaatgcactctcagttggctggttgaaatcttgccggactagtttctcagcttgattaggttgcatttctgttttacaaacgagccccaatatagcatcatgctcattcttgattgtcagaattgtttcttgcatagttggaatatgtcctttgttctctgttttttttttaactgtgatgttctttgttctctttaactccctagataaatggatatttaaaatttaaaatttcctattctatcagg

SEQ ID NO: 31866 - DNA, 1501 bp, Oryza sativa
ttcggggagagagaaggtggggatcagtggatggatggatgacttctgttccattaatcactgctgttccctcctgcttcgtttagggagaatcctgataaacaatttgagatggtcaaatccagatgcctttacccatatttgaattctggtgttatcagcggtaaatttaagttttgaaagtcaattttaagttgattttgaggtttttaagtgtatatcaattacatttctcaatattagcttctaaactgctaacaggttgaaaaactattcataaattatttttattgtttcgtttattttttaaggtaacttcatttattttttcaataacggtgacagtaatctcaacatacgactattcagtctatggaaatgctgagtagtactcctatgtgcaattgtaatgacaagtgtgcgtgctgctgtgtttgaaaaaagaaaacaatatgcaggtagaatgccggtgggtgatgagcatgttcatagaaccgatggaatttcgtgaaaaatggtagatttttgtgaaaccgttagtacttgatttgtgaaaaccaattggtatgagatttttgtgaaaccgttagtacttgatttgtgaaaaccaattggtatgagccagtttctgtatgatgttgactgaaattcattggttttttttggttcagacatatttcgataaaccgtgagaagcggtttttacttcgaaataaaaagattgggacggttgaaggcagaaatggccgtgtcgcaccccgtatagcgtgtgctgtactgtacccaccaaagctgtactgtacaggttcgccatggtccagcactccaggcgaccgcattgtcacgactcacgccgcgtcgtcttctgacctattgtgttctctataccaacatttttcaactccacacgctgattacacatacttggcagactacaaatttccccaaatattaaatgcacaaccaatctgaacttccacgaaaacaaaattcgtttcatccgaaaggcagtttcacgaacttcgcacaaattcacatcacaggaaacagaaatataaaatgacggaatcacaggggaaccaaatcttcagttcagattcatcgaattcatttaaacagaagagtcgctacacagaagccaacacaaagcagaaattccccccgaatcccatcgaaaccctagctcctacaccaccaccaccacccgcacgccaccaggaaggaaggaaggaaggaatcagccgccgaagccgtagagggtgcggccctggcgcttgagcgcgtagacgacgtccatggcggtgacggtcttgcggcgggcgtgctcggtgtaggtgacggcgtcgcggatgacgttctcgaggaagatcttgagcacgccgcgggtctcctcgtagatcagcccggagatgcgcttcacgccgcccctcctcgccagcctccggatcgcgggcttcgtgatcccctggatgttgtcgcgcagcaccttcctgtgcctctt

SEQ ID NO: 31867 - DNA, 267 bp, Oryza sativa
tgcgatgagggaacgtgataaggaagaagtaagcattgttgacaagaagtgtataggaaagaagaaaaaaaggaggttcagaaaaaagatgagaatgaaggagcacatatttctgacgaagataaagaaagttattgagagccatataatggatggaaaggtgctcattgctagtttccgggtaacaactggttacttcaggttgctacctcatcaaatctacaaaattccagaagaagatccccaatatgaattgaataaaaaagg

SEQ ID NO: 31868 - DNA, 153 bp, Oryza sativa
agatgggatgggggtggaaggatgcggcgaggaggaggtgcgggagggaagggaggtaaggcgagaggtgtaccccgacggcgagcgagacgaacagcgccccggagaagaagagcaccttgttccggctgaggtgccacccggcgagcccca

SEQ ID NO: 31869 - DNA, 163 bp, Oryza sativa
agacgagcggtcaaacatatgctaaaaagtcaacggcgtcaaacatttcgaacggagggagtatattataaggcccacatgtcatcctctcacgctaactcttcttcctccttcctctctcccttatctctctctctctctcttttcatttccccctcagcca

SEQ ID NO: 31870 - DNA, 1501 bp, Oryza sativa
aaatatactaacttagcacttcatgggctttcaaacgctctgatggataagggcagagcatcttttttataagatcctttgcactgtcagatatcctgggccaccggtttgatttaaaatcaatacgtccatccagtactttttcatatatcccgctttgtgtatctagtaagagtgaaagaagtccttttagcaattcactaaaaccaatgaagcagaattttgcaaatcttgtcaaatcaatcacctgcccaaaatggaggaacaccagtcagcaatacatagagaatcactccagcagtccatatatcagcctctggtccataacgcttctccaatacctctggagcaatataatatggacttcccactacctctctgaaaacctgacctgatttgtggatagatatgaatcagttaggaaaaacagccaaaggaagcatagattgtatgcaagagtaacaattacattattatttgtttttgttaaagctgcattataaggaactacaacaaactaatgtttccaagactaaattactggtagaaaatttgattgggattgtttttctactctgccatactttcaccttactcgctctttgtacggaactatttacatcataactaaataagttagcaggatatcaaacagctgattgctaacatgactaaatatagaaacaaccccattgaatatacttattgactctgacataatacctggtctgaagaacacagatagaccaaagtcaattgctttaaccgagaattcatcgtctgcgtccagtaagaggaaattttctggcttgagatcccggtgcatcactccatgtgaatggcatgtttctatgatgccaactataatttttataagctctgcagccttccgttcactgtaatgacctcgcttctgaatcttgctgaagagctcaccacctgcacagagctccatgacgatgtgcacggcctgctcatcctcatatgtgtccttgattgtcactatattcttctggcccgaaagatggtgcattatctggatttcacggcgcacgtcctcgatatctgacacacatcggagattactctttaagatagtcttgcatgcatattgacaccctgtgctaatctcagtgcagaggtatgttttcccgaactgtccctgtccaagctcccggccaagagtatagagctcccttacatttggagtcttgtatccaaggacaggggactttaggttcagcccttgccgcagagcacccgctaagctggcccttgacgagcccgagtagcaatcctcagtatcattcccatcaacgtaccgagaagcaaaacggtcattctgaaaccggttgctgttctggtaattgttcccataggttccattttgcaagaattccccattcccacaaaaatgtatatcctgcatgatacaatatgcaagttagatatctacaacacttcacagggatccggaaaagcctgctaaaaaggagaactc

SEQ ID NO: 31871 - DNA, 1501 bp, Oryza sativa
tcccctccgctggccgtcgcacgactccgggtggcggcgggaggaggagaccttggcagcaggcagacgcctccctccgcatctccgctccgctctctcccccttagaagttagaccacctccaccgccgtcgcacgccgcatcgcctctccgatctctccctggcggttacgaatcgatcccagccagaggcgaccaggtcggaactcggaagcagtggcagatggtgctgggcctgcaatggcaagtgttctctaataagatcatggtaccatgtgcatatttgacagtgaaattatttgctttttggaagtaacattttcattcctgcaatgcagcactgatatgctgactaaacacatttgccaattcagatattgaccatttgtttgtcagttgttgcttccttctacagttatgccgtttttagcccaatcatagatgttagaatgccaatcatttaatattgtagtaattttcaaaaagtttattatgagatgattttttagaccttttctcgtgggcttacgctaaaagcgaaaaatgttatactgaccataaactatgcaggtgatatggaccaaagttggggagatcaacactttgtccgtttctatggccgcaaacgccggcaacagaatatgtgcaaagaaccggaatcaagctgcagggataaagctccatccttaagtgtgattgagcaggtacactactgaggttctgggggtaaaggttatgttatgttatatttctttcaaaattaagttttttgtgcttcatttgtttggctaatatattttagcaatttacatggtgcagatttctatcttcagtacattctcagattgtgatttcactatatacatattgcagatctgccaaattgtttaccacagagattgcttttgtgttttcctagcatgtttgtattgtaggaaaacacgatgttgctaaccgtgagaattccgcttaactcagtcccctgttttggttaagaaaatttgtgaccaagatctttggccaaggtcagtttggatccagttatgcctctcttatcttgattcttgaacaatagaagacttttagtgatgcatagttaagaatttccgacttgcttttataacctaacacatgtatataagctttttaggaatagtaggatagctgatgcaagtatacaggagacttaaaaatcactggttgtcactgaattttaactaaacctcatagatcctagggagaaaagggttaattgcatagacatatgcagcattggcagttgggttgcatcttctttggcggttggggtaagctggcccccatcctctctgttccaccccctacaaggtacaacgaatttcctctcttccttttcatgttctcattcagtgtgtcatgatagtttatgtagagtttattcatacagtacaaagatcaaaacggacttggtgatggtgattgtattgaccaccaagcaggtaatttttcttgtgatgttcat

SEQ ID NO: 31872 - DNA, 1501 bp, Oryza sativa
tcgcgcgacacttctgttctgatcaatacacgcgcgtgtgggcggcgggcgccatgaatcaggaagaaataaggatcgctattttccttttttaaaaaaatagtcactattttctttctttttttttaatagtggggtcgatcgtcgtttgtttgccccggaccacctatggtccgccattgaggattcaatctatagtcaatcgaagtaaagagtcttcctggtgataaattacttacttaactcaatggtgctttcatacgcaggagtcattgattcaaatccaatagtaggtaggttggtagaaaaattactagatagcattggccctacttcgcttcgctatctaataactttttctacccctcttctctttttctttgtatcaactaaactgttgggttgtttttaattagatggggaatccaattaatagcctcgactcgtatcctagctcgtctgagagctagcttcgcttcaaccaattttttcgtaccctcagctctactcacgttagcttcggctattccaggaatacgtaacctattttactgctgattatgtgtaaactgcttctggcgacggacggtactatctattctgtcaaaaaagttcaatagtagttttttaagcaaatcatgcaatggtttttcatttcatccattgacgtgttgatcacttaaaagttagttctcggaaggagatggactaatcaccttatctcttctttctataaagttaatgcccactaaacacctaaaatttatcatacaaacatactctctccgtctccgttttttaatagatgacgccgttgacttttaaacatatgtttgaccattcgtcttatttaaaaaaatttatgtaaatgtatatatataaatcatgcttaaaatactttaagtgataaaacaacttacaataaaataaattataattacgtaaattttttggataagacgaatggtcaaacgtgtgataaaaagtcaacagtgtcatctattaaaaaacagaggtagtagtatttattagtactcctaaggctgtgttcgggagacaaggttcctaatcttgccttccaacacgaaaaacaaagcccacgcgagattaattaagtattagctaaaaaaacttaaaaaatagattaatatgattttctaaagcaactttcatataaaaaactttttaaaaaaagcatgttcatgtaagcatagagtaaaacaagggaagtgaattaggaaagagggaaaatgaacacagcctaaagtctacatgcaagcatgccacatcaatccatttagcacacaaagctcaacatgtaagcatagagtaattatacctacaatttatttcattataaaactcaacataacatgctaaatcatcattctcaaatcattttcataatatttcaatacaaatcatttcatcatttctccaatatttaatatatatcccatagcaaagtacaaggtatcatctaatattttattatttgtgt

SEQ ID NO: 31873 - DNA, 1501 bp, Oryza sativa
aatatttcacttgtaattagcagttttacctaggtaatctgtgactaatgcaatgctgacaccacagttgagctagatcagtggataaagtagatattatctgaacattatttgtgcctaatgtaatgctgacactatagttgagctacaccagcagaactaaattaaaatgataaattctatctgattcctggacaacagtgtatggtttacggagtagtttctttgaattgatcggttgttgtttaccatgtgtttcttgtcttctggtattttttaccatgtttatttggttgttcatttcttgtccgttcttgattttgtatggaagataccgggtgttcttcctggacgccgttggtcatgacgaaggaggagggcagggtaggtagacgtcgcaaatttgtcacaccatggaagaaagcggctcaggaggtcggcgacggcggtgcagaggatcgtgtcgagcgcctcgctgccgcggctttgtcctcaactgctctctctccaaggttcgtattcgattttttttcgatgatgtattttgtgttcctaaaatgtgttattttcaggaaaactctatagatgctcactattgcgaggttaaatgaattttcacatctaacctcacatagttcagttcatggctactgcttgtgcaaaattcgattaattagagcaaggaaatagcactgtatttctatttacagggagctgttgctggttgttctagtttatgcaaacatttagcataagtcttttccttatcttattgcttcataaattggagttcttgttattgtataatttcttgttagatcacatggttgtctgtccagttatgctatacaaccagtactagatgtcttacagaatggatgcttttatcttttctcagaaccttactatgcttttcactcttaacatttgatgcaacttataatccaaaatgtgcattcatgacaacttcgttgcaacaccttttgcagggttacactagatgggtccaatgttggagggaaaagaggcaaaaaaaggaagtctccctgcgtggcaatgccattctttagaaccccgttgagcagaatgttactgtcccctagcatacggataaggtctccttctatacaacaacgaacatcaccttctgctacaacccatggaatttgtcaaggtcgagagcaaagaacaatggatattgatttaaatttggaaccgggagatacatatgctgccacagatcccggagaggctggatttgatcacagtgctgccaaagatgctcaaggcaatggagaggctagattcgatcacagtgctgccatagatgctcaaggcaatggagaggctggatttgatcccttcgattcaaatgctgatgatgatgtcctagtcactctagaggagataggtgttgaccctggccaggagaatgtacagcctcagtttgatcctttcttcgattctgatgttgatgatgctatcctagttcctcaggaga

SEQ ID NO: 31874 - DNA, 1501 bp, Oryza sativa
tgttgttgttaattacatgggttcgggtcatatttatacccgagatacatgatatgtccttggtggacacgactcttatctctaaatctctaagatacacataagtctttacgacagacttttgcctaaacatatctctaacgaaactatttaaaatatcctaattaataggtacaattatctatctgagagcttatctcgcatcgtggcaatccttgtgtagtacgttgattgattctagaaacaattttacaactgtcttcaacaaaatcggctatatcggctgtcctctgtccgatccatctcagccgatgcagactccagccgattccttcgcagctgatgcatactctgttcttcgaatctatttctttgccgaatccactctgtttccaatgccgaacctagttcatatcttaccaaatttggtcgttaacacaagggtgtacatatttatacccatgggaagatactagtccttataggacaagaaagaaactttcctaaggaaaacataaatagataaaaggaaaacataaagttcttataggacactaaacacgctttcctaaatataaaagaaaactaacaaatgttgcctaattaatagataaactgtcatgccgcatccttcttaaactcggtcacttctagataagctttctttaacagattaattttcataaccgaatatagtaggaatccgactattggcgacgtgataattctctcaggggcttaccgaatttcattgttaacaattatataagactttctagcattgcccacaattaatgacatataaatatgggcaatgttagaaagtcttataatataaaatggaggaagtaatacttaactaatcacacgctaatatacggctgtttccgtgcatataagtgattagtcgacaaccttggctgccgagcgcagcccaagggcccctttaaattgcaggattgagaaaacagagaaataggaaaaacgtagaaacagaatgccacacttattggattcctatgagattttaaacacattaaaatctccaaactagcgtttgattatcacacaggaaaatcgtaggaatcttagacatacgaggaaaacatgaggtgagacctcacacttatttttctctaaaattgctctaggaaggtccattcgatgcaaatttcaaaggaattgttaggaaataatctgtttcaaaggggtttcctgtttgacggttcgacctcgccttcacgctttcagccaaaacacagcggtggcggcgcgacagccgacttggtgatcggcaaaagcaccaaaccatccccctcctgcctcctccccttaaaccctactcctctcctaatccttcccttcctcgtcgccacgcggcgacagcgagctcccctaaccaaaaccccaccaccgcgatggacgacgcggcggagcggaggcggcggcagcagcagcagcagcagccaggcgccgcccaccccgcgcgccgcaaggtcgt

SEQ ID NO: 31875 - DNA, 440 bp, Oryza sativa
gaatagtacatttttctaaaaaaaagtttgactgagggcaaagtcactttaactttgcgtcaatcctactcatgtttgattaagtttatataaaaaattaataacatttttaacataaaataaaaaaacatacttgatgacaaatttaatgaaactaatttgatgttgtgcatattagtacatttttctacaaatttgtttaacttaggataaactcagtaatataaaatagagggaatagaaaaaaaaaagctctccagcagcaattagcatgcactttgctccattattcttatacttgtataacatatgattagagtgtgatggtcttatcgtaatcatgattgataaatactggtattgcacatggaatctgcactattcataatagaacaatatcttagtgttcaaagaagtattatggagaaagaaccatctat

SEQ ID NO: 31876 - DNA, 1501 bp, Oryza sativa
gccaaaagaacttaaccttatcttggttagatcatcacaagctttatcacacatcactaacctttttcttggcatggacgagatcttcacaagctttatcatacatcactaacgtatcctgcaattcctttctcagttttgctacttcatctactggttgagactgcagatcctgctaagaattgaatcacaattaatacaacttatggaaagcttatgaaagccaacactagtcagaatattttcaaggctggaaacaggtctgacctcatcaattgagctcaaggcaacataagggatttccttcaatcggccaatagcatcgggatccgtgttcacatctctgcccggtgtttttcgccctaagcttccaaaaaggcttcttccatgacttcctgaacttttaccagcattagtagaagtgctacgagagctgcaggtatgagagcctgcataactcgtatctccagaagattttggtgttccatcctcagggtggtcatgcaaagattgtttgtctagcagccagttcttctgtattcgggaaaatgatttatgactgattgactgagtccttacacaagcgcttgactctgcaaaaaatagaaaggtttaaggcaaaatgagtgcctcaccattgcatttcccaaaagaaatagtagagaatatgggcaaaacatactgcttgttcgagcctgatttgcaaacttaatagtcaatctgtgcctggacacaacaaatacattgcacgaacatggcatagctttcaggacagtagagggcacatctcggagccgtaatatcctgaaaaaggtaacagcaataccatttaacaacaacagtggatttggcaaaagtggccagaaatcgatttacatttacagagatgctcattaattttgcttatgagtttaaagttgacaaataatgaagataaaaatcccccgcattaaccagctaaagtgactaatctatttatcagcatcatgaagacaaactgatgttagttgcgctggctcttaccaatatctgtggcttcctgggtcctaattactcaaaaggcataaatgcgagaaaaaaagaaacgaatgtcaacagaaaaaggaaagtttaatcaagatatatgtacgtgcacacacctatcacctttactcagaacaagtgacaccatcccaaaaaggggctcaatcttcccttttttttttctgaaaaactttttgtcccatatacacagcatatctagtatgcactttccagttatttttatactttggggggaataaagctatacaggtaagaacaaaaatcccccttatccctatcaatctatcattggtagttgaattctcaaaagcgaaattctaacctttactagtagttgggaaaggagatttgtcacccaaaataaagtgaagaggattatatttttcaaaaaaaaaacaattaatctagtataccttttgaaccagttgagggaggtggatccaaccacgaggttgcg

SEQ ID NO: 31877 - DNA, 632 bp, Oryza sativa
aaaaaatttatatatagaaatactatatataaaaaaatatttgaattcaaattcaaatttgaatcaggtatgtaaacttttggcttataaactttgggtctataaacttaggtgtataaacattagatgtatagacatactatatatagaaaatatttgaattcaaattcaaatttgaatcagatataattcaaattcaaatttaaaccgggtatgtaaacttttgacttataaactttaggtctataaactttaggtgtataaactttagatgcataaaaatactatatatagaaaatatttgaattcaaattcaaatttgaaacgggtatgtaaacttttgacttataaactttgggtctataaactttaggtgtataaactttagttgtatagaaataatatatagaaaaaatttgaattcaaattcaaatttgaatcggatatataaactttgggcctttaaactttatatgcgtaaacttgagatgtataaactttaggtgcataaatttactaaaatataaaagaaatatggtgcaaaaaaaaaaaccaggtaaagggaggtaaagggagggggagacccgatccgatcgcccccggcggcccccggcgatcaatcgcccaatagg

SEQ ID NO: 31878 - DNA, 250 bp, Oryza sativa
ccacgtcattttcgccgccctctgggagggcgatttttaaaaatcgccctcccaaagggcggtaggcgactatttccgttaattttcaaaatggaaaattatttttgtaaaacttttaataaaaaaaattataaataaaaaaaattcggcagtgtttgctatgatgcggcccagtggagtaagcaagagatatcttagtgggctctccttcagtccttcccggcctttcatgggctcccgtcccgttagt

SEQ ID NO: 31879 - DNA, 1501 bp, Oryza sativa
  unsure (1)..(1501): unsure at all n locations
cttgtttttcttgtcgtgttaggttggttatagtgaaccttactcgtttttttgttaaaaaaagaaaaaaaaacagcatctcaccttatgctcaatcaataaatattggtgttgccttgttagtattatgctatgattttaacttaatatttttttagctcgttttatgagaatggatgtgtcaaaactcaatagttttggntgttagcaaatactttttttataaaaaaatagttaatatatttttcaatgaacttttattacacaaatataattttagcgtattgaggaaataagaagcaaaccattatactatataagattaaatgtgataaatatgtattcgaatttttgcacgagaatatttagcttcttactaatgatgtctggatggagatgactagttgacacgctttcacaccgtttcgtttataggagtatatgaagttgacagctgtgtattagcgttacaacgtaaagtcatacatgtcacttgtgaccaatattatgactcatgtgtcatgaaaactaaaagagagaataatggagctaaataattccttaaatagtgtcaggattggtggtaggacatgcatatactcattctgttttttttattttacattactaaagatagagagagagagttcaatgttgaattctagataaccaaacttaatgcctagagtagtatgataagcttaggtggtgtttggatccaggggctaaactttagtccctatcatatcggatgtttggacactaatttggagtattaaatatagactaataataaaactaagtgtataaatgagaactaattcacgagacgaattttttaagcctaattaatctataattagcaaatgtttgctgtagcatcacataggctaatcatgaattaattaggctcaatagatttgtttcatgaattagtctaaggttatggaatgtgttttgtaattagtctatgttcaatactccaaattatcatccaaatatccgatgtaacagggactaaaaaattttagctccatctaaacagggtcttagccatgcaatgatatgtacaacacatcaatatgcatatgatgcatatgaccaattattatagttatgaaccaacttaatgagctagaaaaaacaaagctggtagtatttatgcttcattagtatgcccttgcaggaggtttcaaaatacaagaggtattaggatatgttgtaaattttagtcacactgtaagcaatcatttatacaccgagcaattattttatactacatagaggtaactggtttgcaagattttgtaacaataataattgatatgtagaggtaactagtttgcaagattttgtaacaacaataattgatgttgggtctggtgcatcagagaggataaacaaatgacacataaaaagtacactggaattaatatcgagcaccagaatcgggtggtaaacgccttcgtgtgggtgacactgtgtccgtcttaggtcggca

SEQ ID NO: 31880 - DNA, 328 bp, Oryza sativa
aatgctagaaagtcttataatatgaaacggaggaagtacaaatttagttatgcttaatgtttctatatacgttatctctaacctttatccctccatgcagatgaggataatgatgtatatgctgaccatgtggacattctcttcgttcaggatgaggtacatgtatgaaccgatgaaacaggtattcctatgagagcaactatactttacgaaatgacataaatccaaacaacacgttttaatttaaattttgcatattatgaaccgttgacatggcacaccaccaagatgcacatgaaaaatattaggagaagaaaatatttatcag

SEQ ID NO: 31881 - DNA, 1501 bp, Oryza sativa
ggttggttgaggtcaggaatttcttcatcttcctctgttggcactgaaataggatgacatggattagtgggtgtgctgtagtagcagatgcaattgtattggtgctaatgtgaatgggagcagggagatgaagagtaggtcaaagtggctgaaacttcacatgtaatgtatgcaaactgacatacctgtgtccatgttcaggtcaaaagggtagtggtcgacctcctcctggacagcaacatcttcttgacccacaacaggggcttctataacaatattgtggagattatggataccccatacccacacggcatgtatatctgactgggtattggggtaccatatgtagatgaaatatctttaagggactcgagttaaatttctaacttgtgtatcaaggaaatacccagggtcctagtcggctacgattgtattttatctttactcacctattctgttaggaatatgggatgtattttgtaatacggactccttccactatataaggaggggtccggttgcctcttggggcataacttttatcccagatcatattatcaataacacactcggcagatcaatcccggacagaagtagggtattacttctcatcgaggaggcctaaacctatataaaattcattgtcttcaaacccatccacttttcctttttgatagccacccctttttgtattgccgaaatcttgtttcgacaaatatcttctcgttgcacagctcggagttctatagcaacatcgtcttgatgcacaacagggacttctacatctcctacaacttgtatggtaaattcttgattgaagtaaggaagttcatcttcctccacttctattggagatgaattaagatcgattggcatggattggtggatgtgcatgatgagattcaattgggttgctggcaatattgtgagaatgggaataagaggctgggagggaaagtttagagcaaagaggcaagggagtatttataaccttttgattcaaatttgtatgtttaaatcagggtttgtgtaaattgcggcaaaaattgcctaatagtggaggcaattaaatctcacgcttgagataagtctgacattgctagagatgtgtctggcattctcattaattgaagtataagtttattctcaatatgtatcttttgcagtgctttgattactgcaagaatacattctattagtctgtttttcactgcattagtacctttttcagggttatatgagtcttttggtcatcaccttaatttctgctaaaatgggaataatctcctatattgtgggacggagaaagtttaagcaagattgtcaagatcggtatcctatgtagtatcgttttgctcaaagtagtatcgtatcgtagtatcgggatactatgagattttctttttttttttcaagtttagttaatatttatgttaattacgtatagccattctatataaaaatgtggtaataatatatgtctgctagtgatatgggcccg

SEQ ID NO: 31882 - DNA, 1501 bp, Oryza sativa
agatgttgaagtagatgttgaagaggtaccacagcccgaacagcgcgccgagctgcagcgtcttggcgaggccgctttcctcctcctccgccttggcgtccccggccgccgcgccgcacgccacgtggcgcgccctccccctccccgcccggtccggcgagatcggcggcggcggcggcagcagcagcagccgcccaagcgaccgcgccgccacggcggcgggccctcgcgaagaggaggcgatgccggcggcgaggggccgggcatggagcaggatgggacgacagctactgctgccggggcccagctggagcggcggccgcgcggggcacggccggacgaggccgaacgccgccgcggcgctctgcatggcggcgggaggcgagaaggttcccccgggggaaggggaggccggaggttctagaagcttccggagtgcgtggggtggagagcttggaggaggaggaggtggtggcgcggcggggaggtcgagggggaggagaggtgagtgagtggaggggtttggtgggatttagcagggggcgaggtggaaggctgagccgacacttgggcccgcatggcagtgagtgggcggatctaccaaaatatccaagctggctgcggttggtgtctctggcggcttgcagttgcaggaagggggttatggagagagccgattatggagttggtggagggagtttcacttgtactcaaggttccgattcgtatccattattttaccatgtttcgatcctaccaaattaaaacgatatcgatccacttagtattctaatttttaatagtatctcgatccaactattcattactacacgatcctacgaaatcttaggtggtatcccgattctacgatccctacgatactataaaatattatttgaaatagcatgatttgaaaataatgtaaataaatatgcccaagtttatataaaaatcagttaaatatatcaaaaccaatgtggtttctcttgataaatgtctcgatttgtatgacattgtcggagggtgtactcctccaccagggaaccgaaaggcctatcttttttagttcggccggggacggtgattgtagattgagaggttcgctgtcaagtgtgaagaagagggggtgcgacccctcgggggaaaggcaaccgtggtttatacaagttcgggccgctgagaagcgtaataccctactcatgtgctatgcttattgagagggagagattacaagatctccttgttggagtagaaggtgttgatgatgaggggcaagagactgtgctagtcaaaatggatcatccctccctcagtaggccaggacctccttttatactccatttgtccctaaatatttgacgccgttaacttttctaaacatgtttgaccgttcgtcttattcaaaaacttttttgaaatatgtaaaactatatgtatatataaaagtatatttaacaatgaatcaaatgataggaaaagaattcataatttcttaaatttt

SEQ ID NO: 31883 - DNA, 303 bp, Oryza sativa
ctgagaactgaaaaaaagtttagcagaaagctttatgccagttacttcctgactcctctatagggcagaacattgtagatttgtagtttcctcacatgttagcgtgcaggagaatttcgaacaaagggacatactgaagtagtattttgtccaaaataatgtcggccaaaggagatttttcacctttttgcaaatgtcagggtctaactttggtgttggagtgaaaaatagctgcagattatgtttagtttactttttagaactcgtgtgtataataatatcatgttttttcctctttgcagg

SEQ ID NO: 31884 - DNA, 845 bp, Oryza sativa
gtgccccacgtacttttttttttttttttttgctgactaggatgccacatcaacgaaaccacccatatatattgccctaggaccttgaatgcacggtttgtgtgagtttaggggtacatatttctggttttgtggttaagggaccttaaaaaatctcactgttaagttgagggacctccggtgaacttattcctctagctttccatccattcttttctactatttttttctttttgcaaaatactccatccttttcaaaatatatgaaattgttaatatttttacaacatttgaccattcatcttattcaaaaaaaagtttagtataaatatgtaaaagtataagttaggattatattttatttaatgataaaacaagtcaaaaaataaattatatatatatatatatatatttctaataaaataaatggttaaatgttatgcgaaaaagtaaatgacgttatacattttaaaataaagaaagtagatagaaaagtgttttttttcgatacgcatacaaaatgaagagcatgcgcactccacctgatatttctgcctcgttgcattcctaggcgcaactcagagctcgattttaatgcacgattttaatctgataaatcgaccgctattggggctcgattttaatcttgtattctgatcaggtcggattctcagagctgcgggcgaagaaatctaatttggaaggccgtattcgtatttttgaagagataaagggagtaaaatgaaaatatacgacgaccgctaagccctagaaatacccatcgcgccgcaagcgccaaattgagcccaaagtttgtgtcccctcctctcccttctccgccaagg

SEQ ID NO: 31885 - DNA, 469 bp, Oryza sativa
tccacccaccgccgcctatcatcgctccgcccgcagcccggcgccgcttcacgcactgcgctcgctcgccgttgcccatcgccgctccgcctactgccgcgctcggccaccgctgcccatcaccgctccaccctccgccgctctgctgccacgcgggcctgccgcctgcccattgccgttccgcccgccggccgccggcctccctcactgaagaggaagagaagagagaaaagagaagagaaggagaagaaaagaggagagggtggctgacatgtgggcccacacacttttttttatttttttttactgactaggatgccacgtcagcgaaaccacccatatatactgcataggaccttgagtacttggtttgtgtgagtttatgagcacatttctggttttgtggttaagggatcttaaaaaaatctcgctgttaagtcttaaacctccgatgaacttattccaaagc

SEQ ID NO: 31886 - DNA, 196 bp, Oryza sativa
tcgatgcccatgcttctggaagagatcattcgtccaacaacgctgttggaatgcaaacaaaggaagaacctgcatttagcaggaccctttacgtgcagagaagatcagctcaagcaaatgaatgctggccatggaagaaagcctggtatgccgaacgcgcagagtagcgctggtcatacgtccaacgccaaatgag

SEQ ID NO: 31887 - DNA, 1501 bp, Oryza sativa
ttgtttcaataatatttataataagcttttgtcaaatctaaaaccttttgaacggaacattctcattttatctttacgatactttttttacaattgcacagtacaacgcagacactcacaacgcacgcaaaccctacccttatgagcatcttcgaagactaggccggcaaatccatcctagagattgatgaagtcaccacaagcgcctcgctgtcaacagcaatccatccttgagattgacgaagtcaccacatgtcacgccccgaactagtaccgaccggaactagcccgtgacgctccaaattaacctgttaatcgataccagtcccaggaaacagtgctggtaccacaggaagacggattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggggattatttatatagagcaagggtgagtacgggagtactcagcaagccatgggaaataagtgtttaatgcaggcttcaaggaaaggctgttgtttttacaattgattttattcgaactcttttctaaaaacaactaagtgagtgcttctcaaacgacacggatgagacagtgcgtctcgtccggtcggagtatgtgcaatgtatcagtctttagaattgttcaagattggcacccggccaacaactttcaaacggccacccgggccaacaactttcaaacggccacccgggcctagctgatcccatcagctgcagatttttcaaacatcgaacccctttccataacagcaatctcacaaggcaatagtcaaacaaaactacgctaggaatcacctcacatccgcccatgaccgtgggcacggctgttcgaacagtttgttaacctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcgagagcggaaaaccgtacacccggtacgtcccccggtccgcggttttggaaattcatttagttcgcaagcaccgacccaggtgtcgggttttccaagt

SEQ ID NO: 31888 - DNA, 1501 bp, Oryza sativa
gaccatcatggtgtcacttgttgctgcgatctctattatgtggttctgtaagagaaaacataagagacagtctatctcttcaccctcatttggtaggaaatttcccaaagtttcttatcatgatcttgtcagagcaactgaggggttctccacatccaatctaagtggcagaggaagatatggctctgtatatcaagggaaattatttgaagggagaaatgtggttgcagtgaaagtcttcaatcttgaaactaggggagcaggaaagagcttcatcgcagaatgtaatgccctgaaaaatgtacgacatcgcaatctagtcactatccttactgcatgctccagtattgattcagctggaaatgatttcaaagccctagtctatgaatttatgccacaaggggacttgcataatttactatactcaactcgagatggtgatggatcttcaaatctgcgcaatgtttcacttgctcaaaggtaagcattgcagtggatgtgtcagatgcattggcatacttgcatcataaccaccaaggaaccattgttcacagtgatataaaacctagccacatccttctaaatgatgacatgacggctcatgttggagactttggactagcaaggttcaaatctgattctgccacatcatcttttgtcaactcaaattcgacctcttctattgcaataaagggaactataggatatgttgctccacgtattgtgaattatgcattgacatttcttgctattcgactgacacattgcaattttttcatattcatgtgagcatgtgaattagtgggaactaaactcttcctttcttgatctactcaatgtgctgaggatggtcaagtttcaactagcccggatgtttacagcttccgaattgttctactaaatatattcattctaaagaacccgacggatgacatgtttaaggacggactgagcattgtaaagtatacagagatcaacttgcctgagatgttgcagattgttgatcctcagctgctgcaggagttgcacatttggcacgaaaccccaacggatgttgagaagaatgaagtcaattgcctgctttctgtgctaaatattggacttaattgcaccaggttggtcccaagcgagcgcatgagcatgcaggaggtggcctccaagctgcatggaatcagggatgaatatctgagaggagactgaagattgaagaaacagatcactgatgattccatctgagattgaagaaacagatcactgatggatacgaggggaaaattatctgagatcagtactttttccctggataatttgtgaacgaactataatggcatgatttttgtaccatcataaatgtagttgatgcatggagtaccggcatcacatgccactgatgcatccggtacataatttactgtgttccaaatgtttctgtaatgatatcagttcttgttaatacagtgttccatctgctatgtcaagaaaacggaaactaatattgttg

SEQ ID NO: 31889 - DNA, 690 bp, Oryza sativa
catctaggttctaggaggttgttacatgcacaattttattggatcaaactactgaccgcaccatcccacgttccgattctggctccatctctctactacttaaaaaatccgtagtggtggtattgattcctgacatagcagacgcgtctgacagacacgcgtaatctcaaccatccaattgccatatccaacggcgtcaatcgtccatctcctatccatcacgcgatcactcctctccccatcacgcgctcgctcctctctcggatcgatctcctccccacgcccactcctccttcccccacgccgcgtccttcgctctcctccctgtgtcgcctccttgccccgccgtctcgtcgcctcctcaccagccatgcccgccggcctcctctccagacctgcaatcgccgccgccctctccaatctcctccgcgcctccacctcgcatcggattgatcctccaccttcgccctcctccctgcgtcgcctcctcacctcgccgccgcatcgcctcctcagcagccacggccgccggcctactctccagacgctccctcgctgccgccctcgcaaatctcctccgcgcgctctcatccctcccctaaccatcaccggccgcctccccttccaacctcccctagccatccgcccgtcgccccctgcccaccgaagacggatttcaggtaatgtgcc

SEQ ID NO: 31890 - DNA, 1501 bp, Oryza sativa
tttaaaacggagggagtatcttttttttcctttttgaaatggaccgtgcgaagtagtacgagtgctagacattctttgtatttctttagttctgataaattagcatcacataggttaatcatggattaattaggcttaatagattcatctcgtgaattagtccagggttatggaatgggttttgtcattagtctacgtttaatacttctaattagtgttctaatatcagatgtgacagggactaaaatttagtccatgatctaaggctgtgtttagatccaaagtttggatccaaacttcagtccttttcaatcacatcaacctgtcatacacataacttttcagtcacatcatatccaatttcaaccaaaatccaaactttgcgctgaacaaaacacagcctaaatagggcctgagtgatggatggtggaggctgacaggctgtgcttgcttgcttcgggaggagacaaatccactattgccctggacatacccagggaataaaatccctcgtagtacttctggacagagggagtaaatgtcataagtaaagagtcaacaatattatgtacttaaaaaaaagagtaattaattacatacagttactgagttaagcttgggctgtgtaagtccggtttggagcatatattctgctcaaccacagttccaaagttaaaacctcccccagtttgtaattgtagctactagtttgtcatattccaaatattcctatggagcaattgccattatgcaggctggtcatgacatatctaacctgctccattacagacgaaggtataggttacatttcgacaacatcccattcttaatgttctgcccaaatagagaaataattctggtagtatgttattatgtgaatagatagaaatacgttcacattgccatttcattcagtgcccactatagatcacgagttcacgactttaacagagatgcaaaccatttttattattaaaaaataatcttgcatgcgtctctatctcacttcaacaaaatgtccgacacaatgaggcgttgacatcagttttattcagttacggttggtgtcgaactgtcaatatcttaattaatttctcccggttatgctgatgcacgcacacccaatccgctgcgctgcatccctgcagcatcgatctaattttccctatataaaccatagctgcacatctcttcgatcaaaatcacgatcaaactcatccttgcgctcttgaaacagcagttaaaatcacgatcattagctcgctgattgataactaacagtggtcataatcatgggaaggctagtgacaacactgctcgtgctgtgcttgatctacgtgacgacatgttcgctctcgacgcgcacggcggcgttccgcgcgcacgacctccggcgaggtctagagcaagccatgcgcggccgcctcctcgccgacgcgacgccggcaggaggctcggccgtgcccatccactggtccagacacctctacaacgtggcgaa

SEQ ID NO: 31891 - DNA, 1501 bp, Oryza sativa
atatctaccagcagatgtggagagaacacctaaatcacctcgaatggaaagtggaggcaaagccattgcagctgcagagataggaataactgcatcctgagattgttttagtatggtattagctcatgctctagtggaacataaaatgtcccaaagataaaaaaaataagaaatgatcctggaaaagaaactagtatcatatcatattcaagtacggtgcttttacattttttacaaaatatgcctataaaaggatagcacaggaaaggaaagcattaataatttatggattgctcatgtgttgcttagtactccagttcagtgagtagtgagttcatctacacgactatggctgcaaaagtattttccaaagagtcacaatgcagacaaaagaaactcacaagaagctttttccactcctggactgcatcagcaccaacaaattcatcaaggtcctgaaagaattgcgagtcagaatcgtgttcagagcatccaacataaataaattgttagcatcaaaactgcataaatgggagagaacatctctaagttcaataaccagccataccatttgagaagaaataacatatctgagtgagaactgataatgtcacaggtaaagttaagtgaatggttccaacgattacatatctaatggcaaaagactgctcaccttgaggaaatcagttggacctatccgcgaaaggaactggccttcaggtacataaaccatccaggaatcatatgaggcacatggaactgattcgcctagcgcatcaaggacctgaccaattgaatgaccacatcagcttccaagctctcaccacaattaacttgctctaaacccacaatgccataatgggaagaacaatttgctgcaatcaagtatcacctgggcgaggggattggcctgggggcctctggactggaagccggagaacagggaagggcccgagtcgaagttgaagcccttgatgtcaaacgagtgcgcggcgcctccggggcggtcatggctctcgagcacgagcacgtcctggttatacctcgccaggagccccgcgcagcacagcccgccgatcccgctcccgatgacgacgacgtccgcctccggcctctccgcctccctgaccccgattcagaacgcaaaaccggctatgcctatgagcatcgatcaatcgccggagagtagtggtgcggtgcgaaacgtacccggagagcgcgccgtcctcgccctcggggatggaggggtccgcggggcgctcgtcggcggccaccgccctgcagcgcgcgggacgagcggcggccgcgcatccgcgtcgtggccgtggggcggtggtcggtggagcgcgcgggcggcgagcgcagtggcggggcggaggcggcagcgcgcgggaggccaaggcggcggaagccatgtcggaggcggagaatagcgcgcgtctcgccggctacgccacatagcttcgggatcaggccgcggttggagtgaggcggccgtcgt

SEQ ID NO: 31892 - DNA, 1501 bp, Oryza sativa
gacgacagagccaaggaggacggtggtggctcagcctcatggaggctcacggcagcaggaggacgagggtagtagcagcggtggatggtggcgagctctcaccgggctgcagtcgaacaaggggcggcgatcagcgtctaggacggtggccactcagcctcacgaaggacgggcggatgagtttctccgcagcggccgcgaagtaaaggccaacgacttcgttgaggctgtcgtcaagagttgaggtgatagtggcagcgtctcgactgtcgcacatggcgacgtccatgaaccgcgagatgagatcatccttgtcgcaacggatgacctaaagaggtagtcacaaccgtagtcgtcgtcctcctccttatcggcttggtggtggtcgtaacccgccgccgccgccgtcgatccggtccctgctcatacctggttaaggtcgttagcttagcataaaatttccctattgaagcacaagagagggagaaggaagagagagggatgaggaagaagggaatgagagaagatgacaaatgggtcccacacatatatttttaattttaatgacacataagcgccacatcaacgccacgtgtaactaagacaaggtcaacaccgccacctaggcgccacataagcaaaatcactctctaagaccgtcgagggagtcaagttacacccttttaatagttgtggttcaaggttatgaatcagattttgtcactagttaagggagtcaaagtgaacttattccttttaggaaacgaggggaatttgctgggaaaagcggcccagtcgaagacagaagatacagacggcccagtctggcccgtgaagttggcacccatatatatacggacgggatatctcttttttcctcgttgctctcctccccctcgagcctaaaccctagccgccgccacgagcgcgcgccttcgagcaaccgcagcaaggccatggcgcgccatggccttgctgcccaaggagatgcttcgtttggccttggccaggcgttgcaccggggtcttcatggcgaggcgtaccatcctcttcaccgcagccgatggaggggcgtcgatgatgctgcagagggcgaggagctctcacgccattcgtcaggctcatgtcagccgcgacttcgtcaaaactactatatatataatacccatatggggcaccatggtgcccgggcaccatggtatcaaaacaactcaaactcaaattcatttgtatgaattcgattcatacaaatacctaacaacaaaacaactcaaactcaactttatttcacaattcattattatatacctaacgaattatatgtttggatgttatatacctagaaccaaaatctaacaaaaaaaaagttcaaactcagttcaaacttgttagtaaagaagttaatgttcatatctaaacatttaaaaaaatttcatactcattcaaattgggtatatactcaatttgaatcttggagcccatactccatgtagcaccagtt

SEQ ID NO: 31893 - DNA, 179 bp, Oryza sativa
agaattttggagaacaatattgtagagaatgtaacttagtgcgtagtacagaaatgcgaggttaacgtagttattgttttcatcaggcacaatgtcaaataaggtcacattccagatagttcacggtgaaggaaatattagatttggtctagatggtgttgatctgtcagattttgtaa

SEQ ID NO: 31894 - DNA, 1501 bp, Oryza sativa
gggtagacatggagaacccacaaaacgacggaacacgtgcatacccacgtagtgaaacaagatcggactacctaaggcggaaggatgagcatgaacgtcgaattgctgctgaggctttagaatggcaggtaaatcccctaggactctccacgtgccgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatccccacaatggatgtacataggaggatgcaaggaaatgtcaatttgtacaatggattgacacagtcagagttacttccagtggcgggccgataacgcaacctgaaccgaccatatagttcattcatgctttgatggagtacgaacgttgggtggaaattgcaagcttagactggaggaacaatccattagggttacctaaatggtccgagcgttcaaagtgtgggtgcagagatcgctgctaggtggctacctcctttgcagaacaaacatttggaaggagatattttgtctgccccaatgtagacaacgatttcattgtatgtctaaccgtttccaaaatccgctatgatttgcacaaaatttctacccaaactgaataacattagtattttttcagggcaatccaacgatgtgtggatttactcgatggatcgacaatgtcactccatcatatcatggccaaaagataacagagtcagaaacacaagtagagtatcaacgattgaaggaccacgagaatgcaatgcatattgactgacctagaaggggccgataggttaccgcaggctagattcgtcgggatcgataaatttgtaccgtgtatcgatggcacttcttatctatcttatcattaaaatatttaattatggtggtgaatttttgtatgcgtaagactaaaaaaataataaaattgtatttcaccaatcttggagattttaatcttgtatagttttcaatacaaaagatttgataacaattttctatttataaaaatatctatttctcaaataaagcacaatgtaaaatcgccctcacccagggcggcaagggggccgcctgcaaaattccaggccccccgccgcctatttgcaggtggccccccgcacagtgtaaaatcgccctcccccagggcggcaagggggccgcctgcaaatttccatgcccttctcgccgcccatttgtaggcggccccccgcacagtgtaaaatcgccctagcggagggcagcaagggggccgcctgcaaatttccttgacggccgtcgcccgagagcgaacggccgtctgccacgtcacattcgccgccctctgggaaggcacccaaagggcggcgggcgagtacttctgtcaatttttgaaatagaaaattatttttgtaaaacttttaataaaaaa

SEQ ID NO: 31895 - DNA, 1501 bp, Oryza sativa
gtacaaagtaagttgtgttcattgttatcggtcagataacgcgcatatcctactaggatcacagtggacacatcaaatcccacaagcatgtcctcaaaatatataaacaattgccaggttgcaaggatggacaagtcccttggattgaagtatcttcatgatggaaagtcggtgaaacaaattcattgaaaaaacacttaattgaatttcaagttttgtaaatattccaaaaactacttatgtaccaaacgatataccataatattgtatcactgactagtgactattttaaagcttcaaaactcatcgtattcactaaaggggaactagaacgtatgaaggcattgaagttccaatgtagttaatgccaatgcctaacctcttatgcatgacagttaaaacctgttggaggcatgtcatgagggccttcgaccaaaccaccaaactcatcaggcgtcggctgaatccaagggtgcgcctaaggcaaagccttaggtcgaagctcttggacgaagccgagcgacgaagaccaaagggttcgccacaagctcaccatcctagggcgaaaccatagggcgaagcacctgagcgaagccaggcgacgaagaccgaaggattcgccatcaagctcaccatccggccgaatcaccactaagggtgaaggccataaggcgaagtaagaggccttcgcccgaagtagaagatgccttcagctaagggcttgggaggccctgcagcccatggaggcctttcaccactaatgggccggcccaagaagaacgccatagggcccatgaatatgaaagacattgtatacttgttggtatttcttaacgacattactagaactattgattcccagcaatggcgccagaaatagtcctagtatatttatggcttgggaggccctgcagcccatggaggcctttcaccactaatgggccggcccaagaagaacgccatagggcccatgaatatgaaagacattgtatacttgttggtatttcttaacgacattactagaactattgattcccagcaatggcgccagaaatagtcctggtatatttatggttacagaagtaatctgcaagtgcacgaatgtaccattgtagcatttcatacagaagtattccaaggtatcgtatttttaatcccaagcgaagataataagagtgaactttgctaatgcactttaaacatatattacttgtaattgtcaaagtctaagcaggggttaagtttaatatataggggtagactgacacgaagcaaagctaatcaaatcctcataataaagtaattctaactaagtggaagaagaattaggaagcattcaattcctatacttctagtatacactcaaatcctaatttatatatgctagtatacaattgtttggccaatacccctaacagtgccctcatggtacttcgagagaccaccttggtttgccgagttctttacgacaacctatcatggccgtccaaccgaggctaaa

SEQ ID NO: 31896 - DNA, 1410 bp, Oryza sativa
atttccaggtttggatcaatgatgattggggaactggtgattggcatttcagtgtgaaaaaaaatgatgtagaattttgagttcattcgtttggtattcgtgattggtcatggtggactagatatttttgagatttatgcttgttagacatggtgcatgacataaagtagttaaaataactaaaatgtcctgttgccatcaccgagtattgccattaggattgaaatagtctgtagaagaagaaacaaggaaaggaaaattttgttccatttgttggatgttctatggtgttacagacttggcatttcaaagcctcctctcactctccctctgggacatgtggttctctagtccttggaccaaggttaagtagtgctgttcaacctcttttctatgggctggagagaccctgcctgagtggctgctgttggggttttgagtgggttggctaaccggagatccctagttataacccctcgtgagaatactctcacctaatcgtagctaggattggattttttttgggacggagggggtatgttgcttcacttgtcaatagaatcttgctcagtagtcaggaccaatgacattttttcctagatttagtctggttgcagcagagtgttaacttcaagaagcttcagcccttctattgcctgcttcttgttgagcacctccaatgttgcattagtggtaggatgttacacatctaccatgagaacaataataaaaatactgatactgagatcctagatgcctggtagatgaacagcctgcagaatgcactagccccacttgttgactacttgcaaaaccagtctcaggattgatatttctcctttgcctttgtttttcttataaaatctcattttgtatgcctggtttctgatgtacttatgtcttgtggcagttccacatttaactatccaattaatttaagctgttttggaccaaaatatttgttgcggtgcttcttttggagtaattaattttatgtacacaactgcctatgaggattactcaaatcattatgcctatgaatagctcaagatggaatatggatttagctatctacacaatattttcaaccatctacaaattggagctgcttatgttcaatatgcttagtagttgttgaatatcatgtttttatggggtatatacacatgttgtgtgttgtgtcagtactgtcatacatgagttggatactttgatttattcatagctccatgtaatatgatggcatctgatttcttgtatttctctgtggttgtttgtcttttcgaaattcagctagttttttttaatcacatttgagatatcttgcagatgagaatgctgattgtacttttgtgcttgcagggacagtacaagacaagtcgcacaaaacagaaaatcttgtgatagttt

SEQ ID NO: 31897 - DNA, 1501 bp, Oryza sativa
caaaatccatcgacaaaagtggttgctagggttcatgagcgataaattacgattataccccgtgcatacttttttcttagataatactacccctccacgtttctactactgttaattatggtggtagtagaaataaacctcaaccatttgattaaagaaaaagtacgaattaaccccccagactattacgatagtatgaattatacccttaaaccacaaaaccagacattttataccctgaactatctatactagatgaataacccccttcgatccaatccaaagcagtattgtcctacgtggtatgcaagtggcaatctagttagcatttctttttaaaaaatggtggggccacctgtcatactctccgacctctctctcctcccctcttcctcccaatctctctctctctctctctcttcccctcttcctctcaatctctatgtcacagatgtggagcggcgagttggtggccggcgatgggcgtggcgggggcgcggcgagcgtgatggagaggtgggcgacgtccggcgggcggcggacgccgtcgccctcgcacaccaccgggagcagctccaactccacgcgcggtcgagctcctgctccacgcgcgccacgggcacggtggggcgcgaggcggcgttggcggcatcgtcgtcgcccacctccttgcgcggtcgagctccagctccacgcgtgcgctcgaggactccgtcttgaccacctccagcacgctctccagctccgccacgtcgcccagccgcgcccgccgccgccgcagccgcctccgcgtttctgggattctcagtccacatcatgaagaaagtctgttcactactagaattacattatccattaacttcttcagaataagaaaaaggtgaattgaaggagtaaatcagtgcaaatctgatgccaacaaaatggaaaaatattcagcaaacagtgcaacttttggattcaaatgtgcttttgtttgcacctccactgttctactgttatagagcttttttggctccttgcaaggtgaagctgtgtatcagctgcgtcaggctttcatacgaggagcctcctttctccatggctctgcgagctttctccccgtactccttcgccttcctcctctcgccggcgtgctcgccgccgtccatcagcgccatcaccgcccgcgcgacgtcaccccgggtgacaggtgaccgccatggcctcgtcgccgagcagcagcacgggcgtcgtcacgccgacgccgagcacgtcgacgacgagccgctcgttcaggaactggtcggagaagtgcggccacgccacgaccagcacgccatgggcgatggactctagcatcaagacctccagtggatttatgatgttgtactcgcgagcctgattctcgctgggtctcttctgttctgtagttctgtgaaggactatcaacatacaaatgcacaataatcctggaagctcaaaccggtttggtgaattatgcccatttaatcgacagagt

SEQ ID NO: 31898 - DNA, 1501 bp, Oryza sativa
tggagattttgatcgatcaattagcttttgatttgagaaaaaaaaaaagggctcatgtgtactcatgttattgcaactttacacgcgctggagctagaaatagtgatcaatcaatcaatcgacatctgcttcgatctgcgagagaaagtgcgtcatctgaagaaaagttgaaacttcgtggaggtttcaattagcttgcgcatcttgtggtccatgtgtgcaaacattttgtgagtagtggagatgataattacatgatagatacatttatatatatttattcagcctagctagctgaatgaatggccagaagaaataattaaaccgctaaaaaaagattaatgttaaatgagactaattaatatatttaatggactgtactacctaacgagaggggatatgatcagtctccacccttcagccacacaaccatagcatccaatgaactggtccctgaattgctttctgctgatacatccaaaatttctctcaagttgtcactgatattacgaactagattatctggggctaattataacatggtccactggtccatgcataattcttgtgcataatactgtagactgaatttagatccatttatatgatgatgatgattaatttctactaccattgccagtgctctcatatatatctcctgtccttctcttgtcactctcatatatgtgctctctgtcatacatccactcgattgcatgcactagtagtgttatttcagctagaagagtcaagcaactggacgaactgattgtaacaaaagggactggtcgatctacccatgttgtcaacacaacactactccagttgatagcactagcagcttgcatgcatgtgaaataatgccactgtatagtagctggcatatgcatatatacgcccctgcatcactaaaagctagctagtagctactctctccgtttcacaatgtaagtcattctatcatttcctatattcatattgatgttaatgaatctagacatatatatctatttaaattcattaacatcactatgaatatagaaaatgctagaatgacttacactgtgaaacggaggaagtacgagcctgcatatgcaatctagtacctcccgcaaaaactttattcctagctatgaatgaatttagacaaatatttaaccaattgtaaaatcagaaatgaatctttttgaaacagatgtagcaaatactaggagctagtatttatccagttgtatagtcgatcggaaatgatttcagacttcatcgtttcgcttattgacggaataagcgaaacggcatatttacaaataaaaaataatttataaataaaacttttatatatgtattcttagcaatctaaaaacaaagactaaaaaataaactacgatgaaaaacctcaaaattaactctaaatttaaatttaaaatttaaaattttaatttataagcataagtataaatcaaaagatgaggctagaagtattttgggggacagatcgagt

SEQ ID NO: 31899 - DNA, 581 bp, Oryza sativa
aacgcgggacctcaacggtctgtagctccaaaacacgggactaacggtcccgcggctccaaaacacgccaccatggtagcaagtgattttttttaccgtgtcggtactgcttagtactgttttgacactatgtttgcactgtttggaactgttcacatgttggttcccggcagtaaaactgctggaactaacatgtgaacagtgtcaaacagtgtcaaatagtgtttcaatagtgccaaaaagtattaattcgatgtctaccgcggtggcgtgttttggagccgtgggaccacgatggtcccgtgttttggagctgccggaccgtcgcggtaccgcgggacgggtatattttcgcaaatccttcccatgaaggtatatagacgtaaattattgaaagaataagtatattcgcaaatttttttcgagatataagaaggttagagatcatatctcgatgcaacagaaagaactatcaatatgcttgtctccgcaatatactcagccatagagccggtccatatcaaccttgctgtaacctagtgtctctactcaatgtggactaaccttgtgacggggccaat

SEQ ID NO: 31900 - DNA, 1501 bp, Oryza sativa
ggaaacaagaaggtacccaatattatatagtatacatcctctgagaggaatggaaatgtggataaccaatatcgaccagagcagaagttctcccattcattaaaagaaggaaaagaaaacaatttctgcaaccttgccgggtcaaccaagctagccatgggggaatttgcagatgatcttgggatgcttttaagactcttcgccactctcttgacgacatgtaagacttgtggtggagacaaatttcctttctttttggttgaacatattgtagtccaccagaacgaaacacatcatcatgtacaactaaagttatgtttgacttctgttgcagtatgagacaagagttagtctctgtgtgagcaggtagaagatctgtttgaatctaatgcccaattgtgacaacgactaccaaatccaactctggtcaatgcagtatcaaagctgtctagtgtgtacatgctgtgtggatttatgaacatactaacttgcaaaagaaggcgttgatcaatggaaccacatcactacataagcatacaaaaggtctaaaactaaaaggacagttggttttaaggatatccgtacggaggtcacagtaaaccaaatcctagggaaattcatgttgcctatccatctagagcgctggaaaataccatccaattccatagcaagactctccctactcttccatgcaattgcacatgagacaattagagattaaaaaaaaaagacaagcacttcggttggaactgaactactgaagaaattcctacgatggcgaactcaaatataagggagaggatatgccttggaatttgggggagaaacagaaaccgtaggttgttgttgctgctgctgctgccatggaagcacgccaacagcgacaggcagccgctcgccgtcgtcgccgcgcgccatcccccgcctcgcggtcgcggatgcctcggcgccggcggcccctcgccgcccgccgccgccgcggtctcgcgaccccaacgacggcgacgagcgagataggtacacaccgtcacagggctttctgtgagatgagcccactacacgttacggaattggcccatcatgaacccggatcaccgaaaatagggccgatacggatctaggtgggccgacacggcccaatataaggtgggctcatcatgatgaacaccgagaaagccagcgtgcatgcatgtgagcatgtaggacatctgaagcgaagaaaaacattcgtattataatttcttacagcagcaaaaaaagagaattacatcagactttacagaaaagtatcgattcaactctcttcattaattacagatcgatcgaggaaacaagcaacgcatatgcataacctctgcttcaattcgatcaaaaagaaaaaaaaaacactccgaacctctgatgaagatgaatttcattagttcacttcacaaaagggcactacatcatcacgctttacagaaagaatcaattcaactcttctcatcaaattacagatcga

SEQ ID NO: 31901 - DNA, 1497 bp, Oryza sativa
ctctctctccctcggattcgttcgggatctttccccctaaatctcgccggcgcatcaatggcggccggatcttccgcagccgtttccccctcatccggccgctctctccccctcccaaccctatataaacactccccgtgcctccctccgccgtttccgaccctcgccgctctctctctccgccggaatcgagctcgcgccgtcgctctctctctccgccgtcaccgccgagctccggtccgccgccgtcgtcgccccggaccttctcccgcttcggcgtcgccttcttcgggttcgccgcaacctcgccgacctcgtccacctctccgtttcggtcgccgaccgccggaacgccgccgtccccgtcgacccgtgccgcgccgccgccttcctccgctccggtcgccgttcccgtcgtcgccgtcgacccggggtgagccgtggaccgccgattcgtttcccccttccctcccctctctcggccgccgctccgccgtgcctatggccgccgccggcgaccataggggcgcgggcgcgccgcctcccgtcggctgtgccggcgtggccgccttcgggcgcgtcccgcggctgccatgtggggcccggccgtcagccgcccgcgccctcgggtgcggctgacgcatgggacccacggcgccggccggtgtgagccgggtgcacccggtccaccgtggaccgtgaggctgccgcgtgggccccactcccgtggacccggtctgcgcgccctctcccctcggctgacgcaataaatccattttaaattaaaatttaaatgaagaaattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagacttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgctttaaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctaattgattaggtaacattaggcggttttacaactctagactttgggatattcatatcacctggacactttggaattgttggagtattgtggaattggattcacaccgccccctctattcaaaatccccaaaatggttttaggctgggctcagggtgcatggttttgatagtagcacctcggccatataaggaccggt

SEQ ID NO: 31902 - DNA, 373 bp, Oryza sativa
gctaccggttcgttggagagaggagacgagccaccgagacggagcccgaggaggaggaggctccctggcgcgttcgcgggttcggtagagatgatgatggcggaggacggcgtgccgttggccgagtccgagtggctgcgtcggtggtggcggcgggactctggcccgctcgaacaccggccggctggtcttgtaggcagatggcctcctatgcacgtatagcaaaggaggaaaatgatgtaatcttgcgcatttgtcacatgtttttcattcagtttgttagctttggattctgcggaatcatcttgggcagactggatctggagagaatttgatgggcaatctttgatgaaaaccttacctctgggccagc

SEQ ID NO: 31903 - DNA, 363 bp, Oryza sativa
tcataacaatttattcttggtaagtattaaggctggcccaatcagatcagtttattcttgattccatgttaacaagctggcccaattaaccattgatcaatattttttttggaagataaacttcatttaataatgccatgaattggagaaggatgagaaaacaaattactagacaatattcagtggtattatttgggatgaaatgttttaggctaatatatttttatttacattccccttttctaccctctaagtaaataactgaaaatagacgtcttagcttcttttcgattctcagaaatttcgctaatttgagcaagttcagcagatcgccatgcataaccccgcagatcagagatctca

SEQ ID NO: 31904 - DNA, 1501 bp, Oryza sativa
ggtactttaggttttttttttcaatgatcataaacgatttggtaccatgaggtaccggcaccttgagatactttttttttgacttgagcaaatctctaagggcatcaccaatgtatatggtaaagtgatccatatagatgggacccgcataaatagtttatccttatggcaatctccataacgtatacagatacaaggtatcattaggagaagagagaggagatagataatataatttatttcatatgggtagtccatatgcatatgggtatcttttgctattttttctatatggactagttgcacaatggtaataggtggctgaatggaatattatattgcttatgtactacttttacaccacattgtggatgccctaatccataacatgtggcgcatatgtcccgattaatttaaaaacaatccatatggagcttttcccatccatccaaacatccatagaaggctaaaggtaaaaaaagggcacctataaggagactggattttaaacttttgagggaatgtcccctcgttatttgcatgtcacttaaatatttaggaaaaaaaattaagaagatgtatcaatatatgatatatcactccaaaaaaatacaaattaaaatttaacttttacatatcgcaaagaaaaaaaagcaaatttgactagctgtagtttaatttgcattttgttgcaatatgtaaaaaattaatttgaacttgcatgtttatggagtgatataccgcatattaatatattttttcaatttttctcataaccatttgagtgatgtaaacaacgagagaatatcccatcgagagtttagagtagtttccttatatataagtatcaatatgtgctggtcctccataaaaacatatattccatccgtcccaaaatataagcatttttaacatagtgacaagtcaaacagttttaactttgactattaatagaaagaaaaaaagatcaaccatgtaaaattgatgttactagctagatttatcattacacaaactataataacatgcaactctttttattcaaaacgtcttacttttatatatcgttgaccaaaatagcatctcggagatcgtgttagaatccaaaaatacttatattttaggacggatggagtagtattttctttaagataaaccaacattataacaaactaatttataggtgtcgtgtcgtttttttaaaaaacttgtactcgtaaaccgcaaagccgagtctgagccgggcctcatctgtgaacgtgattagctgatctttgctgacaagctagagaaactaattgacggccggactatccgtgattagctcgtttacactatttgtgagggcatttctgtttctgcaagatcagcttacgatccagctgatccttctccctattattcagattatttccccccataatatcgatccgtaattaagtcagcaattagtagttttttttcattgatgatctgcaagtcatacacgaggttatatttg

SEQ ID NO: 31905 - DNA, 1007 bp, Oryza sativa
atgagccaatattacccgatacaattggacgggataaaagccggcgacgcggcaatcgcgctgccgccgagcggcaacaccgtccttgtccagaccttggcgccgatgagcttcctggtggacagtgcgtaccaggccctcaagaaggaggtgacgaaggccgtcggcgctgcgccgacggcgacgccgttgcagcctttcgacctttgcttcccgaaggcggggctcagcaacgccagcgcgccggacctggtgttcacgttccagcagggcgccgccgcgttgacggttccgccgccgaagtacctgatcgacgtcggcgaggagaagggcacggtgtgcatggcgatcctgagcacgtcgtggctgaacacgacggcgttggacgagaacctcaacatcctgggtagcttgcagcaggagaacacgcacttcctcttggatctggagaagaagacgctctccttcgaacctgcagactgcagctcacttatctcctaatcgatggcttcttgatggaagctgttcttgccttagcagcttagctagctttgctattcaagcttccatatttgtgtcattgtgtgtgtgtgtgtgtgcaagtgtgcgtgttcatagataacgcagccaggcgcccaggtggcatgagctgcagcatacttttctttgctctccagtgtgggtagcgtcgatctaccattttctacttcctgaatctatagtataggctatacgtgcttgtgttggaacgagatcctctgtaatactgagactgacatgtggccccagttacgcaaggcccacatgtcagctgcttctattacaggggaaactattttgatccctcgagaagatgtccactcattatttgcatgccactaaatggttacgaaagaatttgaaaaaatttaagaagatgtattaacatatgatataacactaaaatatgtaagttcaaattcaacttctacatcttgtaacgaaaaaaacagtatataaacaatcag

SEQ ID NO: 31906 - DNA, 1501 bp, Oryza sativa; identical to SEQ ID NO: 28498

SEQ ID NO: 31907 - DNA, 961 bp, Oryza sativa
ggcatgcctcttgaagtcatcaccgagttcttctctgtcggagcaaagcaggccaaggaggactagttgctcggatcaagtgatcaatcagattgctggtggtaattttgttgcttccaaatcgcgctgcgggttaaacctgtgatggatgctttgttaaagaatcttggaagagatcaaaatgcagtgagcctaaagagatgatttggctgtacatcatgaggctgaatcctgtcgtagactggattttggagcttaggatatgtagatcatctgttccttttggtttggtcattttccatttgtgtttctttggaattcttctccctgtaactagtggtctatcacagttgtgttactggttttgccttactcttgagtttgttttcttctctcggttgtgagttctgaatattagcatagccgagtactagttctgaattggtttcctctctgctgaacatctttcattgatgcttggatttcatcaagtactaaaaacccaagctcacagggtaaaaagaaatggtgaaaggtgaaaggggagaaaaggagaagcaaagcaaaggtaatgctttgagttccatatacccaggaaaagaattgtgcccactcttgtaaaggagttcaggagtaggagaagtactttgtgaataaaatttcaattttgttagctgtcagagtggaacccaaaagctactgtcccagcagaaaagcttcgagttctagtggcagcttataaattaaagcgatgcatgatggtgggaagctgtgggttcagcatgcagcaatgtgcagtttggggacaagctggagcaacagaaactgtgttggactctggtgtactccctccgtccaaaagaaaaaaaaactctagattttcgtgtctaacgtttgatcatccgtcttatcttaaaaaaatataaaaaaaattaaaaagacaagttataaagtattaatc

SEQ ID NO: 31908 - DNA, 827 bp, Oryza sativa
tccgagttcggcgagcgggaggaggtccgcgtgatgccgcagtgcggccatggcttccacgtcgcctgcgtcgacacctggctccgatccaactcctcctgcccctcctgccgccgccccatcgtcctcgacgacccctcgccgcccaagcgctgccgcaagtgcgaggccatagtcctcgaggccgtcgtcgccgcctcctcctcctcctcctcctccgccgccaccgccaccggcagcggcggaggcggcggcggtggcggtggccgattcttgccgtagtgtagggaggatggttgtgtccctgacgggtggggcccaggtcggtgtgggtagttgagctgctcctttccacccatggcccacatgtcagtagagagagagctcttgaaaaagttttcttcagaaaaagaaatggaaaggagaataattagaacttgtgaatgaattgtgattctttttttacacctttttgggttccttccagcttctgtcgggggcatgacatcacatacagtcgttgttgatgtaatctgtaaaaaaaaaattatatcagttatggttggggtaaaaaaaaaagatttttactagacctaagtgtcttgcaaattttagcaaactaatcccatctgaaattatatcagttatgcagcatgagagtaatgatacttcccagctgagcagatgcatgccacgtggaggcatccgcagccgttggatgcgagaagagggagcgtgtgaagtggagtagccgggtggtctgcctcaggggcgttaggtcagtgacaataatcatcagtcgccatgtgaccgtgaggtttttgtct

SEQ ID NO: 31909 - DNA, 1501 bp, Oryza sativa
gttagaatcactggttagtagatgtactcaaggttaaaaaaccaaatcacacacaataatcggaccggatgggttttctaaaacttttaacttattgagaaactgaactgtttgtgttgtcaaattggcctaagaagtgtggtttgttttttttttttgttggttttgtgaagtgtaaaccatggctgtacctccacgaggccaccagacatgtgggtggcacgagcgagcgtgagggagagggaaagacgtgtgcataaataaataaatggcgtcgtcaacggccacctgccgctgcccgccgcacgaaaccgtggtggtccgccgcgacggcgatcaggcaatgacgctacctccagctgcgcggcggccgccaacctatggcttgcccatttcttgcgtatttaaaggtaggggtggacattcggtcagaccgaaaaattcggtctcggtcttcggtttttcggtcttcggtctttgaaaactcaggaccgaatttcatccaaaaaaaactcaggaccggtaaattctgtctcggtcttttcggtctcggtctcggtctcggtctgaccaaaattttcaggagtaagtttgaaatgaaaaattttgacagcacttcctctcttttgagacatttcttcacagatatatatcaaaaaatacaagataatatgcaagaataaatagcacagccgcacaattacaggtgtagtagtagtttatagtttatgctacctgctagtactggagtagtagcgtctttttgttgttgccaatctttattttttaagcaaccactacaaacatcgaccagcggttgttgccctcttggatcaggtacaaacagaacgtgatggagatgttctcttcgattcaatcaatcttcggttccaagacctgatctaaccaactgcaatgcagctttgcaagtggagctccagtactacaagagtttctgaagtctcagctctgaaccaatactcccaccgtccaaaaaaaaaagaaaaatatgaattttttttataattagtatttttattattgttagatgataaaacatgattaatactttataacttgtctttttaattttttttatatttttttaagataagacggatgatcaaacgttagacacgaaaatctagagtttttttttcttttggacggagggagtacaccagagtccaacacagtttctgttgctccagcttgtccccaaactgcacattgctgcatgctgaacccacagcttcccaccatcatgcatcgctttaatttataagctgccactagaactcgaagcttttctgctgggacagtagcttttgggttccactctgacagctaacaaaattgaaattttattcacaaagtacttctcctactcctgaactcctttacaagagtgggcacaattcttttcctgggtatatggaactcaaagcattacctttgctttgcttctccttttctcccctttcacctttcaccatttctt

SEQ ID NO: 31910 - DNA, 1501 bp, Oryza sativa
aacaaaagcaacttggaaaagaatcaaatcttgatgcaccatgaagcccatcagtgatacatactcctaccaagtagggccaaaggccagcagggttagatctaccacaattcctaagctactacatctgccatccgaatgtgcatatcatccacttcctttcaatttgcattcaccattccaaccaatcgacacaacagcagcagcaaagttatgagaattgagagactctatacacacagctccccattcacatggctcaaaatcagaacaaatggtggttaagaaaaaagcaggaggttagtcgaagctcgatgaccggctccagtacccgtcagctgaagtgtccatggtctgttcagtgctgcagtgcgagagggtgtcatcctccacgcccagcaacgcgaggttcaggtgtgactgcatgtttgagtcaggagccgccacagcctcctcgtccgatccgtcgaagctcgcggtgacctgggttcttgcccagtggatcgtctcgtcgtctccttcaagcagtttcaacatctgtgttgccagaacatagcaagttgaggtcaatcatcaagactttttaagtatttgtacatgtaatttgttcaggttcttacctgtgacatttcgggtcgggaatgagaagatgtccttgtgcacagcgaagctgcgagagtcatcctctccatttcatcacagtcataatcatttcccaagaatggatcaaccaattgtttaatttccccacttgatagtaatggctttgcctgaatccgtcaacaaagaattagcaaaaagaaaaaataattaataactcgctcgtgcaggagtgattgtgtggtcaacagagcaaaaaaaatgcagcaatggtcctagacagctttaattccaacagtgactgaacgtgcaactaccattttgttcttggctcagggcatgttactgctcagagcaagccagccaggcatatagggggttaaggatcactcacccatccaactaggctttcctgaccctttgaacatcctgttctaataggtcttcttcctgaaataatctccagaattacaactccaaatgcatagacatcaatcttctcattgaccttcccgtgcgaaaaatactcgggagccaagtatctgtcacaggagtagtttgcttaggcatttcacacttgataaaagtagcaatagctggtaaaaatagcatagagatggtacttacccaaacgttcccgtgatgtcagtacatgttaggtggggggttgaagctgagacttgctttgccaacccaaaatcacaaagctggaaatttcaaaagagatgatgtcataagcagaatcaaaattaactagtaaggctaccaaatactcaatgtaattcgtcactgctaacgcattaaagcacttgctttgatctgaaaaaaatatttactgtatgaagaaaaaactataattgcttcaggtatttcagtatttgcaaatctcttatggttattt

SEQ ID NO: 31911 - DNA, 194 bp, Oryza sativa
ctctctctccctcggattcgttcgggatctttccccctaaatctcgccggcgcatcaatggcggccggatcttccgcagccgtttccccctcatccggccgctctctccccctcccaaccctatataaacactccccgtgcctccctccgccgtttccgaccctcgccgctctctctctccgccggaatcgagc

SEQ ID NO: 31912 - DNA, 1501 bp, Oryza sativa
ttttaacttataagtataagcataagccaaacaatgaggctgtaaagcatcgaaaatagaaaatactaaaatatagtgggtctatttgttaattcctgtaagtttatcctaattatcaaagggataagtatttattttcaattataatatggatggcacgagctcacacatcacacttatatatacctgcaaatgtatcctttaacgcacgctcaaaggaatggaaactaccaacatgtcctcgattcgtatttggaaacatattacaataagcatgcttgtgccgacatgtgcgcacatcacactcatacactcacaaagattaatactagtaaatctctacttggaaaaatagaatcataatattcgaagaatttggatttaaaccctgctattcataagtatgatcatgcacccatggcttcatcgtcctatcacactctaaggactatataaccaattttatctttaaagtaaattatagtttgttgtgaattctgctctagtgcgttttagatgtgcagcatgcgtgtctctatattttgaagcaatgttataaaaatgctctaccccttgttctttctttcctcaaccttggcaacggctttctgacgaccgtttgtgttgtctatcttaaactctgctctcttcttctaatatattgatatataatttttttgcgcttttgcggaaaaaaaaaattgcttggttgcagtgcacatgaaaatacaaaacagtggcattcattcatattcatattcacgcgggatatggtacaggtactaggtggtgagggcattggggagcgaggtttgagtgccgaggaccttgccgccgacgtcggggaagcagtcgtggccggggagagagcggacgcggccgtccttgtccaccttcaacgggtaacacatcaggtgccccttcgtctcctccatctccggcgacacgtacgccctccagttctcctccgccatctccctcacccgcctcacgcactcccccgtctccggccgcccgaagcactcctccaccgccccaaggtgctccgcccacagcgacatcctgtacccgtacacctgcaatgcaaaaaaaagtgaatattagtgaataacctaatatcagagttggaaatttcgaaccgaaatttcggtcattttggtcccctccgatacgatattacttcggctaaatttttttaatttttttcgtgaattttggtaatatttgttcaaattcaactaaattttgttcaaaatttcggaccaaaatttccgaaatttcgggatttcggtgaactccgatcaaatgggctaaaaccgatagagtgaaccctacctaatatcaaataattaaaaggggtgaggcttttgaacctaggttggctagttcaacaccttgtggagttagcaagaaaatcctcgtttctctacatctgcaatgcaaacacacatctctctctctctcgtcatcgatcgtaatgaagctctttggatgaactgta

SEQ ID NO: 31913 - DNA, 383 bp, Oryza sativa
cccaagaggaagggggggggaaaggacttttagggattttctttttataaaacctttttaactttgtttatttcttctcaattattatttgtgctctgaaaattccactaaaatttgagggctccttttagaccaaggagaatttaacaaaaattctccgggccacattcgaatttttcttatacgtattttaatgtttgccaatttcttttcgaattttaattaattctattattccttttagaagatgatttttattttgggatgaatttatcaggacgtgacagggaccgagcgcagcccccagtcccgcagggggtccagccgcactccgtcgtcccgggggcggaccgtgaccttttcttccccgatccccgcgagta

SEQ ID NO: 31914 - DNA, 1501 bp, Oryza sativa
gctaccctataatgcattttaatccttgccaatattgatcaatgaaattaatattctatcataaggtagcacgtcaatgccacaagagaggcagtttgtaggttccaagcgttgaaaaaaaacatgcatgagggagcagtagctagccggtcgatctttttgatgtgcggttgtgttggtcctcctatagtcgacatgagcaacgccctgatttgtcatcacacggcgataatgcaatctaaaatactcgctccgtcttataatataacaataaagtagaatatccccgtaaaaataaatctagtagaatataagatatatcttaatacgatgaatctgaacatgagctatatctaaattcgtggtagtagcataagttcagattcatgcgtcggaaaggctaatccgcgcgcgcgttgctggcgcgcacgccggcccacgaggcccatgcacgcgcatgcttttgcgcttctctcttttttttcttttttttacgccgctgtttcttttttttcgccgtatattgttcctgtcgtacggataaaagaaaaaaatataattagtttagattagcttcatatttttactagtggttggtttactagtaatttttaaattttaactttaaaattttcaaatttagacatgaaaattttcaaatctcaagttgaaagtttcaaaattttcaaatctggacttgaaagttttcgaatcgagttgaaagttttgaaatctcgagttgaaagttttcaaatctcaagttgaaagtttcaaaagtttcaaatctggacttgaaagttttcgaatcgagttaaaagttttcaaatctcgagttgaaacttttcaaaactttcaaatctgtacttgaaagttttcgaatctgagttgaaagtttttaaatctgagttaaatatcttcaaaatttgactttaaaatttaaatcttaaatcgaaagtttcttaatctaacttgaaaaattttcaatctgttagtaaaaatatctcaaaaaaatctctaaaatctttcctaattactgttattagtgttaagtagtgttaactaatactaatataatactaatataggtggttaggtggggaagcgcgtatgcgcgagctaggcgcccccctacaatacactgaaaatattggtcgactccgcatcgtaccgctctctccctcttgtcgttttaggcccacgagcagtaggaaagcccaccgattagaactcggtccatctcgcactaacgggacgggagcccatgaaaggccgggaaggactgaaggagagcccactaagatatctcttgcttactccactgggccgcatcatagcaaacactgccgaattttttttatttataattttttttattaaaagttttacaaaaataattttccattttgaaaattaacggaaatagtcgcctaccgccctttgggagggcgatttttaaaaatcgccctcccagagggcggcgaaaatgacgtggcagacggcc

SEQ ID NO: 31915 - DNA, 245 bp, Oryza sativa
catgaatggaatctgttgagcagcttgcacccaaatgcccatttataacgttggcgtgtaaatatggtgagcggaactctcccggtacctcacaatcctacaattgtttacaggatcaacaaacaaaaaaaaccaccgtacggtagaacacccacccaattgtgcatgttcttttaaccatcacagcaagcttacatgatctgtggatgcagaactgtttgttgcatggtttacttatacccagt

SEQ ID NO: 31916 - DNA, 1501 bp, Oryza sativa
ccaaatcgtttgcccgtcacaggtatcccgacagaggtgtgaggatctggcgtagtgtatggcgtctacgagtcgtcgtcgtcgtcggggtcggcacgcagcttcacgaggcttgggtggtgcatgaccgagtacggcctcgacgacgacgccactgacggagcagacaagcaggtgctctgcaaggtctaccgctcgccgcgcgcggtctgcgcggaggcgcgcacggcggcggcaaagtgctccggctccaagaggaaggcggacgacggcgtggatcacccggaggcgccgccgcccagcgcgcggccgcggcaagaggaggccgggagcgagcacgacgagcagtcatcggagctcctgccggagttggacctggacgcgctgctgtcggcgccgatggacgagaacctggagagcacgttcagcacggccgccacggaacaatacatgaggtatctgttgaacgacgagcctttgccgtgggctccgacgacggagcttgtcgacggcggcggcggcggcggagacgagttcatccagacggcgaacggaccttgcatggatggcgaggtcttcacgcgcctggctgccggagaaacgctcgacgacattcttggctcgacgagttcttgattgatctctattgtcagcggctgttcctctagcactagtagtgtagttctttcgatcgaatccgatcgaagtaggtttagttagagagattcatggattaggtatttgtttgatccgtgaatagacactgagctgcatgaagatatgcattgctcgatcgatcgatctgtaatttgatgagaagagttgaattgattctttctgtaaagcgtgatgatgtagtgcccttttgtgaagtgaactaatgaaattcatcttcatcagaggttcggagtgttttttttttctttttgatcgaattgaagcagaggttatgcatatgcgttgcttgtttcctcgatcgatctgtaattaatgaagagagttgaatcgatacttttctgtaaagtctgatgtaattctctttttttgctgctgtaagaaattataatacgaatgtttttcttcgcttcagatgtcctacatgctcacatgcatgcacgctggctttctcggtgttcatcatgatgagcccaccttatattgggccgtgtcggcccacctagatccgtatcggccctattttcggtgatccgggttcatgatgggccaattccgtaacgtgtagtgggctcatctcacagaaagccctgtgacggtgtgtacctatctcgctcgtcgccgtcgttggggtcgcgagaccgcggcggcggcgggcggcgaggggccgccggcgccgaggcatccgcgaccgcgaggcgggggatggcgcgcggcgacgacggcgagcggctgcctgtcgctgttggcgtgcttccatggcagcagcagcagcaacaacaacctacggtttctgtttctcccccaaattccaaggcatatcctc

SEQ ID NO: 31917 - DNA, 1501 bp, Oryza sativa
tgcagaagttataatggctgtcatgaatctagtacttacaggatgcgtgtagcaagttttgttcattgtgaaatgacattggtgattatcttttaacgtatctaattcaaaattatcattttgaatgttcattaatttccttatcttctatatttaatcagggggaagacaagtaaacgctgtttggttggatcggtccatcttgatggaggttttttggagtgttgttgaactagctatctcatcatcttgtctgatatcgccaattctggtctactctttaagtatcgcctcaaagttagcaagagcctgctgattttcctttacactatgcaaaactattccaattgtggtcggatgacccatgggccatggctgcgtacctcaaatgatggttttgtgactggcaaataatatgttcatcatgcgaacttgttgcagcgtgcacattagtatatactttgttactgtcccccttttgatgattggtttgtttccaatcctgagcaagtccaatttctgaacaaaatcgagtgtaaacttttccatgcaaaaatgattttaacgttcactttgcacgtttccccgtgagtacatttcgtgtggatctgaaatttggccggtggtctcatcgagaacgggcgttaagattatactccctccatcctccggtccttaatacaagggattttgatattttgcctgtactgtttgacaactcatcttattcaaaaactttgtgcaaatataaaaaatgaaaagttgtgtttaaagaactttggataataaagtaaatcacaaataaaataaataataattctaaatttttttaataagacgaatgatcaaatagtgtaagcaaaatgttaaaatcctttatattaagggacggagggagtacaagatgactgcaaccctttttcttttacgaaagtttcattaagctatttaggcgaataaaaacgtcttttatgaaactttcattaaactattttagacgagtctatataaacgggtgtgaactttcaaaattaggcaaaggctgtgtttagatccaaagtttggatccaaacttcagtcatttttcatcacatcaatctatcatacacacacaacttttcagtcatattatctccaatttcaataaaaatttaaactttgcgctgaactaaacacaaccaaatttaaagacgcccaaaacgggatgctgacagtgaagcaactgtctctgcgaaccgacgcgtccatggcaacgcgaaacacctgaccgttgttcggccatggcaaatccaaaaatggattaaccgtcgccaaccccacctcgtccgtttattcttcttcttgtttcggcttccgcctccgtcccgcgcgcgcgtgcccccgcccgcgccgccatctctctccttcctcctgtattgttacgcaagccatccgagccaagcaggagaagaggaagaggaagaggaagaggaagagcatgcccccctgcgcggcatgggga

SEQ ID NO: 31918 - DNA, 1501 bp, Oryza sativa
tgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaactccaatgagtgcactaccacaaggtgtcaatgctcaatttcagccccagccaccagctgacaagacagaggccagtatctgcgttgtacctttagaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcgacaataaatcatagcaaccattctctgcaccgacagcctcagcaaagaattgtcgtagatggaagaagttgtgtctctccccgacctactccaggccgagccaagggcaatcaacctccggagggcgataccaagcagaagaccgtcatccgcttcaaccagcaatcagaaggaagcttctcctgtgaatgatagcattatgcagtcctgtcacatcatcacagaaccaatcaaggatgcagtcactagaacaatgccagctatatctctccagaatcaaaatgagcagccatgtttgtggtttttagttcgctacttatcatggtgtaatcgaaagtttgcagcaatcatgtaattcataaatataatcatgtctgtaaacagtgagcttgctatgtttagagatgattcatgttgaggatacaatgtaccgatgataagcaccttccctttttgtttaaggcagtgccttgtattcgtgtaataagggagaaatgtgtaatacagacaagttccctgaggattcgtttgaaagatgcggatatgtgatcatgtgtataattgtttactgacaaaggagacctagggtctcgtgtcagaggaactatattctaacctcgagttaataaccaacctgtggatagaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagttaaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcg

SEQ ID NO: 31919 - DNA, 1501 bp, Oryza sativa
ttggaagacccagcatagacctgcagcgactcttaattctccccattagtttgggacttggataagtagctgtcagatctgacctaattaatggatggaaaaaggtttggtcatctgacctcccaacagattgaataattggttcctaattgcagtcatatatcttgattcttgcatggagtagtttcattcatgttacttcttccaaaatagaaagagcacagaagaaaatgcaactgcattactggaaaaatcatgtactgtactagtctctcaggcatgtgaagtttggaaaatgaataactaatcatactataatcaacaaagtttaggccacgtttaaaacagatttttacgtgatattgaggcagattatttacatgataaacacaataaatcgaaattttaataaatgaattccacaataatatactccctccgtcccaaaataagtgcagttttaacattgtttatgctcaacgtttaatcgttcgtcttatttgaaaaacaattatgattagtatttttattgttattagatgataatacatgaatagtactttatgtgtgactaatatttttaattttttttataaaatttttaaataagacaagacggtcaaaacactagacatggatatctatggctgcatttattttgagacggaggtagtatgtaatcttttaaaaaattactctcgtttaaaaaaagtccaattcatagtacgtttagtaaataaaaaatcggagaaaaaagggtcagattgcatcagagatcacagtatcgtcgtcacagtgactaaatgcagcagcagtcacagatgactagactaaatcaaagattaacagtagcagcagagtaaagagaggctttttttccttggaatcttccccctcactcctcgcaaatcccacgcgccttttcttcccacgtgcatctgtcagtgacacattactactaccacaactgcctcccaaaaaaagagagaaaaaaaagatgaactaatattcggagaataacctgtaaagaaaagagagagagaaaaaaaaagaaatggaaaaggaggcaggcgaattgctcaacggaagtacggtgaaagaaagagaagagcggttgccatcgccagccacagcagccgcggctactataatggtgggagagacaaactagagagagaaagaaaccaccaccgccccaagaagagagagagaggacgcgacggttgccaggaggaggcagccaacggcgctcgaggcaagaaacgacgcggccatggtgggcttgccttgggagtcgtgacgcgctgtgtttgctgccgttgagagatgaaggtagtatccaagaagcatcatcagcaaggaggagggacgacgacgatggaggagggcgccatggacggcgctggcggaggagtggcggaggaagggtgctccggggaggagagggagggagtcgccgacgtcgctgttggcggcggcggcggcgagggggagcgggagg

SEQ ID NO: 31920 - DNA, 1501 bp, Oryza sativa
aatccctcgtcatcgtttccctcctcttaattcctgctgcagaaaaactaacctacggtatcccgtccgggggagtggggacgggatacataatgagctctcatcgtccttatccgtccgcatccttttccaccttactcaatccccaatctccctgtcgcttttctagttgcccatacgcctctcatccaccaccgctcttctccttcctctcctcttcttccggcaccgcccttctccttcctcccctcttcttccttacttggctggaagcctgaaaataggttgtgctcctttctcttgctcacctaccctcctgctctgtcccccctcaccatcaaagagtcaaggagggcgctgccaatatcagatctggagatacctagggcctttccatcattggatccgcttgagccatgtcagtgatgaggtgatggatcgcactagcccccgtggcctccacctcggtgtcatgccgttggggaggatgccgatcgatgcgaatcctcctcccacgctactgttagtggtgatggaggggaaacaaatgaaggtgctagatctgaagtttcgattgacaatcgacgtggtgctgcagacattggctgcttgttgacattgtgcgcaggtatgtcgtgtgtgcggcatatcaccatggcttagctggtacctacaagtaccaggcacggtacctgtggtaatgtggtatcatggttgatacctacacagggctggtacctgtggtatcatggttgatacctacaggtactagacctggtgccaatggtatcatggttgatacctacaggtttcagatctggtacctgtggtatcatggttgatacctacaggtttcagacctggtacctatggtatcatggttgatgtctcgggtaccagctgatacctataggtgctaaccgataacccataggtactaagtacgaggtatcaaggtatcgggagagaacgtacgttgttgcctcttggctgggtggtgagccatctaccaccagcgttttgtctcgtcttctcccttccattcctttcactatcaccatcctttttcttctcaatgtggtgttgatacaagggtcatcatgctattgcagggaccaactttgtcacctaatccactattagtgtcgtgtccttctcctagcgcctcacgcgtgctcttccaccggctgtggcgtgagcgtgtagggcggtgctaagtcgtggactcatgagtggataaagctgaggcggagctgacatcatcaatataaagtatcttgtttggacgggataccgtaccctagcagacctcttactgctgctgctgtgcctctactcccctcccctccgctctatccattccaaccgcgcacagtattattgggcctggcttggagcttattgggcctctagctatgattacaactggcccatagctttcctgtgcaattggtctgcatcttcgtatatgttgatgctggcatgctgccgatccttacca

SEQ ID NO: 31921 - DNA, 1501 bp, Oryza sativa
tgaggcagggcggaagaagaagcggctctagaagatagggcagacagagccgtgtcgggggagcttcgtcgagcctccgaagtggacgttcaaacgcccccttcgcaggtacggtcatcaatgcccggcccgatgctctccatccactttagcttcttgcttcttcctcttttttactttcttaacgcaactagggttctcctgtagcgagattccttcccaaggggcctcggcgttcgaacacccccaggggtcgaagcccgagcgaccgggacagccgggatctggctgatccggtgctgcggagcctttgcagccccccggcgtgcggcccgcgggccgcccgccgggtccagctccgagtccaccacggccgagaccgccccctcgagggaggagggggcgcaattcgccgtgggcgatagcggcaccgaagcacccatctggggcgatcccgagggtgcaacctacgaggagcgctgctcgggagcggagaccgaggcaggacgcggcccggaggtcgagacgggacgcgcaccgggggccgaggtggggcgtggcccggagaccgaggctgggcgcgggcctgagcctgaggccgaggctgaatcggctcgggggcccaaggcggagggcgacggcagcaaccgttctgctctgcacctggggcgccctccgggccggccacgcggaagggggactgtcgcgaccgggaaaattgccttttcccgaacgctagtgtattaatccccgtcccaggaaaagccggggtacaccatacaaacatgatataaaagacacatctttattatatcgataatatttacattattacaaaggcacttagggcctgacaatcaaaaataaacggcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgattctagagctacacagtgttattaaacaaggccgtgaaccctcacgaacctgccttaacccaaggcctacgatgatttggaccgaactggcaacccgacctgggttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttaga

SEQ ID NO: 31922 - DNA, 393 bp, Oryza sativa
ctaatggttaactagtggtcaactaacgaaatgagtatagaagggatcaaataataaaactcagggcaatccaagggatggtataaaatttaggggcatagaaatggttgagtgaaaacttatggacacacaaggaatttgcccataaactaaatattagagagttgacaagtgattttgaaatgttctctaagaaatgctgatgattttttttttgcatcaattagtgagagctagcactagatattgagatgaaaaagagggaggaaggtaaatatctgtcgccctttcatatctactccctatgttaaaaaagacttaaatcctaggaatgaatctagatagatatgtgtctaggcttatccctaggatttgagttttattttggacaga

SEQ ID NO: 31923 - DNA, 931 bp, Oryza sativa
ttgcacgtgcatgattactagtctattgataaaaaatcccacatctcatctttcgaattttggactgttagatatgctttaagattcgtgcaaagcccttaatcctaactcctctcctcccgttcccttcaagcattctgccaccgcaagcccgatcccctaccactaccgcgccaccgcctgactctccgactggccggaaaacgtcaaagaaaaacatgagattgacatctcacgactatataattacatagcaattattacagatataattcaagagatgcaaacattttcagagacgcatgacaatccatttctaaactgggttttcctcttggaaaggcaaaaaatttcggtgggcaccaattctgaaatttcgggaaatttttttagatatttcgaatgattttttttgaaattttaataaattttattgaatttgaataaattatgaccaaattcacaaatttgaaaaaaatccaaaaagtttgctcaaaatatttgcttgcaggagaggggcaaaattcttccgaaatttccatccttgttgctaatacacatatatgtacattttgaggggttatacacaatcggattcatacaactatttcagacagtaattatacaacaaaatgcaaatgcaaatgcaagggacgaaacattatgaacaaatcagagattaaagaggtgggggaggagaggaacaaataaacaagagatttgctccggtccagccaaaagtatctcgaggtactgtacccaaggtttgaaattttgaaactaagatttctgccgcaggtgggtgaaagaatcgaaattttggatttttttcgtgcgaatttttttgaaattttgactgatttttgaataaatttgaataaaatatgagcaaattcaaaaaaatgtaaaaaaccgaaaatttcgggcgaga

SEQ ID NO: 31924 - DNA, 1032 bp, Oryza sativa
ttcgtaatgctccgagttgattacctttattattgtttttagtcaattccataatttatcctgattaaattaaatttttagatagactcacatttttatccctacaacagatttacttataatgttgtactaacaacttacttctattttatgctaagttacttttatgatttatgtaaattactttcagattttattgaacttactttcacaaatgtatttacttgaaaatattctctacactgcttatgaatttactccacagtctctcactacaacttagtcataatatacttacttctaatgttatagagagttctattgcataactaacttacttttacaatttaaatgaattatttttaaattaataatatgtttgaatataaaaataaatttaataaagcctaaaagtaatttacatatattatggaagtaacttaaaacaaaaagaaagtaactttgtcacgacattaaaagtaaatctattatgaaggtaaaaacatgagtctatatagaaattaaatttaattagcacaaattatgttattaactaaaaatgattataaaataaacaactcacaacattatgaatgtatgagaagtaatttagtaaaatcaaaaagtaacttatacatatataataaaagtaatttacaacatagatatttcttttataaaaatatagtcacataagatcttgttctaaagatttaattgcaacgaacgtaatggtgtaattcaagagaaaattctataagaagaaaaaaatgcatgcaattttaggtgtactagtagcaactaggtatgagattgggatagctggttatgacaatccagcgcacggcctcgttgtagacacgtcctagaaataatgcggctccatcacgtttaacttttccacattatttttgtatatagtccaagataatgactacaaaatgttgccttgagacgtactccctttgtcccacaaaaattccaaccctagcttcccaaggtggatataagaggagagacaaaggaccaaaa

SEQ ID NO: 31925 - DNA, 1501 bp, Oryza sativa
ttgaacccaggtggttttgcatttactgaattggatatatattggtgcaattcagatagagagagagatgtggcaaatttctacttcatccgttttaaaatatactaccttcatactcgtaaaggaagtcgtttaggacagcgacacggtctccaaaacacaactttgacttcttatttctataaaaaatattcatcgaaaagtgatatatgtatacttttatgaaagtatttttcaagacaaatatattcatatattttttatatttttaaactcaacaacttgagagttattcataatttatattcctaaggtttgacttaaacattgtcctaaacgacttcctttacgagtacggagggagtaagaacttctagcacttaaattttgtccacaataatataaaaatttctagcactatagtactatttatcccttctcattcaattttctttttccgatcaaacccacagttaaccttcgacacacatcaattcctcatttattgaggagcagtaaaatcttttcttctcaacccccaaacctgcatatgttttgagacgaaggtagtagtaattcttagctagctacttgtgtgtacgaatatatatatttcttgctttgaggaaggaccctgtctcacttttgtaggtaagagaagagatggctttgttgattgtgagcaaagtagctgtggagtacagcctttgattgtaccaatcagtcacgtttcaacaatcgccagtatgggttgcactttctgtccaaaaaaaataaatcatgaggataaatctggagagagatatatatatatatatacactatagatggggtgcgttgtattaaaacacaacccacccccaccccgctcccccacatatttcttgtagtactgatagtaaaatgattaatgtatgaatatgcatttaccctatagtaatgttgttacttcccgcacatattagccattttctttacacctgctttgtacggttataccccgaatttttaggatctgggaacgggcggccaagggagcggcatcggcgtcctccagcggcaggcagcgggagaacggcgaaatcggccagcgacgggtggaaaggagtcgccgccgcagccgccggaggtcggagccgaggggaggtgggcggacaacaacgagcgacgcctcgagggtatctttcctcttcttgttcttcttggtcctcttcttttccggcgtggccccggccggaaccccaaacgggggcgcgtctcattctccgtccgcgcgtccgctgcggcggcgccggcggcagggtgtgatgccgcgggggatggggatggaggcggccgccgtgccggaggagctgcggcgcaaacgctctgacggcaagtagtggcgatgctttcccatctcctgcaaactcgtgttctcatttactcagatcctgtctggaaaggagggcggcgacgagcagctgtagcccctcacccagttgtcggctcgtcacagccc

SEQ ID NO: 31926 - DNA, 373 bp, Oryza sativa
attagccagcagttttctgcaattttgaattagttcaacagaatcactagttcagtcagccacgcgattagcagatatggtactagtttctgaaattttgtagttcatttgagcattgttgatcgggtaacaatttttctgaaattccctggttcagtagagcagcacaaatgaatttccttttatccttcactgaatcagttagccatatgattttgattttgagatatgaatatacaggtttgtgatctttttcgatgtactacatactaattacaaggacgtttccattcttaattttctttcatttcttaatactttatataatgttgaggctcttattgctattcttcttgtatctacgtatttgccc

SEQ ID NO: 31927 - DNA, 1501 bp, Oryza sativa
atgctagagaagtggatttgcacaattagtatactagtaattcgtaaattagcagtttagcatgcctacagtctctacacatttaaactgtaaatggcccagacaaaacttgcactgggataatttcctaacaatataatacgtcagacattgatgcttggagatacaaaagtgcgcaagcaattagttttcataaattactagaaattgttgaagcaaaggttggcaaacatttgacctaacttccaggatgcctggatttgcacattcctggttaaatgaccagttcagatttctttgaaaaataatcaattcaggttccatcagatcatccgtaaaactataattcaaatttaaaagaacaacgtaattggtcaaggcaaagttcacatttttaatcccaacataattagccaaaaggtaaacttcatgtcccagattacatatcaggaacaaatgaagtaaataacataaaggaggtacaggaattcatgaattatggataactcaccttgtagcgatggtagtgatcaacagcaacatctgcattgctgaaatcaatcacccgacctgaagaaagattacattgctcatattgcagtcatagtttgcacctcagattagagtacttctacaaataaatccccattactgaacctggtcttttcgtgagagtatcccatatggtaggtccacgttggccctcattcacggcaccttcatactggtaatatattgaccagaaatatccatcagacatccatctaaaagaactcaagtgaaattagagatcttttggtaacactagacctggtaagctgaagaagctgtgccaaagataaaaccgggagggaagtctgctctgcttatagcttcaacacaggcagaaaagctgacaaggatatgaacaagtgttaagagactcatggccttcccttcagtaggtagcactaactactaatgtccacagtctatagataagtagcagacaggattgtaagatatatataaaccttgttgagttggtggggtgtgggaagcaactgaaggctgatcatcacttgtcttggaatccaacgcgcgtctctgctaagtagctcttgtggaggtgacaggttgcaatatctctatcacactggacattttatcaaaaagggaaggaaactttgacatgtccaactctgaaagtgtcacgggtgtagcaaactaaagctttacttgagtgcaacaattccaggcgcattaaggatttcccaggattccagcatttaagaataaaaattgtgtaactgagccagtctttaggaagctacaccagtttgagaggagtgcaagcaacatggaagaaaggctgtgttaatatcacgataacacatttccttcctaaaataccatcctgcagtattgaccccccttttttttctcttatgcaatgatgctaagtgataatgacaataaggagcctaaaaaattatgattaggaaaatacagtggttaaccc

SEQ ID NO: 31928 - DNA, 1501 bp, Oryza sativa
cagactgacaaccggagacggaatatgcgtcaggccgtgcatccatcgtgaatagggaaaagggggcggaaaggagcacagtgaacagattgtcggctcccggaggaccatggccagccacagcgatcacatactccctccacaaaaattaaaaaaaaaacttgttttctgtatctaacgttttgaccgttcgtcttatttaaaaaaattattaaaaaaattaaaaagacaagtcacgtataaaatattaatcatgttttatcatctaacaataataaaaatataaattataaacaaaattcatataagacggacagtcaaaattggacacgaaaacccatagtttatcttttttaggatggagggagtagatcagtaacatgggacaacgccccagtttcgagtgaactaccaaagcaatgtagggctggattaatttgaggcctaaattagacttaccaaaattaatcatgtcaaaacttaccaaaatttaacattgacaaaatttagtaaggcttatttagaccacaaaacaaaccaaaccaaccagtcatatcccaaagcctttgattactgattaggtgctacgacgatgaaaacaacacgttcatacgcaactgcacatccctcgaagcctcaaactagcccttgagctactactaataagccacgaaaaaaaatagcaaagtaaaaataattatggatatcttttttctccgtgttttgggacaaacaaaatagggatagatggagaataggtttctcaagctcaatgcctaacggtgattattaatagagttattatctcatttctcattgataatagccgagcagtaaataggaaagttacaagcatattcttaaaaacggaaacccgaggataatcccaaacttcacattttgaggccattaaggttagttgttccttctattcacgatcagagtaaattaattagctcacggccagtagtatattcacttagtgtaagttagaagtatacaagagtgtatactccacccgatttactgtactctcaatccactcatatgtttttcttcccgattcatctgacactcattcccacaagttatatagtttttctatcatcggtttgtaacccccccagagtcactattttctcccagtccctgatagtccccccccaaaaatctctgtagtcagtcccggtgtcatcaaccgggactaaagagagggtagcggcagtccatcagctggtccttgtttcttttttattttctcccgaatcgagtggtatgcatatcatcaaatcaaaccccaaatccacatcacaactccacagcacgattcacagattcaccacaaattcattcacaatatccattcacatattcattcacaacatcacaaatatattcacaatattgattcaaaggttcattgacaacatcgagtcacatactcattcacaacatcacagattcattcacaatatcgattcatagattcattcacagatca

SEQ ID NO: 31929 - DNA, 173 bp, Oryza sativa
caaccacaatgtatttgaaaaatatattcatgtttgacataaaacatgcaaatgccacactgaacatatactgttaaagctcaatacatgctaaaaaatacaaatgattctcaaaagacatacctatttaacaaatcagtacctcatatacttcatttctcccatggcacagg

SEQ ID NO: 31930 - DNA, 1501 bp, Oryza sativa
ctaggataccgttcagtaagcggtgatgcaacgtgggtgctcagttggcacggcatgagctgatcagattggccattttggctccaggattcatagtcaaaagaaattacatgtcctgcttaaacatatagtaataaatgcaaaagaaaccttgaaaatctaccaaaactcaatgagctaaacagtgtgaaacaaattaattttagagtgaagtgcttgccggtctctagtccacttgtgtcctctaaattcccgaactttcaaaatacattttcaagtctccaatttatcaaagtttatcattttggtcctaaattgacacgagcctattggattctacgtggtgattatctggcatgccacatgaacactaaagtgacatgtcagatagatattctagtcttttttttcttcttcttctttttccttcccttcttcgtttcccttctgtcgttttttccccacatgaatgggaaggaagacaagaaaagaaaaagagaaagaaaatgagtcaataccggcatgccacgtgagcgtcacgtaggatcccagaggagttgtggcgatttaggcactttgataagtttggagacatgaaaatatgttttgagagttcaagtacttgaatgacacaagcaaacaactttagggaccgaaacaatacactttactcttaaatttaggctatgtgcgacaaatgggttataagatgtgtgattggaaaaggaaaatgaatgaatgtctaggattaaatgaggtgtgaataataaatagctaagatacaataatgtcctttgaataatgttccatttgtcaaatgaatccttaaggcatgcatgttgaccagatgatcaccgaagcattaaatttgacaaaaaaaatctctggaaaaaaaggcgtatcaaacaaggactattttaccatcattcgaaggtggtgtcaaattatagccagccaatacatgaacaagttagaaaactgtcaaaacccaattcatcaatagttgagatttggtggtggtatattttttttccttttttttgattatgaccttttagggttgtaatcttgtaattttttttctctatcaatggaactttgcacggttgttaaaaaaaaaacagttgggacttttcaagaaaaaaaaaacggccggagcactgtcaaacgaactcactaataggcctcgaaatctgattgggcttttcacgaacaaaggcccataaaatgtagcccatttaggcccaaactgtacatcacccgtgattaaacggcccagcccaaacatcataacactggatagggtgcagacaagggtcccacccgtcagatcccaacacgtcatcattgccgatccgcttccagaagcagcggcaagtttccatctccttcttccccttggctttttatcgctcgatcaggtggcagcgacaacgagagggagagcgagagctaagttcgccggagaagatggcgatgcggcggtggagagaggatgcgg

SEQ ID NO: 31931 - DNA, 1501 bp, Oryza sativa
aaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaagccaaatctattctgaacttttgaagatctgtgatgtccggaagaaaagattcaaacagataaacgggactctccagaatctataaaataaatgatcgacaaacgctttgctttggtaggcttctcattaacccaaacattctggaagaccaatgctggaggaaaacatagaaaaaaaactctctgttcccataaaagaaatagtactccggtttatctaaaaatatgaagaattctgtgttttcaatatcaatctaaattcagaatagctagaagctgtgtgatctggaagacaagcgaacccagagatagaacttcacactgattggactcatcaaaattcttgtgtttggtttaaatctctggtttattacaaacagaagtatcagctccagacttcatcacgcaattgccgtaactatgcatatatgatatatccaaatgacgagacggcatttatttgttcaggactgcagagtcccgtatcttcagtatagttctgataattacaaattgaagttttaactctggacaacgacatacttttcttttttgaggtaaaacaaaggaatactctgcggtttatctgaaaaaaaagagttatatgtcctcaatatcaccagaaattaagaattattactactacgagcttatattatctcttcgaggcaatcaaaacaaaagagacagcttcacactggttggactcgcaaaaattgttcagccagcgtaatccagaattcagataagtatcaggacgaagtattagcttcagactccatgtgccgtaacaatggcgttctcctctcctcctgtgtgtatgaaaacaactgcaaacttacaaattctgtcaacttatatctgaaaatttgaaaaatttcacccatgtagtttgagatcgtcaggattgcaggctgtatcatgatgttctctattgcatccttaacgttaaacgaaagcacagatgagaaaacatcatacactttgcacccgtaataagttcattagatatctcttaatcacgtacgaaaatcagtcgagagttcaatctcgttacatgaacgttcaaactaaaatctgcttttacgtacaagaaattaatccagagtccaatcttattacacgaacattcaaactccaaatctctacattc

SEQ ID NO: 31932 - DNA, 1501 bp, Oryza sativa
atggagaggaagatggagttcgactgcgacgagtggcccgacgattttgagctgagggcgaatggcggcgacatgaacgtcacctacgagaccgccgaccgccccggctacgactacctcacccccagggtctcctgcatatggtcgtaagtagatgctctccatctgtcataaaataaaataatgtagttagattattgacagaaataatgtagttagattatttaaattcgtagtagtataatgtgtaactagatttgtttatttattttaaaatggagatagtattagatatagacacggctactccaacttacattaattacttgatcgatcattacaataaaatcttttgagggacgatccgtggttcttcgaaagtaattgatgttggtagagtgctatattattttatatctcttcatggttttcgggatgtcacttagtttggccaaaagttttatttatgttatgaaagtagtatttttaacttaaaatccaaattatggtttctaactataactccaaatctatttcagattcaaatctctaccaaacaatcttatttaagatttcgtttggcacaactctagatcttaaattcacactgaatttagaccttataagttaaattaaattgatttaaattttatattccttctgaagtaaaaacaaaatgattcattcaaatattatcaatatactcatatattcaaatcggtgaatttacgaagctaaaaatattactatatttatctacaaagttaatcaaaccttatttctatatttattttctatatttatgaacaaacttagtcgaaccaagaatagttggatctaaaacgacggagggagtatcatgtgactcgcagatacgaggggaactacatgagcagcgtgataatctgggacgaggagaaatggccggagaagaaggcgtgcctggtggggggcggcaggagatgcgagctggtgttcgagaacaaggaggaggtgctggtggtgacgacgtcttcgccggcggcgccggggacggggtcgtcgaggagggtgctgggcgacctggccgtgaaggactgcagcacgcactggtacggccacctccttccctggggcgccggctgcacctaccccagccacgaccacgcctacgccggcgccgtccacagcacctggaccgccgccgccatggccagcacgatcggccactgatccatcgcggcaaaaaaaaaaaaatgttgcaagaagatgatcgatcaccaggaggaaatatatgcagagctggattggtttgaggcctaaattacgcttaccaatatttggcaattttaatagtgtttagtgtctatttgttttgaagccaaattttggcatgcctaagaaaataggccatttcatagtgagcttagactattttggcttcaatccaaacacaattttgccttaccaaaattagtcataccaaaacttgccaaattttggtattgacaaaatttgataa

SEQ ID NO: 31933 - DNA, 1501 bp, Oryza sativa
acagaatcctgcatgaggaccatccagattccagataactatagataacaaaacatttccatcaaatcataagaactgcgactttgccccctttcccctctctctctcgtcgttgatagcgttcagaaataaatcaaagattttctttttctcgtgaatgtacggaaagcatgctctctaagcggttacgattaacgaagtgctatcactgtcggaacgaaactgcggttccactcacgggcgcacgaatttgcaagaaaaatgcgctgttcttattcgtaagctcggatccccggggacggggaggggggcacgccaacggcattgcaagaactcaccgtagccgaggaggatggcgttgagcgaggcgaagatggcgcaggcgagcacgaaccgctccttgctcctccgctcccacgccgagggcctcctccgcccctccggctcgtcgctgggatcaagaaccgcgtacttgttcctgccattggcggcctccgcgcccgccatcgccgcctccctccgggctcccggcgatccacgggcgacggcgacgctgctccttgccgcgggcgattcgccgtactagattcggagctggtcatcaatggcggacgcccccaatccaatgggggcgcgagaaaggtgggagatgtcgatgtgcttcgccctcgaaggttgcctgttccctttcctacaggaggagagaggatttccatttctctaatgttttgtgtattctgatcccaagtactataaatatttgcaagatgatcccttcaccatttttctcttgtacataatcctaatattactataaactaactcctaaaactagggagcgttcggcaggaggagttttgtgagttagttagtttcgttttccacgcgcacgcttcccgaactactaaacggtgtgttttttgtaaaaattttctatatgaaagttgcttaaaaaaatcatattaatctattttttaagtttaaaatagtttatactcaattaataatgtactaatggctcacctcattttgcgtatcttaattttctcttccccccccctctcaaactcaccctaatatttataagtgtgtcacatcatcactcactagtaattattatgtagagtattttaaataatatgcaaacaacgtcaaattattattttcacatcattttcatatatacatgtactagttatgtaatacataagatgcattcatctacatatcatgtagcaaagcgcggggtatcaactactccctccatctcaaaatataataacttctagtccttaagatttgtgccaaaatataactacttcttcaccaacattctcttctaaaccaatcacaaccctccaccattcaattttatcatatacctccacttttcaatcaataacaattttcccctatttaattctacctattttatttaaccctaaaaatctttatattatgtaacgagagagtagtatagaaggagaaccagggtttacaa

SEQ ID NO: 31934 - DNA, 1501 bp, Oryza sativa
gcccggaggacgcgtgggtgcccgaccacgagtctggcggatgaggccgccgtctccggcaccaaaaaccatgaccactgcggagcggcggcggccggcggctcgccgtcggtgcttgaccaggctgtgttcgtccgcgaggaggacatggaggacgtcgagaggccggccgtcgacatggccgctgccaatcacaagcccaaatgagcatcaacttcttgcagcaataaccaataaagccaaataatgccttctgaaatctcatgtacagctagaagtagaaaatttccagtggaaatcttgcatccttggttctatgaatcttgttatctacagtgatcaatcgatcaatcggataacctgttctttgatgaatcttgttgtgtttttatcggatggaatttgctgggattgctttgaattcgtgcacgacgccgtcgatctcgatgaggctgcagtcggggaccttgtcgatctcgttcctcctcatctgcctcctcaccttcaccacctcgccgtggcggccattcgacgcgtatgtgttcgacatcagcacgtagtcgccggcgtccgcgtcggcgtcggtggtgcgccgccacatcacccgctcggcgcgctcgacgtcgtcatgtgcgcggcatgcggcgagcagcgagccccagatgagcgcgtcggggtgtgctggcattgccgcgacgagctcctctgcctcgtctagtctcccggcgcggtcgagcatgtcgacgacgcagccgtagtgctcgatgcgaggttccggcatggcgtcgagttgctggagcccctcctcgacaagtccggcatgacagcacgccgtgaggacgccgaggagggtcacctcgttcggcgtcacgccggctcgttgcatgccggcaaatagagacagggcgtcctcaccgtggccgtgcattgcgagacccaagatcatggatgtgtaggtgtaccggcgagacccagcgaccggcggccatagcaagcctcatatcggccagcgttcaacagcctcctcgcgcacggccacctcctgctcgcgctccgcgccgccgtcgccgccgccctcgcgctccctccccgaccgcgtccgcctccacgccgtcggccgctcctggtgcgcggtcgccgctacttgctctcttgccgtggacaacctcgccggcggctgctccctgctaattttttgtgtgtgatttcaggtggaggaagatggagctaggggcaatcttgctatttcgaaaatttctcacctcttttgacctggatattataaaatattgttttcggtatgctatagccaattacacattttttgtagtgtccatcagccgtgtctcgtttttgcggaccaattatacgttttttgagtgtcctgtagcaaattttgtctattttaattttgcgtttgctgtgtagacgtcattgtttcggaagattggttgttcttcgctgctgatccagaagactttataagcaatcaagtcatatc

SEQ ID NO: 31935 - DNA, 719 bp, Oryza sativa
aggataatatttacatcaatccacaaactctcatacgttcatcttaaattgcgcttgtttacttggggtttgtccggtgatgctttcacatgtctcacttctttaccatcaaattctatccatacatggtccctactattatacacaccataggttgatttttctactgcagagaatggcttaggattatgtgatttaacatcggcttaaccaaaagtataatgagcctgtcattgattatattaagagatttacggatgttagaaaccgatgttatagcttgaatataactgatagagatttggctggtcttgcttttaatggtttaattgctcctcttagagaaagactagatggccaactgtcacaccctgaaaattcaaaatatataaattgttgtttaaatggaatttttagaatttattttttaaaagtcttgaagagaagatctaattttaattaataaattccaatataaaatgggcccagataaaatttcattaaatactttgcttaattctataattcctagatttttctgggatttatttgagctaaggaagtatttttaataaatggaattacatttaagaaataatttaaattgaaaaaggttttaaaaagtcttcttttgggcccaaaacccttctctctctcctcggcccagtccggggagaaacaatcggttgataaaagtgaatcatctccaaaagaagaca

SEQ ID NO: 31936 - DNA, 1501 bp, Oryza sativa
tacctgaatcagctaggctaacaattatcgttcctcccatgcagagaagtacactgattagtttcaaccacgtgaatgtttctccaagaaatactagtgcaaccaagaaagtgaagaggctagacgtgctgctcaatatcgtatttgactgcaggtacaaagaaacaaggacatgttaccaatggacaggagcgaggttaaataatggcatggaaatgcaggccttagtaacacttactgtaacagtggtgtatcttagagacaggttgaatgtaagctgagcgagaaaccagaaagggcagactaccatgctgactctagccacacgagcacgtgtccagcgcccttttgcatccaaccctttgctgccatctgctacattcagctcggcctggacagggaagactgcttctgaagccaatatgtcttcaggcaaccttgttggtgaggctgtattgccctcttgttcacttccatggagaagatttatgctctccagatcagcagactgctccaggtccgcaacatccttgcctttcaactttgtccaaaagttgttgatagaatcctcaaagtatcgtgcagcctcaactattgggatgtaaataacaaatagagaattgcatatgtaggtaatcaagaatggagaaacaccctcatccacaacagactgaacaatgtagcttgcagcaatccatatactcgcaacagcaacaatgtaaatcaatcctaaacaccacctccacgaatctgtgctcatcattttggcccacctactgccattgacgccaggaccatcatcaaccttcatgcttcctatcaatacgaaaatcttaccatttagcattatacaataaataacagtttcacatggaaactatggctttagttatctagtcctagaaggaaattagattgcagaaggaacaggttgtcatggcatcatgcacatcatttgtgtccgaatgatcacacaaacaaccttaattcagactgtattgctgagttttaacatagctcctaatcagtactcatgcaatctttttttcaattcacaaatgtgtttgcccatcagttgggtcatcaatttccaatgaattgaacatctagaaacaggtgcagacctaaagggtgctcaactctaaaattttctccagcaaagtccggatggatctccaatctacaggtgcagatcccctagagttggttccaaatccacctacgcaaatctggaccattacttcttttttaggcgttagatgtagccatttgcccatgtcaccctcttcttccctaatcccacacataatgagctatacattcataactgacaagacaatgaataatttaagttatggcataatgcttgtgccgtattttataattttcgctgttgatctgctaataatatactcccaccctttccttatatttgccgtcgggagtactagtattcaatcaattgcggtaaatactggtgccccaagtttctgaaaagtaa

SEQ ID NO: 31937 - DNA, 1501 bp, Oryza sativa
tgtctttgcttaaacttgtaggaaagtgacacctacaaattgtactatactactgttagttctgttgctgatttacacatttacaacagattttttaggtcaggttacaccaaattaaagaatttagaccacttccgagccatccatcttccacgataaaagaatcttaaacacaacccagatagttttttctacgctctaaatcactccattctccagtaacacatcactctcatggtcgatagaatagtcatatacggtaggagcgtccggacacgtagctcgtccaagtccagctcccgaatttttcctgtcaaaaccgagtggttgaccctgacaaaaccaacagaaatgttgatcaaaccatgaggaaatccacaaatttatttggagccctcgagcaacccacaagaaacgaagttggattcaccagaccgttccgagaaaaaaaacagggagttaacgttttgtcagtttcaattcgggaagtccaatttttggcaaaaaaaaaacaaaacaaaacggtttttattggttttgtaaaccctggttctccttctatactactctctcgttacataatataaagatttttagggttaaataaaataggtagaattaaataggggaaaattgttattgattgaaaagtggaggtatatgataaaattgaatggtggagggttgtgattggtttagaagagaatgttggtgaagaagtagttatattttggcacaaatcttaaggactagaagttattatattttgagatggagggagtagttgataccccgcgctttgctacatgatatgtagatgaatgcatcttatgtattacataactagtacatgtatatatgaaaatgatgtgaaaataataatttgacgttgtttgcatattatttaaaatactctacataataattactagtgagtgatgatgtgacacacttataaatattagggtgagtttgagagggggggggaagagaaaattaagatacgcaaaatgaggtgagccattagtacattattaattgagtataaactattttaaacttaaaaaatagattaatatgatttttttaagcaactttcatatagaaaatttttacaaaaaacacaccgtttagtagttcgggaagcgtgcgcgtggaaaacgaaactaactaactcacaaaactcctcctgccgaacgctccctagttttaggagttagtttatagtaatattaggattatgtacaagagaaaaatggtgaagggatcatcttgcaaatatttatagtacttgggatcagaatacacaaaacattagagaaatggaaatcctctctcctcctgtaggaaagggaacaggcaaccttcgagggcgaagcacatcgacatctcccacctttctcgcgcccccattggattgggggcgtccgccattgatgaccagctccgaatctagtacggcgaatcgcccgcggcaaggagcagcgtcgccgtcgcccgt

SEQ ID NO: 31938 - DNA, 402 bp, Oryza sativa
  unsure (1)..(402): unsure at all n locations
cgtgattagataggcangtanantgcannnncncannnnanagganncccctannggnggcctgataccagccatcttcagcttatcagggtcaattggtcttgtaaatagcattactggctcctcaggatcccgcatttcaggaacctgttaaatcatgatccaaatataaacatgacaaataaaaaattagatgagttgccatgtgaacctaaattttagtttcactatccaacaactatctagagcaacagaaattgtgcctagcaagcccatcaatttctggctgttctttcagacaaatttgggaattaggggtgaaagaagtcaaaatagataggaaaatgctcaaaaggttttctgaaccatatttttatgagaattgaaaatggtaacaaatga

SEQ ID NO: 31939 - DNA, 459 bp, Oryza sativa
  unsure (1)..(459): unsure at all n locations
cgagagcatttgagtntacgtttgactatagggcgaattcgagctcggtacccatgtcggtgggttgcgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagat

SEQ ID NO: 31940 - DNA, 602 bp, Oryza sativa
tatatgctgacatactggaccttgacatttttttgttaaaggtttgttattgccagcagtgctgctcatcaggaattaggagtcccggatatttctagttctgtctgacaattaacgtaatgaacaaaatgaagccctctcgctagctctaagatattgagatacatgcatgtgtagcagcataaacatgacttagaaatttaattagtaatagttttagcaagtgattgacattagctcatgggagctggcgagatggaatgcactaagcagtactccctccgtattttaatgtattttaatgtatgacgtcgctgattttttgaccaacgtttaaccatttgttttattcaaattttttatgcaaatatgaaaatatttatgtcatgcttaaagaatatttgataacgattcaagtcacagtaaaataaatgataattatataaattttttgaataaaacgaatggtcaaacgttggataaaaagttaacggcgtcatacattaaaatacgaagatagtagtaagtgagaaaaaaaaagcaatgagattatgtgccactgatgggatttccctgaactacgtaccacaaagatgcagcca

SEQ ID NO: 31941 - DNA, 1501 bp, Oryza sativa; identical to SEQ ID NO: 28478

SEQ ID NO: 31942 - DNA, 1501 bp, Oryza sativa
taaagaatttagagtctagccaagtgtaatacatgtcccggtgctcaataaccgcgagcacggctattcgaatagatctggtttactcacactgcagtggatgtacactttacccgcactccgcgactgcccaacacatgagcctcgtcccaacacatgagacgcgtcacggcaaagcttttcgataaccttgcattggcagtacccgctccatgaacttaaatcctcatgcactctaggcatccatgtttctagcagtgagaggagttctggcgctcccggggaaagagaagtctcacacgcatattaaattatggttcaagttaagttctctctctcacacactcatggcagtcctaccaatggcaacaccgatgtagggcacgcctctcggccctacctcaacggctgtcccatcgtagcgcacctgcctcactcaggggtgaaccatctatgcagggatctgcctccgctcggctatctaatctgctaggtctatacccattcgagaagtacggttgtacgggagtcgtttcatgcttaacttcatggctcggtccttaattgactggggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaatttttacttgtaaacaaaacaatttcgcaattaggatcaacatgttcgaggaatagtgatgacttgccttgctcaggatagtccttattcttgatataattcttgatcaaccttcacctcctggaagttgctgacattgcctcacgactaaccgatacacaaagtctataatacgcgagaaaaaccaatattcaagcaacaatcaaatatgcacaaacaaaatatatttgttgaggttgaacctaaggttgctcatattattcgcgcttgctaatggtttccaacatgctaagggctaaagtttcttaatctttctgttatcatggtggtctatttaggagctagccaatgtagtatgaatgagatacgtatctggctactatgtggtttagtctagcaaatggctattcatgcatctatctagatagaacggttatacactagaggttttgttgccggatggatttggatcggtcaaataattactgtgaatcatttgtattattattttattgatggaggctttattttaattatgtacatattttacttgtcaaaataaattataaaggttaacaattaccct

SEQ ID NO: 31943 - DNA, 1501 bp, Oryza sativa
atgaaagttttaaaattgagtttcttcaaaattgatgtacagtatatgtgaaacatgcatataattttggggaaaaaaaaaggaaaacatacttatactagtgacgagtggaccttgtgggccagaccaggtggtagcggaggaaaagatccaatttcactccctagaaaccgggtatattgccccccccccccaaacgattaaagtagttcaaaacgactccctcgactgtattgcaggtaatttttgctgccgtggtgtccacatggtagctcagtcattaggaagatgaaaaatagacttgggactcacatataagtggcaaaaaaattgtgagttccacatgtcagcctcgactcttattttcccctctctcctcttttctttcatacaagagcacaacaccctaacagtgggcggtgcaaagcccgctcctcgtcctccccctaggaggtgagtggtggcgatggcggaagaagccgacgagacaaccgtcgccgcacgaggcatgcatgccaggagtcgtcgttgctccaaggacttgaccttggagaatggagacgcagagggcgcgcaggggtgtgatgatggtggcgtcaagtcatcggcgatggcgagcgaggagcgcgaggctgacaacattggtgaagggcgccaatgattggggtccgacattaggctccaccttagggttgtaggctcgttgcagcttcgattaagctatcgggcggtgaaggattggcggcgatgatggctccttcaaatccgcttcctcgtggttgatgaagtatggagctcatggccgatgcgcgtgggtcgaagaggagccggtcggacaggcaccttccctgtcaaagaggaggacagtgcttgctgccagccaccgccacttcccctcgttgtctcgccacctccgccgctatggagaggagggatgagactctctttcctccggggagggctgattggctagcggggagaagggggaggaggagagaggaaggatgaagaagatagggagagcaagggagaagaaagagaagggtcactaatacgtggaccctacatattgacgcaactagtttgattaggtcaacgtgccatatcaacgaaatcacttactatcaagagagtcaaattatattggttttaatagttaggcggtcaagatatccggcattgcagttcaggatatgaatcatattggagtggacctatattactgggagtcaaagtggacttactccaatagcattctgttcatttatcagcccaacaaactaacaaagaagggcttcctgaaatttgacacaaaactgaatttcaggcccatgaaagcccatgtagacctttcccgttaacttttgggccccacaaactgaaatgggcccacccacctctcgtctgctacgtggcccccactaattgcagtgaaaaaccccaaaaccgggtggatttcctccttcccttgcacgcctccacgcacccgtggccggagaag

SEQ ID NO: 31944 - DNA, 1501 bp, Oryza sativa; identical to SEQ ID NO: 31128

SEQ ID NO: 31945 - DNA, 1501 bp, Oryza sativa; identical to SEQ ID NO: 31132

SEQ ID NO: 31946 - DNA, 1501 bp, Oryza sativa
tttattttattctaaaattttgtgattgactaatttaggtatgacgttgtacagaaatcaaattgagtaactttattatatttttattccaaattttatcaacccatattgtgttgtatatggagtttttttattttctaaatttcagatattcaaattgtatttacaaatccaatcttctattttatcatttgtttttaatttgaatttaaaatttttaaaaactgtatttctacatggactcttcctcctttcctttactattttttaaatatgtatttcttgttttcttaaattgtatttccacttggggtctccttttaatttcagaaatttttaagtgtatttcactttggactctgtcgacgggggatacccgtagaccggatatagagggtattggagtacgttggaacgaggatctacgtaatacgacatcaagcaaacaaaagataaggattatactggttcaggccccttggtaggtaatagcccttatccagttggtatgggattatatgatggaaaccatagattacaaagggaatagtggaactcgatgataccgacgaaaccgtagtcgagttggttcgactagatcacccggcgacttggctcctataagctccgactctgtaggctgtggtggatatgttggcggtaagattcgatgtcttcgatactgcccaaggggtcccttttataccgcgggtcagttgatctccaagtaggactcggagatatcggacccctcacgatatggtaacgacccagtattgtccgagtaggactccttccatttgtggattctgtttctatcatgtaatagatttccttaacgtatacaggaactacccgtgtacgcgcgggtataccgtatcagtatacaacgtatatccaagtataaagggtataccttatccgtaacactgacagactcccctcttttttttgtcaaaattgtatttgtacatgaactcttctttttttacctttattttattttctaattttgaactttgtatttctagtttgactctttcttttcctttctaaattcgaatttcatatactttaaattatttttcgatttggcttttttctttttgggtgaataactaatatggtgcatgcagtttcgtttcggactcagtttagtttttgaggtttcaaatcgtccaaacaaatccttcaaattaatcaattgggttaatatagtacttggaccctcaaaaagtgtcacgtgagcatgtcaagtcatcctcgcatgcagcgatatgaatgaaatgaccattctacccttatataccatatagaaaagaaagaaaaaaaaagaaaacaagtatttcacacatgtatgatcgttttagagttgtcacttatgattgctgcagccaagcactgatcgtataaattcctttctcggccaccctccgcaacaatgttgggcttgggctagcctgttattattttgtttgtgtcttttatttcttttctatat

SEQ ID NO: 31947 - DNA, 828 bp, Oryza sativa
cactcgaaagatttttttcttatctctcactcgattttctcactcaaatttacagtgcattttcttgtaagttacagtgtaatttataaaacttacactgtaacttttgtaagttacactgtaatttttgaatttttgcatgtaaattttaaattttgtattggatttggtctttttcttgaggatatggtaatttagtgtccattatggtgtttcttaattgctttttgctttttattatatctatcggattttaatctaaagattaaaaatctgtgtgatacgattataaaaatctttcgaaagatgtataggtactcccaaattttgataggattttttttatagttgccaaattttggcagcaaaccacttatttggcaattttactaaaatttggtaaggttaaaaataacatcaaagtgaacaggcctttgtaaccattttcatccctgcatctggctaccaattatgaggtagagatggagacagcaagcctgcagttttggttccatggcgttgttgtttactagctctggtagttgcgagcaaccatccgatcaacaggaggtgcggctgcctggtctcatctcatcagtttgtttcttctccatggacaaattctatcaatccaagtagcgttttggttacaggtttctcctcattaagttgttattacagcgacgcagctgcactattcctgctgattaacacaggtagaagtagacaggttgggctaaatccgcaccaaccaattactattatcgtgggtagataaaattaacaacagataatctctcgcaacaaccacgaactgacatgacaaaa

SEQ ID NO: 31948 - DNA, 1348 bp, Oryza sativa
ctggatagcaaccttgacttgataattgaagatgcagctcaaaatcaagcatcaattgatgaaagcaacacggtggaaaacacaagtgaggatcaagcagaaaaagaaacaacaaatgagcaagaagatattcaagaccctgacatagctaacacaaaggggaaaaaatcagcaagaacaaaagggatggtagagaagataaaagaacagccaaaaaaacattgtacaagatgtggaagaacaagtcacacaatagaaaattgcccgctgatgcaaattgcaagaagtacaaagaaaatacagaagtctacaacaacaagtaaaagaaatgaataatatgtaaaatattacaaacatgggcaagcaaaaaaatcaagctaatggatataaatttttgtattgcagggacaatagagaagcaagcaatgcccgctaggaagaagaaacatgaagaaaatgacaaaggaagcaagctacctaaagatcaaggaagcacaaaaaagaacaaatcaaattagaagacagaaaacaaggatgtcaaattttgagactgaaagtattagaccttaatgtttttcactgtattactgcactacacacactatatatgtgtattcatactaaaagtatttgatgtaagtgaacatctgtattcactacaggaatatgtaatggcactgcaaaaatgcattcactatgatcctatacattccactatgctagcacacactacagttttatatagcgactaatcttctggacaaattcagccttcaccagcaaattgatcctacaataacaaacaaaaataatattttcaaaactatgaaagaatccaaaaaacaagaatggcaaaaaataaaagacacttacaagattaaaccaattttcatagcaactatctttctgaaaaatttcagccttcaccaacaaattgagcatacaaataaaaaatgaaaaacatttttttcataactaaaaatgtatcaaaaaacaagaataggaaaaaaaaataaaaacacacttacaggattaaaccaattgagcacaacttcttcaacttcagtctgcagcattttattcgttggatggaagaataactgatttgcatacaacatccgaatattgtcaatatcatctgaagaaaattcatttggtagaacaacccttggtgaccacaattccatacacttcataacaaaaattccagaatcaaagctacaaaaaaaaattgaaacaactctttaaattacaaaaaacaaagaaataaaacctaggtagtactgttcatgatattgttgaatttagttgtaccacaatggcattttttcttgtttcttgtattatt

SEQ ID NO: 31949 - DNA, 1501 bp, Oryza sativa
cccggtatcgccgtgtcgcgtattcgtatcagcgtatcggggtaacgtagcctttcataaccgcgattgttccaaagaaaacagcagagtttacatcagtagatatacagctcgtaaaatagcaagctaacctcaccgtgatgatgcagtgcatgtagcaagtgaccgcaaggtgatcaggagaggaagccaacaggcgtgcttaattagcctctgagagaaaaggagagagatatatcgctagccctgatcgagaaattcacgccgatggatcgtccagacaaatcacgtggtgaggtgcctaattaagcagctaacagtacgacaaaagaagctctgattatgttagcctgttaataatttatgcgacaaagcttatcacttcccttaactaattcggggagataagatattatacagttctaacagttcgatatgatttaattaatccattccccttctggcatgccgctagaacatgccaatcgcgaagccctacaagccgggttgtcatatgtcattaagaaaactaatctccctaggcccttcgtcacctactgaatatgttattaacacggtccaacaggattcaggaacatcagaattttcctctcttttttcttaaacatgaaactaacaaagcaattattggcagcgtgatcggattggcggaaaactcataaactcgagtataaaaacgagccactaagctagtcctctcgagagattggagtacaaggaaagcaatgggaggggtcaatctagcaaagcccacattgacaagtatttctttccagatcagtaccgtccacgcagccgtgacagcaacagaaagacgccatgtcgcgatcctgacatcgtccttgagattcgtgctcccgtgacgtgtcggcatcggagggcccctcgtcggggtcaatgggcggtggggccagaccaccgaccgggatctttttcctggcgcgcagaaccgtttgtttccgccctctcttttttcacaggagcaccggtctctggcttttctctcgacctttttataagcgcgggggttatcggtcgcacgcgtcgcggaatcagaaccaaaccccaccaccacacaaacgcatgcgcgcgcgctcccccgcgcgcgccgcaccggtcgcccactcgcccgcggacgccaagcgatcgtctcgtctcgcactgtttcaccggtcgcccaatcgccaccgcgcccgtacgtctatacagcgtggcaagaggtgcaagttggtgtcaggatcagtttaattacaaggttgtctgatctatatattgctgcagcacggcgggcgcggggtacgtttggctgcaccctgtctcgcggctgatacgtttgcacaggcgttcagatacagccgatacaccggcggcgctagctgcgtttcttctccgcatggacgctccgagcggcgagagcggcggcggcggcggcggcggtggtggcaggaggtggaaggggaagggggtgacgcccatacag

SEQ ID NO: 31950 - DNA, 1501 bp, Oryza sativa
gcctgtcgacgtttgatgtcgcgattttggtatttgcatagtatggggatcgttagtactaggatatatgcgagattgtagtaaaagagatggagacgaggatttttatacaggtttgggcccctgaattgtcaggtaataaccctacatcatgttggccgaagccggtattactcttattcaccataatcacaccagtacaatatttggggtagcttatctaactgttgtcgacatggcggtctgaaggtctgactcgtagtcgacaacagggtagtcttcctcctcgaatccgtgcccggcgagatcagagatagcgctttcgtctctcctgacagtatccggagacaccgtaggggactagtcgtgcttatccctgaagtcgatatccggcgtcttgtcttggcgtatgttgacttgtattggctttgtggctttgtggcgtctatgttgtccgtgtcccctctcctcccagggggccttgtatttatacccataggtgtcctcttatccaagtagaactagggaaaccaatatggatacaatccgagtagtccttgtcgtttccatatagaactctagtcatcattccttatacggaactcctcctatatccgaaggttgtttccgtataacacatggtatgtggtggatcatgttgagatttagtcaactactattaggtatgtggtatctataaccctgacaaggcccaaatttaaatacaacatataaacacccaaagttgtgattgaaataccaaaagataataaagattattggaagacgaatctagactctatataggaatataatttagaaataactaaaatttgatattaaaaataactaataactatcatgtatgtacaatacaatttgaatattccacattactagtttggtaaagtgagtacaaaatttaaaattattgtcattttaatatattttaataataaaataagaaatatatatatatatatatatatatatatatatatatatatatatatatatgctattatataagagaaatataagaatgctagccaccatgctagtgttaaagaaaaggggatcagattattgcaaatttgaatacaatttgctagaaaaaaaatcttaatctcaaggatgcatgaaattcggcttctttaaactggttggctcggaggaccaaatgacccttgggatggtcgcaggtcagtgtagacatccacctcgccaatcgccatccacccccaaccttcagctggctcggcaatcggcatctcttatcctcacgtgcgcaccacctgctcgatgaaattccccacacggccaccaaccgtgccgatggcacccgccaccgccaccgccgtggcgtccccctccacctcctcccggctcctacaccgcagcctcctctcgccaacacccacggccgctcgctgcctccggccgccgctgtgccgcgggcgcctccgcaccgttcgccaggttgtcgccaacggcgacgtct

SEQ ID NO: 31951 - DNA, 686 bp, Oryza sativa
taactaaccaaccacgtatgtatatgtgaatctctatgcatccacatacttaatggggctattgggtgcaaatgtatgggcggatccagaaagaactaataggaggggctgaacaaactatacaaaactatagccccctcctctaatggatgtatgacaaaaaaaaattagtgggagcttaatgggggctcccatggttgcaacgtcggtagttggggctagagaccctgacacccccatggcagatccgccaaatctgttctgtacaccattaatgggattgctaaaattatcacaccacatttttctctcctatacgtatgtatggttctatctctcagatctcttttaatcagataataaatcacttctaatcctgattctctttagtgtattacaaaaattacaatataaatttgaatcttacaatgtaattacagtgtaagttttgaaatttatggtgtaattacaatgtaagtgtagataatttgcaatgcaaaaacgatgctattttttggtgaaaaatatggtgccaccaatatagctactccccatcattaattaaacataagtgagttaaatatgtcgactttatttctctatgcatacactgcattttgagtaaccttactctttgtataatgtgtccattttgagacatatataataagagcatctgatttgca

SEQ ID NO: 31952 - DNA, 1501 bp, Oryza sativa
tcaccatcaagtgatgaagtcaccaacgaatctggtataatcagatattgcagtacttatagatatgatgtttcgcgtaacaaacaattcataagaaagtacttgcattaggaaaggaatacttttaactatccagaaacgcatgcatttcaaaatgatctacagattgttgcattggacagcagcaaaaaattgcagtgtcaacggtaattcatagtacaaataactaaacagcatttggcaattattacattaaacgatacaaggaggctaaccattctgtaatagaggaaaatgataataggaaggcaagagaatatgacagagaagttggcaaatcatatacttaaatgagtgtattgtttgttcataactgcaaacaaatggacagacaaaatgattctataaggcagaccatcctgagcaataaatttctggaaccatgctgtacctttatagaaggctgttaagagttcataagttccaaaacgtgctcccaacccaggcagcttgcccaatactgaccatccaatgccactgtaaaggcctaaaagcacacacaataaattcaaaggaaaataatttcattccaatgtaacatatatataggtgatgagaaatcatcacacaggaattagaaaaaagggcaggattcacatggtttctccctgtatttctcgaccaggaaattttataaggaacagacacctaagaatatggccaaaaactaaagaggtggcctggaattctattacaacaccagctgccaagtatgaccaatatgatcaatttgcagcaagttctttttacaaatttgatagtttataatgtgggcactacataaaaattaccatccattttagaattttcagtctcccaatgctaccatgatttttggatggcaggctgagcaagtagtcactcaccactaaccgcaaaactcaaacatcacctatcctcataaacccccagtagcttgtaggtgttggaaagctatgcatatcgacatgccctaacgcaattcacgatatgggattaccaccactaaaaacagtggaagatctctaattatctagcaactgggcaagaaacccaaacctgcagggccggaggcggacatgagccggtccaccacttggccgagccccatcttctgctgcgaccccgtagcgctcaactgcacagccagcacaggagggaaagtaaaacacccgcgaatgagtaccaaatcaaagcccccgagaaggggccagcaacagcatcagcgagagaatctgagggaggaggggggcgctcgcctggaggagggtcttgacggtgtcgagcgggtggacggcgaccgcggaggcggtgatcgccgcgacgccggcggccgcgtggccggcgaacacgctgtcgcccagcggctttcccatcgtcgccggcggcctggagctcccccgaacccaagccgcggtttaggctttaggttctccgaggtcgcgagccattcaccaaacgg

SEQ ID NO: 31953 - DNA, 344 bp, Oryza sativa
tgggctatttcatatgtatagctaaaatagtctattttccgtcccttctctttgggctgacatatgtatagctaaaataagtctattttctgtccctcctctttggctgacatatgtatagataaaaaaagtctattttagatccctattctttcgttcatggcatataatgtctatttttactcccctatttttttttgtgtatcgggcctagctgccggcccatcgtgccgggccggcccggccgtgccgtgccgggccaacgtgccggtggaggggcccaggcacggcccagtggtcgggctgggccggcacgggcccgacctccgtcgggccgtgccgtg

SEQ ID NO: 31954 - DNA, 1501 bp, Oryza sativa
acacagaataatactacctctttcgatgcgaaaagtatgccaatttggccgtacattacgccaagttgtgctcttgctctgatgttgatcggtcccctacgaaccaagggataagagttttgcttccttttgtccctccactgtgtttgcgttcggtgtggtgctgcgcgccagcctgcagaagaagaagaagaagaagaagaagagaagatagtggtggtgggttcaatcagagcggttcttggtgtctgaagaaacgcacaaagccgaagtggaaggaagaataaaggcaagagcttttctccatcgcctcacccttttttttttgttcttgttcgatggaattctctctctccaattgcgaaattaccgtactcgcttacaagttgtagttttatttttactcaatttgataagtttcattcttttataccttatcttggttttacccttttggatggttccggcgagtaactgatattttttcgattgctgggtgttctattgcaccgtggttcttgcagggtgaggtgagctaagtcgtaggctgtctgccgcgcgcgtaccatgggttgtgggctgtcgagggagaaggacgccggcggcggcccacggcggcggccggggagcgtcggcgacgtggtcgtgttcctcccggggctccgggtgccgaggagcgtggacttctcccaggcgctcgccggtcgcctcgacgaggcctcgtcgaggctgtcgtcgctgcgggcgcgggtcgtcgacatggcaatgcaagaatcggcggcggcgctgaagccgaagcggcgggcggcggcgcggcacggtgagtgagggtggtggtggtagcgcatctgaattgctggctggttttgcctgcaaaatttggattggttctcatttctttggttattttttctacaggttcgagcactgctaatctcctacaggctctggaagactatctgccagtgctgctaggattggtgaaggaaggtgaggaattgctccgatatggtggattggtgttctgttggttgacaatcttgttgtttcgtttgattcagcctgtgaactctgcaggtagcgaattgcggcacggagtgcacttcgtctggactaaccaagaggataatgctgaggtatgtgttgggtcctaaaaatgtggtgtgtcatcttcctccatgatgcccgacagtagccattagatctaacattggaattgccaactgcaggaaacggccatggcagatgcatggtatgaagtgttgtccgttctgcatttgatggccatggtctgcttgttgcaggccaattctctgcttcttcccaggtcatacggtgatggttatgcgccaagggtttctgaaggtataaaactgtttttctgaacttctgaagcaatatgggcatatgaaaatgttcatgtcctgctttccattgagttacttctttcagtgtttttgtgctaataatgcaccatgtattgccaatgtacacagagagc

SEQ ID NO: 31955 - DNA, 1501 bp, Oryza sativa
ttctgccatgagacaacccgagcagtgtatatccaaagttatgccaatccacaatagacttagcacctcttagcccgctagccagttttacagcagccaatgttggaacagagggtggattctgtcagacagaagatgagatgatcaaataaaagaaatcagttccattccaattgtacgacacgatcagtcacgtatgaggttttctaattaacaaataaattataagtatcatacagaaggatctataggttatataaatctatcagttaatacggcctacaaaacgatgagactttgactaagtacaggctgcacatatcttagctgaaatgttgaattgaaaatggtgtcatgcagcatgacttgctaactaagctgggaaatactttgctaacaccatggttttactacaatgattgatgaatgatgaatcataaaagaattccacactactgaaagtgatagtgattgtagaaaaatacatattgtccatgtaattctgaaccatgcatgcaaaactgcaaataaagaagctcaatgcaattttgtgataactgacctgaacaatgaagacatcagggcgaggaatcttgaaacaaaggtaccaaatcaatatgataaactggatggcggctttaagtagcattgacagggcaccagatatctttgatattcctgttaactgcactgatttctagaaggtacaatttgtaagtactgatagtaggcaaaattagagaacagccaacagcataatgctttcgcacaatcagtaccatttcgtggatgtgaatcaatggattttctctcaataatagatgtgggtcacttcctgctcatttacccaaagcagaacataggtcaaatttcaacaacagaaggtcgaaagctgttggaaattcagcctgtctgtgtgccctatgtggtatagttaggtataaataacttcgagttacaatgctggagtaaaatccaaaagtacaatggaactttgaaaagagcaatacctccatttgcaacaatgtccacttccataccaccctgtcaagaaaaataaagaacgactaataaactaaaacatagacatatgctggcacatagagttggctgtttcacaacataaagcatgttccaatttcccaatttttttgccacttgaaggaaaaatgcttagtaaatgcaaggcaattttcttctattcacttcaaagtctgtcttatctaacaggattaatatttgcacgtgcaatcacactttcagggataaaaaagcacatttttaagggagcaaaaaactgacggcattaatcaaagcgaaactatgtcagctcacactttcaggggggcaaatgaccaccactacgttagttcatcggtgcactggcacaactgagacgtaccacatctccttcctttccttgttattaccatgctatataacctaggaccaaaggcttctctagagtagagtatagatggccaaaaggcccgaggcccga

SEQ ID NO: 31956 - DNA, 1021 bp, Oryza sativa
aatcatgttcatcaatgggagaaagacttagtgaggtaagaaatgacagaccataagctacgtcattacattgagaaaggagaggactaggcatgcatggcaatctcaaaattttgtgaaacgttagcgaatagtgataaatatgaacaagtttgtatttctctgtggcatagaataaattatatgcaaaaggtgtgaaaaaaataaatagaaagcaacaaagggatggtatttttttagaataaaatatttagtccttcttttaattgttataaccaatttcgcacttctgtatggattcggagcatgggaaccccaaggacaagatattctattacatactcttacgaatatacgttcacacaaacactaacagcaccttgcttcactttatatatataatagtactaccagtcgtgttgcataaaagcaagtttacaacacacatgtaaattgtaactcaatcattattacttctagtccaagtcttgaatttgcatgcttgagtactatgaacacccattgactacctattcatgttacagtaatgtgtcctataaatctcacatgaataagacgggatggctatttattattagagcttgttctatgcaagagttctagctattgcgtgcatctttgaccaacatcatcccctaaatcttattcatgctcataaatttatctttactttcttgttgcaaaccattttacaattttttttcaaaaaaaaaatccgacaccttttttcgcctccgtgaggatcggagcaacaaagatgagggcaatgtgtgggtgctttctaatatttctcagcttgtgtcttagcacaaagggaaaagggtgacgctctactgtccctctttgcttgccctttgggttcatcattccgaggacccacgagtggcctagctgctacacgtacactccatccatccaacccctcacatgccacagctatcttagctcactctagagagaatttgaagctactagatatgtagctcctctcttctccaaa

SEQ ID NO: 31957 - DNA, 582 bp, Oryza sativa
ttcatggagtaaggatgcatctggagtgtgtgaacttgacatcaattaattagtagggcttggtattatgtgcatgcatccctcttgcaacaccagtgtgatgtgatgaggtcctctatggtgttggctagcacagaatgataatgtacttgaccctctatccactatgaaatttggatttcttacccacctttgaatgtttgatagttcatgatgtatatcttgtcctatacatgatttggctattgctcattaaatttgcactagaatgagattagattatcaatttttccttaatttgtttctacttgttgatttatacgagtcatattttttatagaaaatgttctcagatagtactcaattaattgtttcataatgttcagacgatatcatttttaaaaccatcgtaaacacactaccatactcttatatcattgataatacagaataacgacataccgggtatatattctcgttggcatgggttatactaatttttttttgccatgggtagaataacggggccgtgaagccaaggggagacattgcaggtgcggggtgtcagaggggagcatctaa

SEQ ID NO: 31958 - DNA, 384 bp, Oryza sativa
ttttaccctagaaaaaaaaagaaaaacctaaccctttgaatcttaggtatccttcaaatcttcggtattcttcgagtcttcggtacgcttcgaatccttatggggaagtctataaattatacgccccttgcttgaatcataatgacttacttcaattttgaccctatcccccatcagtattcgtatagaactagaccggatctttcctgaaatatagcccaggatgatggtgtcattctctaggcgaacgcgaaacattccgttgggtagggcttccataactaaaccctcgaaagtaatttttgcttctctcgggttttttttttctctcctatttttcttttctgccatatttttttctcctatttttctttttttattttc

SEQ ID NO: 31959 - DNA, 1501 bp, Oryza sativa
tggccatacgtatgtgtttttcatgtcacaactttaataacttctatttaataaatttatatgtttacgaagtgacatatcacatatttatccatttaattaattaatttttaaaaaagaattaacagctatttagatgaacgagggtttagaatacttttccacgcagatggtgatactatatatattgagttgactgttcaatttaactcaaaagctaacatgatgagtgaagaggagcagttcaatttatattcctagcactactaatgcacacggccgcacgtcggcgccggcgacagataccatcaaaccacaccgcgttccaacgaggagagatcagaccagatatatatctgatatttatctgcatgactagtattctctcccttttatattataaatcatttgattttttttaagtaaaattttgttaagctcaattaagtttatattaaaatttagcaacatcaaaaatattaaattagttttatcaaacgtaagattgaatttattttgataatatgtttatttttttacttaggaaaaaaaaccaaacaacttataatataaaatggagaaggtagtatttaaatactcctccatgatatcacccctggctactcatgggctattatactatttgccatgagaaacgcttccaagaaattatattcgagtgaactaaccaatcatgttaacctgtcattattatactgataatttattctcaaatcatagctgcaagaactacgatctcgctggtcgctgctattatctttggattcgtcgtttctggcatctgttactacgagtggaataaaataaatactagtttttgccaagataatccaacgtcaacgtaactactgagccactagtgttataaataatcagcttcgagaatggagatgtagttttttttttacgagggagaatcgagatacagttcatagcgcagtgataaatggtgtgtgattttaacctcgagatcccgtatttaattcctaacatgctcacaatttttcaaaaaaatgtttggagggatgtctctcatttcaaatctttctttttattataaataatcagcttctctccttgagctactcgccgaggcacactttgactgacacttccattgcagaagaagcagaagagacagatcaaagatcaagatgttcagagcattgcagatcgtcctcaggtatagttttacatgatcctagctgcaaattaaagcttcatcgctgtcaagatcgccttggattaagaacaagaacagcttaattacttatatgtgtttttgtgcaattttatatatttgtgtgttgggtgcaggggtaagagccgaggatttgtcagtcacttctcctccacggcttcaaattctgaaaggttgcaaacttaatttcagcatctatttatgtttgattttttttttgttcactttgtgtttggttgcttgcgggttgtgaatcatggagaagcattgcgccgtgac

SEQ ID NO: 31960 - DNA, 1501 bp, Oryza sativa
tttttaaaaacagaaagtgccggtcggagtattttttttagaaaattttggaaatgaaaacaaatttgatttttttcttggaaatgaaaggcactatccataggaaagcgaaagttgcctagaaacttcctgaaaaattcttagaattttgaagtaaaggcccatattaccaaacatcaatttggtccaacccaaatagtagggcctactactcctatatattaagatagtcaaataggggtgatcaaaaacaaaccatccactaaagactgagccgaaccgaagatgtgttttcttactaaaaagttaaaagctcagtttagagggttttatatttcgacaaatattcattatgatattcactcctatttatgtatgatccattttcatattggttttcgatttcgaaaagaaaatgatagagctggttacctacacaaggcgcaggccaccaccggcaccggacgagaattctgtgttgctgatcctacccgaataaagatcaaaatcagtgcggggacacaactttgtcatattcagagacatttataggatgtttaaattgtatttttctcgaaatacagcaaggggatgtagctcaaatggtagagcgctcgctttgcatgcgagaggcacggggttcgatcccccgcatctccattttaatttttgttttgtgtgactctgactctgctgccttgtgtccttgaccccccctgttgtcaaaatccaggcagcccaaaacgagctgccttgtttttttttccccgtattgtgaatttttgatacacggcaagtgctttccccttcttttaagaaaaaaaattccgtgagacgagaaaaatcgagttgggaacttgggacttgggatttgggaattggtcctctcttcagctgtagtacgtgggattgggccgtaactgaatagctcgctgatcgcagcgtgaggagggctttgtgttccaataatttggtttggcccggaccacggacgcctgttggaccgcacggcccaggcgtgccatcatcttcgccgcgtctattcgaagcgatgctgaatccaagaccgaatgcctccatccttcttcagtcattttcggagtgaatttgctccctcctgcacacgaacgaatacggcaacatcatggacgataacgattgacaagctaacgagagtgattcgtcgagaagaagctaagaagcagcttttcatgtccacttcctaagcgtgttcatctatggttttgaaggaagcgtccaaaactggagatgtgcagcgattagcatagctcccagcccaacgtgcttcaaagcgagtcgaggccggttttgaccggaccgtagataggatatttgtatagcatgaagagcagtctctttttgtgtgtcattaattcatctttctagcattgcgcgcgcgcgcacccacatatatatatatatatatatatatatatatatatatatatatatatatatatatatatatatatatatagga

SEQ ID NO: 31961 - DNA, 1501 bp, Oryza sativa
ctcttcttccccggccgcgccctctcggtgccgcgccaccccgccgacgcgaccgcctcgccgcgactccatccgcgccgtcgacaccgtttctctcgtcggtgagctccccactgaaccccttttcccttgtcgcacgccgcgccgcgcccgccaccgttcgtcacatctcgccgcgcgcccttgctctgtcctggtcgtcgctcgccgtcgccggcctctctcggcgtcgcccgtgccctctcgaccggtggaatgagctcgcgacctcgcgtagatgctccaacttcaacgaatcgaacccccgttgccccggtgaagttttccccctttgctcgccgccgacgatcgccgtcgaaatccgccgccgtcggctcccctcttgtcaatccctcttgccaccacgctctcggggatccccttgatctcccccttgttgcctcatggccgccggcctcccctctcgctctcgcgccgtgccgccccttccgccaccgcttagcgccgccgcctgtgcgtcgccggtgaccttcgggtcccgcgtcaccgtgtgcgcgtcgcaaccccttttccacgacagctgaccctgagaccgcgcgcccttcgctctttccacgcgcggccacatcggcgtgtcggcgagattggccaccgccgtcggccgccgtcgttcttcccccggctaatccgctccgttgaatcgattccccttggcctcctctctcttccggtgctaaccccccaatccacctcgccgccgttcgccggttcgcgtcgctcatcgctagccatcggatcagcctgcccggcctcctctgcctccccatccgacgtggcttccacgtggacgccacctcaaccccgggccagcttgaccgagtcaagccggcgcccagtcagcccccctcctccctctccccgctcgtgggcttggcccgtcaaccatccccccttctcggcctaggggaaaatgaaaagtctacttttactccctctgtccaagcccagtgcccacacacatgaacaaaagtccacttaatccccccccatgtacagtacacccttggccccgcacgtcagtgactgtcaataatattcttgagaatattatttccataaatttcgacaaaacatttccttgtccagaaaatccatttagacctccaaaattcatatccctcgatccgtagctccgatcgcctccgttccacttccagtaattccgtaaaattgagatctatttaatggcactactaattagtctaaataggatctttattttggtcctttgtttaggttttcgattgtttgcgtatagttgcggttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcg

SEQ ID NO: 31962 - DNA, 1501 bp, Oryza sativa
cccaaccaacctaatttggatccgtcctccagccaatgtccaagctcacaaaggcttcatcgatcaggacacggatcgacgccgatcagtttcgcgaaacgccgtattcgtacgaggcaacgaggcattaccgtcagtacaccaacagcttgtccgcttgattacgtgcgtttccatgagttctatttatctgcggtgggcggtagctcgccgctaacgccccagaggcagccaatgccacgccgcccgggcgcgcgagtaggtggcggcggtagacgagacccgttcaaaaacaggtccatatgaacgccgcgatgggtcggtacgattagatgctttcgggccttaaagataaaaatctgttccggcccagtccatacagacgggtcaacggagcaaattacaggccatatctccatcggtttaaacggcctcgtctggtagaaataagtctattttgtctcccttaactcatgcccctggttgaatcgaatccctcaaccgcaaaatcagatataacccgttcccctaactctcaaaatcagatataaagacggtaacgttaaacagactaggctgactatgagaagttctcttcgtaccggccctgttcttttaagatgtgagtttatatgtgctttaaggtttagagaattttttcaaagaagtacttcctccatactcgtaaaggaagtcgtttaggacagcgacacgatctccaaaacacaactttgacttcttatttctataaaaatatttattgaaaagtgatatatgtatacttttatgaaagtatttttcaagacaaatctatacatataatttttatattttttcaaactcaacaacttgagaattattcatgatttatattcccaaggtttgacttaaacattgttctaaacgactttctttatgagtatggagtagtactgcattaattatacaatttgccttaagctatctactaagtttattttaaataaatatttaattcattctataataaagaaatagtccgcgatatctgcttaaaaatttaaaccaacaatcagggcctctaggaaattctcgagaaggatctgaacaacttaaaattttccattcatcaacacgggtcatggttaattttcgcggcccatcgtacaaaatactagctactagtatttgaaagaacacacataatgtcaatccaaatcgtacgcggaagaacccgaaataagatcgagcaacttcagccagggctgcctcgcaacaaaagacggcgcagcagcccataacttctcttctcatcgtgccgacggaacaaacaatagtggacctcgcgatcaccaccagaccaccaacatgcacgcgcactagtcattgcagctccgagatggcttgctgcatgtacttgcacgacctctggtagctcacgaaccccatgaaccagaactcgaagccgtccaccgtgacgacgtggatgtacttctcctccggcttgtcggcattctcgctc

SEQ ID NO: 31963 - DNA, 1501 bp, Oryza sativa
catgactaagcaatcagctgagaaaaatgcaccaaagtgacttactctaagaaacaaaaggatcattccattcctgaactcagcttttagcccaagattagagtcaatctaaagtccacaaaaatcatgagcccgagaataatggatttttaggaaaatacattcgctcctcatagggtcaaactgttttcgaactatattagccgaagccgacaattcatagcaaagtatgataaaaatctcaatcacaccatcatagtaaagtccacaaaaatcatgagccccagaataatggatttttaggaaaattcattcgctcctcatagggtcaaactgttttctaactatattagccgaagccgacaattcatagcaaagtatgataaaaatctcaatcacaccatcatagttgagaactcccattgcctaaatatgacatgtaaaatcagaatgaaatttgtgcgatggatcgactgggactcgatggggctcagattcagtaaactactccctggctggcattgctagcacacaagtcatagatcgaggaatctctctctcctagctccgagtaagacctatgacccccggactggttggatgaaagagggtgtgagccctgggaacgcgaatgaggaagggaggggggatggaggagggggacacgtacttacacccgcgaggcaacgggttcccctcatctgcatccgccagggccacggcgagcgagcatcgtcgccggtgcggcggagcagaccccaacttccgcgactccgacggccgcacggcgatgcacaattgcacatcgccgcctgcgaggggcatgccgcagccgcagccgccgccgccgctagacggctagacgcccacctccccgccacgcccgccgccgccaccggccactgcccgccacgcccgcgagccgacggcgtccttgagaggagaggtctcgggagagagggagaggtgggagagagcatgacggatgggcccacgtcaggggtattttggtcgggaaaaaaataaaattgagcaaaaactttctattcacaaaaaagaactaaaatggcattttggtaaacacatctcaatttagtgtgacattacaatgaatcagtttgaagcgatggcaatccagcgaaaccactcttttacgatggtataatcctaaatttctcgccaggagaatcggagaagagctccgcgccctcgtccatgctacggtgccgccgcggtgggcgatgagtagtatccccaattccccattggtaatcttgtctcaaagaggatgaatggatgtgcctatgtctcgcggttcatcatcttctccttaatttacgcttggctgggaagtggatttttgtccctcgaggggacatcctctcattttgtgcctgtcattaaaaagctatcaaaaaattttaaaaatttatcaagatagattaatatataatatatcttattgcaaacatgcgagttaaaattcgacttatacaattgg

SEQ ID NO: 31964 - DNA, 245 bp, Oryza sativa
acagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagatgggggatttatttttttcggatccagaacgaccagagagggaga

SEQ ID NO: 31965 - DNA, 1501 bp, Oryza sativa
atcacagaagaacatgaatgaagcatacaacgatggaccatccacacagcagttgccaaatgatcagtataggtctcagccaagagaagccaaggaagagcaaggagctgatgcagcactaatcaatgaaattggcaaggcccaaaaggatgatttgttggcaaatccaaatcaaagtagcactggaagagttcaaccaacatcaactgaagaaacatccaagcagcaactgcaatccgggctgaacaagcctatatcatctaaagatggcaaagaaacagtaagctatggcagctcagcaacgtccagagaaatgctaccttctattcctgataagagcatgagagtgcagcaaccgcaaggtgacaagtccagctactccagtatatcacaagaagacaatgtgaagcaagggtctcaagctgcactgcagggatctggaaatgagcagcctaagaaaagggacctccttgcaaatgctgatgagaaaatcagaggaactacaggagaagccttacaaaagtctgatgaagggcggatctcctctaatactgagcaaatgaaaagcaacagaaataacagcaaaccagatggctcaactgaacccacttcatttgatggcaatgaaggtaatcttcctgagtcacagaggcgtggctcatcaagcaacccgtaaaatgcttcatcagctcattttctttcaccatctctgccgtactgctatctacttccctattttcacataataaggtcacctatacaccagcggaccagccataccagtccatgttgtctactctgcatgtttattattccttcccagtggtgcagtattgttcattacttgaacaatgacttgttcagatgtcaaagttcttaatttaatcttgttttgaataatgtgaatgcaatatagcattctccatatgaaccctatctctttgtaagttatccatgcgcattcaccttaattatctattatatggtattaattgttctggaatcacatccatgcattaccaatgtgtcattaacccattaccagttaggatatctcttaaccaaaaaaaacttggaaagattgcctccattccctagtaagtggcaagctacatagatgctcagccagaggtaaatatttaaatcaaacagaaaggtagggggaaatgaattcttcattgtatatatcgtcacatcacagatgcacacatgttagagtagcttaatttagtacttatgtcatagttaaagcttaagtgtggatattttgccaccttcctaacaacattaatttaactatctggaatacattgcagcatcctaggccttgctcgtggaaatatgattaactcctcaacagattgaccttagactgctaatataacaactgtacaataagctcaacaaacagcatagtggccactgttatgggcacaactcagcccatctcatgcattcagttagtttgttaggctttgttagatagggttgttaggagcct

SEQ ID NO: 31966 - DNA, 1501 bp, Oryza sativa
attttagtttggttctgactccatggatctcaactatcctatccagcatcaagaccaaacccagcagccatcatgcaggttagttgtctctaacccatatcaccatactactcactattgtggttttattttcttttttgtgctgcccaactgatacatatatgttttggaatatatgatgtatttggtgctggaactcctgagttcatgtttgaatagatgtattcaatttttaggtagtaaacaacagaagttgttctgtatggtctacttgtttgattgattgataattttacagtgcatttgtactaaacttacagtgcacttacatgtcatatatactgtttttacaaatgtaattttagtgcaaatgcactgtaagttttactttcagtgtatgaactgtgccctgtattttgttcaaaacactccttatgcatatgggatgggggcacgtatggtgctatgatctaagatttgtagacaattttgaggatgagcacaggtttatggaacatacctaatttggatttcttccttatttcctgtttctcccctgtgatttcactttgatttgaagaattttgctttggttcaaccttttttctcttctttctctcctactcgttctccatggtgtgcgtggtgttgcttttttggatctggtgtgttaatttggatttgtgtttgtcctttttcttttagctttcttggcagccaagttgatgcttttggacagggttgactttacttctttgggcctctcagatatgttctttgtttgatttatttttctaatttgttgtttgggccagattgcagcccatgttttatctgtttttttagtgtgttggcccagtcatttttggccttttttggctgtctgttcggtttttttttaactctattggatgaaaatctaagggcaaggaaaaatctggatgatttttgagaaaaaatcacccgacagatgcataggtggttccatctggaatcatttttcttcccgagttgctttgccgttgtgtactttcagcggctttggttcgtgttcctcgctgaaacgatagacaaaaatcactcacaaagtaaagcgcccaacagaaatcactcaggattgcaagagattggaggggagaatgaaatctccattttcgttttcgatggagatgattcctccaatatttattctctgacatgtaccaagtaccatggcctgtaaagaagggagaagatgaaaggaaaaggctgcgggtgattaggaccaaaaccatagcccatgtcagccgcatccgacccaaagggcctaaatttccgataggccgagaccatagcccatgtttctctctagaaggaagacggcccattacatctaggcccaagcgaggcgtgacaaagaaggacccgaactgcggaactgctgctacacatcaacggatcaacccttgtccttcactcgcgaagtcccctcgaactcccaggcgcgcaaaaagtcccctgg

SEQ ID NO: 31967 - DNA, 1501 bp, Oryza sativa
gcaaataggtaatatattcattgagttcgttctaattctacaactaccgagcagggtttcctaaaccgccggggccggggttaccgcgccccggcggtaagcacgataaccgcggtaaccgtgaaaaaccgtgcaaaatttatcaaaaattcaaattatttttaaaatttatttgaatttaaggaggttaccgtggtaagcccggtaaccgcgcggtaaggtaaaccctgctaccgagatcattcaaccacactcatgcataggattgtaggactaggatagctttcagtcatattcatacataaatgtatataagaaaaggtatgcatttaatcagcatgtccggattccagaagcaagcttcatcaggaaggcaagaaagccaaaccatgttacctgctataataaatttaaattggatacgaaattggtgaagcgataataaaatttaagccgctcacttaaatcattctgcaaatgttttatttctacttgttatccttaagcaagcacctttgcacttgatggcatagtttctccaaggcaagataagtcttattttcatcacttaaacccacacaattctccaatttttgactgacactaaactgagttcacatgataattccatttttcagtgaaaggttatggaggtgaattccccacatttcgtcagcattcaaagacaaaactttttccaacaaggggaagtcatcatcaagtagttagcagctgcattgattcattacttgtgtcacgtcagtggctttggattcaaatcagcaataacagcttacggttctggattgccagctactcagctactccctccgtttcatattactttgcattagccatattcatatagatgttaatgaatctagacacatatgtatgcctagattcattagcatctatatgaatgtagccaatgctacaaagtcttatattgtgaaacggatgaagtatttcataccttaaggtccataacaacctgcaagatggaatcatgaaacttacaggcaaaggatattctgcagaccagtcttgctatccatcattactgattaagatagttggaaagcacctcccaacaacctgcttagcccctgcatggttgagcggaagaaaataagagactataaacgagcatgatcagctagagagtagaggaagagtacgttagttcaaactgaaggttagacttgaatgaagaactcaaaatggtaccgactaataaagttttcctttttatcagagttttgcatgtggagaatctatacattgagaataaagcaacctgtccaaccccccatgttaaatgacactagaccccccaacattaaattagtagccacaaatctcccagcagacatataacaaacaccactgtactgtactgctgtactgctgtagtatccaactatccatgatggggttaatacgttgatcacctgacacaaaccgttgacaagaaaagcaaaatagtagcatgttacat

SEQ ID NO: 31968 - DNA, 1501 bp, Oryza sativa
acaaaatactaagttcactgatcatccagggtgccaagaaatagtaaagcaaataggatagtgatatataagcatcccactcaaaagtcaaaagcaaaataaagtaccatacctcattgccatcctcgtcaaatgacatagcctctgcatttaaggaatccaacctcagaatgctagcatgagaaactatggagaacttaagtgatgcatttttttaaggaaaaaaaagagagagaagtccataatattgatggccattgcagtaattttgactcaattttttttgagataaaaagaaacgcgaatattagggaaggacctaatatcaaataaatataaggggtgaagcttcaaacttaggccggctagcctaccaccttgtggagctagctataagacccctgggttttgagatagcaagcttgctaggaactgagagtagtgaaattgccactaatactatattagctcagtgactcctctgacccgggtgttcttattcttttgagagggacccgggtgttattaacttacaaaaggatcagacaaaaggattgcctgccgatgcattaagattttgggggaaacaaggtacagtgtaattgacttattacatcacgtgcatgacattaatattttaatctatctaaattgtcaattccggcatgaatgattggtaagatatcagctatcatcagttcactatccggtacacggcctgccctgcacaatcacatactcgaattcgatctaaaaaaagagagatttggagggagagacttcgctccaaacattttcttaagaatgaaattatgagcatgttagggattgaacacagaaatttggtattaaaaccacacacctcttgccactgcactatctactgcatctcaaagcttcccaaatccaaagcaacacaacaatctagcgcggctaccgcatctcaatgaaaagtcacgagtgcacgagaaaatcgccattggatcacaatattcagagtttttggcatgtacctgcggcgagcgcctcgagggaagatggcgccggggcaggagacggcgacgacgacggcgccgcctcgacggcaggcggagaaggctcctccaccgcctgcgcgggctggctcagaccttgacccatcgaggtgtagcgctagagaagaagcaggcggcggccacactctctcgtcttcccgggctgcgacggcgagaacgggagcaagcggcggcgcggcgagttggagcgtggtcaagtcggccggcgtccaagtccaactaaataacaggcccgagcaccaccacatcaccggaagcaaaattggacccgagttcaactccggcgagcgctttcccagccgtccaaatcgcatcaagattcgtgcaacgcggagacaggcttactgggccggcccggcccgtttggtgaatggctcgcgacctcggagaacctaaagcctaaaccgcggcttgggttcgggggagctccaggccgccggcgacga

SEQ ID NO: 31969 - DNA, 1501 bp, Oryza sativa
gaacgcagcctaagggtgtgttcggttgggctgtggcttttgaaaaaatagctgtgtgctgtgactttttgaaaagtagctgtgaaaaaaccaaaagctcgtttggttacacacagatggcttttgtaaaagcttctcccctaacgagtagaccccacatgtcatatacataggtatcttctccatcctcccctgacgagcatgctggcggctgacgacttcgcacgtgtgggcggctagctcggtgaggaggcagaggcagacgcgagtggggcggaggccgccgcgcacgcgcgctcgccgtcgccggagctccactacggccacctcccatgcccgccgacgacgactgaacaacgacgacttcgcacgcacgggcagctcgactggaggagcggcgacggcggcggcggcggggaggaggattagcggcgatggcgaagtgaggaggatgaggagcgacgcttgtggaagggatgggagaaaaagaaaagcaaaccgttttttttaatggcagtggtaggtaattttttcctcgaaagcatgtgaaagcaagggtagaggtgtgtttgatttgtactacaccaaaagctggctttgggaaaaaaaacagttgtagcttttaggccttggtttttggattttgcaaaagcaaaagcaggttgaaaagcccaacctaacacaccctaagtttaaataagtttgtggacaaatatactaacattacaacaccaaattagttacattgaatctataattgaatatatttttctagtatatttgtcttgtgctaaatatattactatttttttctacaaactttatcaaactagaaccattttgactttgacaaaagtcgaaatgacttaaaggtcataaattgacaaacaccatgagaaaccattaatgcgatcccagtgatctcctatgtgatgtctgcagtggaagtagagattgtagtcttcgaaccgctccagggcttgtcatcgatatgtcgaagtagctggagcggtggcacgtacaagatcatcggtttgattgcgaaggggtccattagggtggtagcgtccctctactctatgccacctcgactactcaacaagggcaaccgcacgttcttgttctagttctagtcattgtctactcaatatgcattcatgattggtcttgcgtatttgagttggcaatgactacagggagggagggattagagacatgagataggagatggtttggagttaatttacaaagataaatttatatttacaagataatctattatacttattaaaaaaacagcctaaaaagtaggagattttttaaagataaattttataataataactaggagctgccgttttattaatttggggatataaattttatacttcctccgtttcatattataagattttctagcattacgcgcacgcgcacacatacatacacacacacacacacacatatatatatatatatatatatatatatatatatatat

SEQ ID NO: 31970 - DNA, 1501 bp, Oryza sativa
tttcctatgcctaagccgactgtaagtttacatcttacttttcatctctcatccacctcagcattaagcgttcttacagcccactattatattttctctcgtgacatcagtaatccgtagtcctatcgtctatcgacactaccatattcatcgtacacgctgtttctagcaacagaatcatgagttacagaaacaagctttattcaaagagaaccttttgcttaaaatctgaaaatttccacaacatataggtagcaaccataactatacagtaacaaagttgcagagattaacttcctcttaggggaaaaaaagaaatccttctaattaatctctgcacagagtattcagataagtgaccatgctgagatatccaaatgacaagttgccttttgaaaaaaaaaatcagaaaagaaacctcaacttcaatacggctcatttagacattcaggcccaacaagcgggctccggcctctgggcctgatctgagctgtatttgggccttacaaatgagctgttaactcggatgggcctaggcccacaccgtgtgggctgcttgcagagaaaccagaagcagaagcagacacagacctcgtcgcctccagatcgacggcgactacggcggcggcggcgggtgccaccgccaacgccgaggcagagagcggcaatggcgatgagccgcgcccacccgtctgcatggggaaggaggcggtcaggcggcggaggagggggaggagatccgcatccgctccagcttgaccaggcaagctttcctcgacgccctcccctcccatcccctccgccgccatgcgtgtcggatcgaactgcttctccgtgagatttacagaggaacgccattttctggaggatgcatgtgagatgctgcagtgcagatggattggaccacaaggtacattggcgataagaatttgtcgaggaagttgttcaaatcgaagccaaccaaccaacaccttcctaaccctaatcaaatttgatgtgggcgaaaagatctgcggctagcctatcacccatcgatctcttcctacgccattgaagttaacaagcaagctaggaagctacatgctgtcctcgtgtcgatctctttattatccacagtacggtacggaccagtatacagttgcatcacttgcatgatcattgatcaaacagctcacaacctcactcctttcccttgcaggattggtctttttttatggattgctttgcaattgtaattgacaagaaaacacagcgaggtatagcaaagaactcttcagtgtagttcttggaacaactctttacagaagtgcaacctgcagcacattgcgagttcagaaaccagaaatgcgcaagagttcagaaaggcatgtaaaatggagaacatatggatgccacatctgatgatatcacatcatcgtagaaatatggagcacataccatatgcaagttgcttgtaatgctagtcaagtcttcctcaaccaacccctaatgatcagataag

SEQ ID NO: 31971 - DNA, 1501 bp, Oryza sativa
ttagtacgtactatcctctcctcctccattttgctttctgcaattctgctgcatgtattctgacgaacaatttgcacctttataaggctccatttcgtggcgcatgtccctgcttccacctagactgggacaccggtagagtgaaagggtgactcgatcgcagggtatcagtagttcttctgcaaatctgcaatgcacacaagtcaaatggagagtactggactagttcgagaggaatgcaactttccctctcaaaaataataagttgattttttccattttgctttttccaagtaatggtggcaacgtgacatccctcacaaggtaagataatcataaaccattttttaaggaacataattttaataagatatttaactatttataagataccattgaacccacatgttatagacacatgaaaacgcacatgtcatagactgtaagtggtaaatccttaattgtcacatcttaaaagtgacaaaaaattaaatgcttaattttaatatccatgatataaacataatcaattgcgtcgatcaaatggaaaatctttacttaccgttttcctgttctatatagcatgccacaaccgtccgaataggaaatcgtgtgattgtatcatggcatgtatcaatttgcgttgagctaatgccaagatcatatgttttcatccttatacttgtaccttcgccaacatgaaattttagtagtttattttagaaaatataatagcatcgtagcattagtcatcgatattttttccttaagtattattaatttttttacaactgggattgcttcaagatccgttcaaccctaatttatttatctaaccaccctctcctcctcaccacttctagccaacctgacttgattgccgttgtcagtctcttggtctctaccagtctctgtcaacccaatgccagccgattgccgcttcccccctccttctccacaagattcatcattgtcatctccaagtatgtcgccatccctcccccttgtcttttctcaaccatgagatgtcggatcctcaaccgctacccccaaccttctaactagaaggcctctatcactcccacagctcacttcacccgctgccctccttcgtgcctatatctctggctatcaataccttgctgcctgtccatatccgctccaaaaccactagtcttccaacacttgaccattccattaaagccattctcattggcccccatcctcttaccgtctttaatgtcaaaagcttaatccgtcaaagcctactagagtttaggcgtcactgatgttgtcaccaaaggagttcaagttatctttctacctcactcttggctagatgtgaagaagattgctaagccgaccattagatcttgatccaagggcatttatcgatagattgagatatgaggaaaatctcaattggccgaggaatatcaaaaggcaaatgttatcctaactctattgtagtagtcatggattgcaatggtcagtaatagcc

SEQ ID NO: 31972 - DNA, 1501 bp, Oryza sativa
ccggaaaagggaaaaacggcccaacgaccaagagggaggtgaaacggctgagggagggaggtgggctaaggggaaaacggcccacaatacccgagggaggtaaaatagacttttgcagagaagactgatttggagtggattcgaattgaggttttggatttgaattcaaatttgacattcgaactcgatggtttaggttggaatcaagggagactcgaggagaagtcaagaaagagattcaaaacgaaaacttggatatttttttttagtcggagcgaatattcggcaaggattcaaaggaagggattgactttcggaatttgatttcggagacttgaattttggataggaaatcttgaggtggaggatttttgatttcgatgagggggaacaacgggatttgaaatgagatcttggcacgacttagactcgcacacaaagaacgaaaattttcgcaattaggattttgccgagttagtttttaacgactcatgaaaagcggagcgttacaaatagtagatcaaaacagccgatcggctgacaagccgatggagtagttccagccgatatccaataatagccgatgccgatactagctgatagcgatagggtttaagcaatcggctatatgtccaatgtagatgatgatataaaggcaatcggctgatgatgatgtaataaaataacaatatagtccagtataaaccaatcggcaaataatgatatgataaataagcatcgatccgaaggttgaagcacacatcggctggaggtccgatgtcatgaaatccacaagattagattaaacagcgaaacatttgttgtcatcggctaaatccaacttatatgtatatgcaatccttatgagccgatgcaacgtccagataactcaccggctgaaaccccgatgaaacccttattggcaatcaagaagcaggctagagattatggttctaagcacgacttagtagatcaaacttaactgatgcaacactaagtatgaaaaaaaacataatatctagacaatcaagccgttgactgagttttcagggtggtagatgtctaagctaatctaatctagcaacgcgatttagccgataccgacagaaaccctaaaacgagaagcagccgatagagctaaattgatatgctaagactagattaacagagacatgataaataggtaggcaaatatatcatctaaaccagagcaatccaagaggttgaatgtactgatgcagccttgaacgacgccgacataaacgatacaactacctaggccagtggaacattggacttaccccttagccagagatcgaacaccgatgcagccccgcgtcaggtgccaagtcccgccggacgataaaaataaagtagaaaaggtaaaaggtggcgatgcgccgaattgtattgattgtgaagatagattacatagaccccgggtgtacatatttatacccatgggttgatacaagtccttgttggaccaaaaagaaacttt

SEQ ID NO: 31973 - DNA, 1501 bp, Oryza sativa
atagcctcaaaataatgttggtttctaattggctagtcagacatacatgagatggttcaagatccttaggctttgatcattgagaaatagagactttgcaaataaaagcagatgattggaatttcattgctgtcaattatttacgttcccaatatgtttataatgttgcacctggtggatctttagcaagcgtgtatcatatcttaagagaatatagcatgggatagataacccataagaattatccatagtagaagatggattatagccttttttttccgagaactttatacatggggttacttacactaatgtgaatggcttatcaatgccacgacacgttgatacccccattcttttcttttgccatgcgtccgggtggaaccaatagaacgggactttgcaaattgcaaacactgaaagtaagcaggcagggcctgacctgtgtcattcttcacaacctaacttgcacctccccgactaaggaaaaaaaaacagtaaaagagctagctcatcaatgtttggtgggtcatcacttttcacacgcatatccttgttctcatggtgtaaacatatccagctggtataagaatatgatatagtgccttaaacgcatagtgggatgagctactaggggggtcatatacatagttaaatatactacaaagcacttacgactacagtaactgaatatgcatgcggtgtctgcatccatatacatttgccattggataacaatgaagctagcttctcctttccattgagctccaagtatatctaatttgacgacataccgatttagattttgaatagaccaatttcgcaccagatacatgctactttcacctttcagacactaataatctatcaatatgagataacacacacatgtcctctttatttgtatattccagtccttatctattctagctgtgcatagggaatattttccacgcaaaacccagcgcatatcccgcagtttctccaccttttctcatgtttttcttccttccttttttttttttttgtcacagcaagagtgctttagctatagtcaatggaaggccaaactaaagttatccactttgacctctgaaatcaaaacgccagctcccccaacaaccttttaactccgatgtctatctccatatgaccatatcccacgcaacaacacagagcatggtcacaaaagcaacacataaaaaaaaatccaaacgagacatgtacacattgccagatcgcatcatcactgacagggaagccataacgcacacacatgcgcatgtcctgatcagtgatcacagcacatgcatgctgctgccggccggcgaactgtcaactctcgatcgagggcgcccgccgctgatcccgccatagaaaatgacgaccgagctaacgaccgacgcgagagcccatcagctcgatcgatctgcctgcctgcctgcaggctggctggatcgatcaatcgatatatcggtacgtcggcaccaacccaacccaa

SEQ ID NO: 31974 - DNA, 388 bp, Oryza sativa
tatgctccggtcaagaacttcggcaaaacactgttctggagtcgccggcggcagctccttggctcttcggcacgacgaggacgaagacacaagccacaaagctggcctagcatcgttgcataaagtgcatttcatcttctcctgtcactctgctttggattagctggacttgatcacttacctatattctgatctaggtaaattttctgtaattttgttgtttaacttcaaattttgtttgaaaatttcgttgggaatttccgaaaaatttctcctttctgatatattaaaccctgcccatgattcctacaccacagtaatggtctttttagagtgctagattgcaataattagctgtagctcttcttagcaaatgccgaaatattct

SEQ ID NO: 31975 - DNA, 252 bp, Oryza sativa
cccggtctctgtatacagtacacaggttaatttatgtgtttgtgatttataaacatcgccttggattggatgcgattgacgcatgcagaaaagggcaggaacacacacacacacacacagagatcgatatcgggcgagcgatgtcgatcgagcaaggggtagtgggagaattttctagggtttgaagtggaggcgtaccttgttccgccgcctgcttcgatcgcccttcgccgaagacttgctcctccgccg

SEQ ID NO: 31976 - DNA, 1052 bp, Oryza sativa
gtcctcgttgtcacacgccttcatcagctgctcgtgccgaactgttcgattcaacataactgccagctggcgaacctaggttttgcactattcgtttatgatctggtctcagttataagttcttagattgaggttgcaattcttcttctggcgtgctaatatatcggttgattattgctcccgtgcttttgatctctttgtgggtaacttcatctatacttattcggtgccctggattgtcttcttcaaagaaaaaaatgcaactggggatgaaaagcacaaatttgatgacttacaggaatgccatatccagggatggtctacttaattgatataaagcaaggcaaagtaaacgaatgaacaaatgtatttgttttatcttttgtctttgtgttagaacttaactaggttccttggaattgtacctctgttgactattgattggcgtagtgacttccatatctctcagacagtgtcttgttatgacggcaatcgaagtttttttttttttctgtttcgtcaccttgcaccttcaatttcatcaatgttttgacgtttttggatatttgttgtagcttcagtgttagtcaagttcataggttctttttgtttaaggttaagtggttacctgtacttcacttttgtagcctagttacctttggacttctccataatgatgttctgcttttcatatatacacatgcagtcgtgtgtagtcagttttatctgtaactatctccaaaagagtccttctaaacatatcaaggaataagtttcaccaatttgccgagttgcttttgcgaccataatgcctactaatggtgactcactattacaattttattctctgtggtccagggttggaaagatgacagataatctaacaggtgattgctcaacaagctcaaagaaaaggaagaaagcttgcaaaagttgaggagagacaggtgagtaataggtttgattttcttaacatacttacacatcttcgtcataacaatcacaataatattgtgcaatgcttcctcatctaggaaagttgcatgtggata

SEQ ID NO: 31977 - DNA, 1501 bp, Oryza sativa
ctagagcagcatataaatactcatcacaaaagttcatatagcacgctgcattgtactacctccgtcccaaaataagtgcagtcgttgaaatccgtgtccaacgtttgaccgtccgtcttatttgaaaaatttatgaaaattttaaaaaaaattagtcacacataaagtactattcatgttttatcatctaataacaataaaaatagtaatcataaaaaattttcaaataagacgaacggtcaaaactgcgcttattttgggacagaggtagtactaggttaaatcgagataaagtattgggtgtggaacacatttttagtaaattaagtgtcaccggaaggactagcatggtacgggcatttggaccaaatttacaacattatggcgaaatggcatgtggcttagtggttacacgagcctaagtagcaccttaggttctaggtttgactttccatggaagcgattttttcaggatttaacagctttgtgctttcagtggtaagcgacgtacccgttgatagcgaggcgcatgtggtgatttcaatctccaggatggatcctgtggtgacttcgtcaatctccaggatagattggccggtcgagtcttcgaaaatgctcataggagtgagtgtgcgtgagttgagtgtctgcgttatactgtataattctcaaaatttataacattaagtaatgttctagtgtttagaaatgaagtaaattattttcatttgtgaatggttgcaaattatatgcacagtttataggctccatgttttctgaattcaactcatgtagcctattgactgattccacatggtattgagtattgactctttctgaggactatattgtgaaccattggatctaaaatgtgcgtcccggatctcctcgttacattttataaaacgtctccctcaccaaccaatgcacaaaaattttcctcctaatcccagctatagcaaggtaccaaactagataaaccttgggacaacttgataatttgcatatcaacttgatatatgttaaactgagtatttatctagtttgacaccttgctatagctaagattgggaggagagaataacttagattacggcagcggttggagaaacaatcggtgaattgagtcagccgtcgatagacggcctcacatcaaaagagcaacatagttggcagtattattttctgccagtgttgtttatctgttgcaatcgttgtccaatggtgtaaatttgatggcaagagaaaatgtgcgactctcatgtcaagattttagctcagctttactgaagatatagaacaatatgttattcatataaaatcggaaaatttatgttctttctgagaaaaaaggttgggaaaattccatcctgtctgtagcaaaagctatgtaagctccccccttcctttccttcttgaaagattaaacaactcttccttacagccgagctagcttatggtatcccgacggtaagcgcaataaccacggtgactgtcacaa

SEQ ID NO: 31978 - DNA, 1501 bp, Oryza sativa
gcgcgtgggcgcccatgcgaccgcgttgcttgccttgggcagttggcaccacagccgagcggacacgcgcgcggggggcggacggttacatgcgcgcgttaggtgaggtcggggccttgctgagtcggtgctgcgtgggatgtgaccaagacgtctgggcttggtttggtagggaaccttgaagttgaagaagcagtgcacagcacagcacagtcgtttttgcctctgcttcctccacatcgatcaatcacctgttcgccgtggatcccgtgcggccgctatctcggggaacaattctcgtgcacgccacagtgtgtgttcattcgagccataacgtctcggtgcaatgcacgaagaacgtagctatacaagtggccttgcaaagtacgagtaacctagcatcggctcggcgcagtggggcccctttcgtagctcccgacacaataccggcccctttttttcccggggatccggtgcgtgcaggaatgtgcaggcacatggggcgcttctcggaaagcggcagccggcgggcatggccatctggccgtctcgataccatagagaaatctcgaatctcgctttcgagcaatgaatataccacacctggccttcacatggaaggtggggctacctccaaaagctccatttctagccaggccgaatggccgagcggatgacgcggccactcacgaaacgagcagctgcaagcctgcaaccagcaggcagcaagaggagggtctacgccttctttacgcgaacgtggacctcgcctttctgatccaccggtgactcggccggcccggttgctgactccgcaaatccactgcgcgcctttgcgaaaaggatccaccaccccgccgcgacgcctatataggccgctctccgtggctgcactccggtaccaatccacttttccttccacgctaaggcaaacagcgcaacgcagcacacaacacaagcactagctgctcgatctcgtgaggctcgtagtaagcacactagctgcagatcgagcgaacagccatgaggaagtcaagcatcaacggcgtccatgtcatcggagtcccggtgaccgccaaggcgtttggcatagaggaggaggtgtcgttggccaggggccagtcgttcaggaaggccgacggcgatcaccttgcggtctcgttgtcgcaccccagcccttatacgtctttcggctataagcacagtaagtatatatattggtcacgatcacatcaaaaccgtcagatcaatttctgatgcacgcaagacatgtggtttctaatgtttatggtgatccttgtatctctgcaggcagcaagggtcaggttatccactgggtgagcaagctgagcagaagggcacagggcttcagggagcatggtgagttagcgttcatgcatgcatgtttaattcgccataaaaaaaaacttgttgatcattaggacttaagtgatgaacgccgtgtcctgatatatatccatcaccgtgtgtaacgtgcagt

SEQ ID NO: 31979 - DNA, 1501 bp, Oryza sativa
gggtggccggccggcggcgggatgggaggccggccggtgagtcgatttttttttgattttttttaatttgtggtttggatgttttgatctgtgaatgaatctatgaatcgatattgtgaatgaatctgtgatgttgtgaatgagtatgtgactcgatgttgtcaatgaacctttgaatcaatattgtgaatatatttgtgatgttgtgaatgaatatgtgaatggatattgtgaatgaatttgtggtgaatctgtgaatcgtgctgtggagttgtgatgtggatttggggtttgatttgatgatatgcataccactcgattcgggagaaaataaaaaagaaacaaggaccagctgatggactgccgctaccctctctttagtcccggttgatgacaccaaccgggactaaatatctttagtcccggttggtgtcatcaaccgggactaaagatcgatctttagtcccggttttttcacccgggactaaagatagcgatctttagtcccggattattagtcccggtttgaaaaccgggactataggggggttacgaaccgggactaaaaagcacttctccaccagtgtatattcaaaacagatgattgaaaaactcataaaatttgtaggaatgagtgtttgattaaacggtaggaaaaacataggaataaatttggattagagtaaattgggttggttatacactcttgtatacatctaacttacactaattgaatagacaagtggccatgagctaatagatttagttcgatcctgaatagttggaacaacttagcttaatggcctcaaaatgtgaagtttgggattatcctcgggtttccgtttttaagaatatgcttgtaactttcctatttactgctcggctattatcaatgagaaatgagataataactctattaataatcaccgttaggcattgagcttgagaaacctattctccatctatccctattttgtttgtcccaaaacacggagaaaaaagatatccataattatttttactttgctattttttttcgtggcttattagtagtagctcaagggctagtttgaggcttcgagggatgtgcagttgcgtatgaacgtgttgttttcatcgtcgtagcacctaatcagtaatcaaaggctttgggatatgactggttggtttggtttgttttgtggtctaaataagccttactaaattttgtcaatgttaaattttggtaagttttgacatgattaattttggtaagtctaatttaggcctcaaattaatccagccctacattgctttggtagttcactcgaaactggggcgttgtcccatgttactgatctactccctccatcctaaaaaagataaactatgggttttcgtgtccaattttgactgtccgtcttatatgaattttgtttataatttatatttttattattgttagatgataaaacatgattaatattttatacgtgacttgtctttttaatttttttaataa

SEQ ID NO: 31980 - DNA, 1501 bp, Oryza sativa
gcattactatatggcctatatatgtacgtgttgttaaactatcaaccaagcacgcgtccttatagctcaaataaaacaagggactatctatacaacattcgactaaaaattagcccaaaaatctgtcaaatgtaattgtaacataattacaatatattttttataattacactatatttatactataattacatatgtaattttcataattacactatatttgtactataattacatatataaactcgcatgtaattatagtataagtaagatgtaagtttaatctagatcataaaaatatagtagcccaatggggcagtcacgccttcatcccatgaggtcacatgatcgattcctaaatatgattttgtttttcttcctaaaagtacatatcttgatgcgtattaaactgttagtatgaatttaggacacatccaacggtttagaaagtgaaagatttagccataaaaatatgtcaacaaatatttagcaattccgataaaacaataacctaagttggtggaatctagcttcctgtgtcaatgagaactagagagcacgagggggtcgatgcccttccctcctgatttggcgagtcgttactaaactaggataaacttgtaccaaaacaagctggtgccaactaatccctcttttgactattacgacctccctaatcaagtaaccggtctacacagaaaagagcaagagcttttgccgcattggatatcttgtatatctaggctcctgtttgtgttcctaaaaggagcttcacgcatataattgggagcaacgagatgcctcgatcatgtgctaacccgccctgatgatgatcgatatatcgccaggccgccagctgccgatgcaaccgcgcacccacaaatcgcaattccaggatagtcagtttgtttcgattgggccctcgcatgcacgatcaccttcacacacgagcgcacgtccaatccggacccggcctcatgcttcaagtgcaactgatgaatggatctgcactctcatccgttcatagctaatcagccaacaaaagatttaacacttaattataaagttgattttaggattaggttgtttttatcgtagtctacttttcagcgtatacttatatggtacctttgaaacgtaagactaagaaaatacaggaatatgaaaaataaaggagtattatacgaatatatcactggtggagaaaccatctttggtcggtcgcccgaaatccacaatagtctcggttccactaaaaaccgggactaaagatgatctttagtcccggttggtggctacagcgggcatatttgatctttagtctcggttggtgtaccaaccgggactaaaaatgatctttagtcccggttctaaatctgtcaggccttgtcaggccccccgatatctttagtcccggttgataacaccaactgggactaaagataggatctttagtcccggttggtcaactgggactaaagatcccagggatctttactcc

SEQ ID NO: 31981 - DNA, 1501 bp, Oryza sativa
tggcccaacactacttgtgctcacacgtcggcacggcccggccccatggagataggccactgtcagaaagcccgcatgttgtctcgatgtgatttgacgctagttcctttgactaaatgtctaataaattaaaattcgattcatatgatccttctagaatgatcgatccttcgaagacagtgctggggcacaaatgcatgcacgagcgtaccaccaacagccacacgccattgttaagctatgcgtgacttgagacttaattaaccacgactgttattattattatttttagtctaaggagagagaagctttattaatatctgaacaatggattacatttatgatctaacaagtctaaaatttttacgggagcacaaaacctccactctccataaatctagtactcattaccattttaaccacgactattattatgactctagcaaggtgataaatagcattcgtagcggctgctatagcggtaacgaacctctactgctaccgctacaaggtagtggactttatctagcgtattgaaacttagtgtctgctatagcgcttcacgaccttaatagcaacccattattaactttgttgaatcactatatataatgctaaacagtgttattcacatatggataaaataatttagcactgtgtgccttctttttcttatatatttatatgctatttcataatatttatgttattaaatgtagaagtaattaagcatgcagtttacattttaatttttaagtgaaacttgatgctaatattgatatacaatataaatttatggttatttttcttaatttcgttattggaacttaggtccacaataatacctactaacctgctatacgctatttattagatttcaccttgcactctagctactctcgctcgatcgggtgtagatgcgatgccgtactgtagaagcgcacggtaacgactgtctttaagtatatatatatactacatgatggagtagtatatggcggtcttaattactctggtaagcacacgtatattgggtagggactgtttcgcacacatgagtactactagtatgatttaagccactgaaggccattttggtttgatgccaaaacgtgccctaccaaattattggcattttgaatagtagtttggctagtgtttaatttgctaccaaaatataccaataagacacataagttgtcaaagtatttggtactaccaaaatttacctatgatttggcattgtcaatattttggtatggtaagggggtgttcccctctctcccaaacacccctaacaaaccaaacaagccactgaattttgattggaccgctccgatctaaccctgatgatgctgacaactctctgggcatgtctggctagcttgttgttaccttcaaccatagcgatccaaagtttcaaacattataccatctcaatcacatagtactaatctttttcacatgaatacatgatcactccgtacaaaaaattcggtag

SEQ ID NO: 31982 - DNA, 1501 bp, Oryza sativa
ggcgcagactccagctcgcccacagatgaacgtggcgatcctgcacaaatcccccaaaccccaccgagtcaccaccttaccaaaccaaaccaaatcaaaacgctgctgcgcccgacgaagcggctgaggaacgcgcagattactcggcccccatggatgcggcgtcgcaggcggccacgatctccgcgcacgtggcgaggtccgcgcggtcgccggtgaccaggtaggccctgaagagcaggagcgccgtgccgagcgcgccggtgtagagggtgaagtcgcccactgcctcccccgctgccgcggcggcgcgccgcctcttatcccacgtctcgtgcaccacctgatcgacgaggagcacaccagaatatcaatcactcaatcagcgcatgaggtgacgaactagcgatacggtggtggacgagttaaccttctgcttcaggtgaagcgccgcgtggaggaagcgatcggcgaggtcggggtaggggagggagaggaggtggtggagagaggaggagtaggtggaggggatcgccgccgccgccgctgccgccggtggcggcggcgcgccttcgtcggcatagcccggcatattgttggggaagaagcgatcagccatgccggatacccctggaatcgctggatttcttctcagatttctccgggaggagagaggacgggaatggtggtaaggcgccggaacccggcgagaacggcggcgagcggcggagggaggagggctcagtagatcactgatgaatggcctttggtgaacgcaaccgaccagtgacgtgtgggccagagcgttggtactttctcctaaaaaccctcggacattgtttaatcccccggttggccacttttgtctctactgagtactgaccgtccgatggacgttccacggtccagataaaaagggttgattgcttcttattttgtcgtaaaagctctttgacagatatggctgtgtttagtttccttgaaactttcaaaaatttcgtcacatcaaatgtttggacatatgtatgaagcattaaatatgaacgaagaaaaaaccaattgcacagtttgtatgtaaattgcgagacgaatcttttgagcctaattacatcataatttgacaatgtggtattacaataaacatttgctaatggcggattaattaggcttaataaattcgtctcgcagtttacaggcgaaatctgcagatgtcatataatcaaaactagtaaaatggcccgcgtagattgcgcggctagcatctctataaaatatccacgtacaataacatactacctacgtttttcaatagatgataccgttgactttttcttacatgtttgaccattcgtcttattcaaaaaatttacataattataatttattttgttatgagttgatttatcactcatagtattttaagtgtgatttatatcttatacatttacataaattttttgaataagacgaatggtcaaacatgtgagaaaaagtcaacggc

SEQ ID NO: 31983 - DNA, 264 bp, Oryza sativa
tgtcacatgaacatgggccatactaccatagataacatattgctttgtttagatggatgaactttcaagtgagtaaagagacatacttgggactaacattttttttctataaaacagtgcaaccgatcaaacgtaaaattgttattgcatactgtaataaaacagcagtaaaatttctatggttcagtgttgtttgatatgtggcttcttatttagaaacagcaatttcatttcttaggagctcaagccaagtcctgataatta

SEQ ID NO: 31984 - DNA, 1501 bp, Oryza sativa
ttgcttttcataggtatcacatctctccgctgttacctaaccccttgaacaaagcccattctttcaaagataaatggttgaacaatgaattgttctaacctaaacaggacaaactcacaattcatgcaaaattagaaaatccatgtaaaactattcaaatttgtacaaaaaaataaaaccatatatgacaacaaaaatgcagttaaatccacttttctcctttagaggggattgaatttcaggtggagatataagtttcggcagctaacgtggatttggtatttcagatttggcattaggtgcattatattccaccatgcatcttttgtacacacaactttttttattcaaactgatgctttaaattcagataacttgttgtttgttagtcaatatgctaccggcccgtttgatttagattatttatacggattatctatttgattatagggataaattaatttttttaaaaaaatgttaatatttttaaaaagaagttatgtaaataataaagaagaaaagaattttgagcaaccatatttttaaagtgtggagcaaataatctatttcaataatccgatgaataaattaagaagggcagcataaactatcaagtttattcagtcgtcgcaaattaccttgttcaaacgaacatttaaactcaaccttttagcagcgtcggagctagctcccgagctggtcgggtagtcgtccgagctccgcggttggcattttcgttatattctaacattaataccacacataaaatattattgattgctagctactccatctatttcaggttataagtcattttaactctgattaaagtcaaactaatttaagtttgacaaaatttatagactaatatagtaatatttacaatactaaattagttttatcaaatcagttatcgaatatattttcatataaatttgtcttaggttaaaaatgttactatttttttctacaaacttaaccaaacttaaagcagacttataacctaaaacggaacggcggaacgagtaatactcttcgtagttcaggcatcagagtaaatacttgcaagttcgattacctgcacaaacattcagcctaaatggtaaatgcctcagtatgaattgttttttatttttaattgagttaaagtgggtcaatggtagactctcctccatgcatcgagacctttttacctgtctcggtcgtatccatttcttccttgtgcaagatcctttgcgaacttcaatttcattagtttttccctaacttacaacagaagttcagaataatatgaatcaccactgcctttgttcatcttgcaaagccacaaaaggatcccttggtataagcaagcaccttcagttacctcatccaagaaattaaatgttctttccttgcagagaccacacacacacacacacacacacagatatatatatatatatatatatatatatatatatatatatatcccctatctgattcgtgttcatcacacata

SEQ ID NO: 31985 - DNA, 1501 bp, Oryza sativa
tgtttacgtatgagtccctagtcaactatgaaaaatgcttagaaatgctattctagaatcatgcatactcatatttgtcaaatgctatatgcttgggcaattatctttgggaaggtaattgagatgcggcatgtggagacatgagcgccacattgccatgatattgaggacatgatttgtgaaaggagaaataaactaaataactgttttcgactggggcggacggaggatttgggtggtatctggaaaaggctagtaccgtccccggtcaattaaggaccgagccatgaagttaagcatgaaacgaccctcgtacaaccgtacttctcgtatgggtatagacctagcggagtagatagccgagcggaggcagtatccctgcatagatggttcacccctgagtgaggcaggtgcgctacggtgggatagccgttgaggtagggccgagaggcgtgccctacatcggtgtcgccattggtaggactgccatgagtgtgtgagagagagaacttaacttgagccataatttaatatgtgtgtgagacttctctttcccgggagcgccagaactcctctcactgctagaaacatggacgcctagagtgcatgagaatttaagttcatggagcgggtactgccaatgcgaggttatcaaaaggctttgccgtggcgcgtctcatgtgttgggacgaggctcatgtgttgggcagtcgcggagtgcgggtaaagtgtacatccactgcagtgtgagtaaaaccaaatctattcgaatagccatgctcgcggttattgagcaccgggacatgtattacacttggctagactctaaatcctttaacttgtgtgggatgggatattgcatgatgatttttatgctgatggagccacttcctgagaggcgggaatgtggacgtcctgagaaaaccataacgactcaatggtgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcatcattgctgtggtgtcttgctgagtacggttggtactcacccttgcaaatataaaattaatcaaaagcgggagatgaagcttcggaggatccctatgcctactactaggagggagatgaagacgatggcactcagtaggtcttagttacggtcgttgcctgtggcaatggcgtgccgctgctttaactccgctgccttacctacttctgtttttggaatgtattccgaaccgctcggtccgatgatttaagactgtgcctgcgggcttatgatgtaataattcgtactagactctcgtgtatgtgcacttgatatttcagctatgagttcgtgcgtaccagactacttgatctagggaaatgatactgtttacacgattgatt

SEQ ID NO: 31986 - DNA, 1501 bp, Oryza sativa
acatggccgtccaatcattgaacacaccctgcgaccatatcacgtttgctgtatgaaagtcacataaggttgtgcatgctacaatattcctatctagaggttggcatttggtcttaaccaaaaaattggtccggcgacttcattctttaaaattttcggtcttcagaaaatgagaaaccgaacttgtaaaataaaacaactaaccaatagtttaattaaatcgatagtttggtctttcgtttgactaacctacctaaatttgttacaccggacgatatattatcacaggcaaggtacaaaagcacaacagcgacaatggtgaggtgcaataggtggtggcgcaataaaagaaggaacctcggtagcacaccataacaagcgacgagacgtagcagcagacgacacgccacggaaataggtggggttgcagtgtagcatggtggcgatatagcttgagctagggagggtactgagccatcacatctagggtttaggagtagtcatatatctgtgggtggcccttgaggtggtaggctatcaagccagcggttaaatttgggctaaaattaggtattttggttaaaattaggtatacgaccaatcgacctgaaaaatgattggtcacaaaaaccaatgttttgatcgatgactgatcttttgtatacttcggattctatctaccttttgttggtttttttctcgcccatatcactttgtgcgttaaacccaatacttgaccgcccaaattattataagacggtaagctgaaacgcactacatcaataaatcttaaaatgagatagttacactatctattaacttattaaagtaattcaaaaaggagcctccacgtttactcgcatgacctagaaattctcacattaatcgggaaaaaaagaaaagtagagtccataaagaaatacaattttaaaataataaaaacttgaaactaaaaaaaatataggaagaggagactagagtccatacaagtatacaatttagaaataattgaaatttggaattaaaaaaaagaaaactaaattagaagtcagagtcccacaatttaaaaatatctaaaattgaaataaaaaataagaaatatttgaagaagattctatagcccatatagaatataatttagaaaagctgaaattagtagttaaaaataaagaatattaaaatatgagcttagagtccatgtagaaatacaattagaaacaatggagattcggaattaaaaaataggaatattgaaagaaaagtctagagtatgtgtaggaatttagaacaaattgaaagtcgaaattaagaaaaacaaatagagtttagagtccaagtagaaatacattttagaaataactaaaattcaaaattagaaaataagtaatattgggagaagagactagagtccaattaagcatataatttattttggaattaaaaaaattaatattggaaaaaaacttagagtctacatcggaatacaatttataataatgga

SEQ ID NO: 31987 - DNA, 1501 bp, Oryza sativa
tatattcgtactggtttctcatgtggaaccatagaaggaattcaatataaggaaatgagacgactctttcttgaacaatttcataagcagatcttcccctccacaccaatcacgagtttttttttattcctctcgtatatcgtcgtcacgcccttaatgataggttttgaaaaagtggttattttggccgattaatcttccaatatgctagttttaaaaactctcgttctttacacttcttcttggctgcttggcctgtagtagggatttggttcactgctttaggtattagtactatggctttcaatctaaaatatctgagaaagcaaagaaaaaaaaagagagacaggtggtttatttatcaccaaatagagatgagtattatatgatagcagcaggaaattctttgatggatcaatttctgtaggtgggtctcaactcggatcgagacattcggatttgccgatgaagagtactgccttggaggggtaggggttgtaggggaagaaccaaccttttcgggttacgggaagtcctatcgagcgactggattaaagcaagaagaaaaaagtcaaaacagcatccgttcctcgcgtatagagctagaaattcttgaattagatccatcctaacattggatgtcctttcttccattaggaagagcctcagccgcttcaagcaagtcatctcaagtttgaaattctagagaatagctccgatcaacccattttagtttggttctgcaattcattcgcataaatgaaaaaaaaagcgagatgtgcacgaaagaagatcatagttcagctttaaaatggtggtgtccctgtgttagtaagtggttgaaatagctcatgggagtgtctgccccattcgataatggagtcaactgagcatctcagcggtgggattgaatacccggatcgaatcagagttcacgccgttcgtgcgggaacgtccactttgcattttaaagaaagggggctatggatggcgagagaagccctcatacccactcttctctcccctccccataccctgttgttagggagagttagcggtgtttacaccggtgtcacgtgtacggggatacgtgtattgagaaaaaagacccagaaggcctgttttcgaagctagagcataggtttagtgaggtttaggtactttgaccgaagtaccagtaccgaagaaagcaaaagctttcgagcgagcagcaactccaatgtttggtaaagggaatgaccctagatactcagtggtcgcaacaacaacaaggcctttggtcatatcatatctcggcgcctcccttgacatgttataatgcatctataatttaaagattagtgtcccaaaccctggtccacctgaattccattgtgtgatcagaatatgcaaacttgagaagtggaaccgctaccaatcccagctctggtttctgaagtgccagcagcataaaactgtgaacaggttggatgtgccatctagccgattgcctattgcattt

SEQ ID NO: 31988 - DNA, 1501 bp, Oryza sativa
attgtgattctgaagaccgaattttccaaaagattgaggaactgaaccgaatttctcggttattctgaatgcccacccctacccttggactcgtggtaagaacgcattgaccagctcaatggtgattgcaacgaagggcgatggaaatgatgagggtgaccttgtgatatttaggctttccccctccggtcacaaataagtgacgatttggaatgtgtgcggtaaacatggttaaatttgaatcattattctctttaaatatttcgatctaacttttgaaagtgatatggttagatttatcttaaaaatagtttcaaaatattataactttcccatagtagctcttataaaatactactccgtatattggtaaccatatcatgatccacactgtctcatacatttgtgactggaaggagtacttgttcagtgcaaatagaccacactatctcacattatatttcgagtgttgtggatatatatatttatatctattggaggtgtaggagtaaccgcaccattcaaataaagagataaataaactcaaaatttatataaccaattaatcaaacaaaatcttctaccagaaatatcttgtaaggctgagctcttttctccaccttttcaactcatttatctaattttctacgcacgcttttcaagctgctaaacagtgtattttttaaaaaaatatacaaaaattattttaaacaatcatattagtcctatttttttacaaaataaataatatttaattaattactccctccatatacttttgatagtcatatttccaaatctgaaaaatttatttttgataggcatatttcaatccaacaacctatcctcttaatatctttctcggatttaatacgtgactctccattcttccacacaagattggctatatgggcatcgagaaatgtaaatattaatgaatcgcttgtttacgaggaatgactagcatgtttaaatggatgataagtataattacttatcgttggtctgtgtgccaagataaaatataagtatcaaaagtagatggagaaagtagttaatgcatacactgttttgcgtgtgggagagaggcctcccaaacactcagcctaaccttcgcatgggagtcccctaaccctaaacagtagcccaggctcaaaatctaatacagcaaccaaaaatatattttacatcctccagtctaaccaaactcagccgaattttgaccgaatattgcataccagctagaaactgtttggaaatagggaagaaaccatcagtttatactttaaaaaaatttatgacagttggcacatagctaaccaccttctttaaacaaaacatctgcttaagcttgccgtaaaaaacaatctttgggccaagtttaaaaaaatttaaacgcctagtctgtggtttgacacatacattggtgtgcactgcaagtcttgactcctgcagctaagctaagcaccatcactgtaaaaacaaaaaagaaaaaaaagaa

SEQ ID NO: 31989 - DNA, 1501 bp, Oryza sativa
gctaagttacctgcgacatgacgtacggatgaacgttatatttaacaaatcttggggtgtgtttggaagcgagggttacgaagcagcagggttacgaagcagtttagtgcatgattaattaagtattaactaaaataaattaaaaaaatgaattaataagatttttagagtaacttttatataattttttttaaaaaatacaccgtttagtagtttgaaaagagtgcgtgtggaaaacaagagatgtggggtgagaaagtaaagataagaactcagcttttcagttccctacgggataagtttctcatgcactacttgacccccaacagctccactagcgcaagtgcttgcacttgtcatcgcaacaaaaaaaaaatcaacaaaacagctacggtacaaattatgttgcacttgtaaaagcgatcaattaataaaaactaatctcctaataagtacagatacacatataaaaatcgctttattataattaaagatagtatcttgtcttcttctctttgatatgtaagggcaaatggacaatcacaaatgaaaaaaacataacgcgaatattaggaagtaacctaatattaaataaatagaagaggctagacttcgaactcagccaactaagcccatcgtcaccttgttgagcagtcaggaatccctggcatttctcgggcaatcacaaatgagctctcgatcgatctccttttctatctgtctgcttctgcaagcaactcgatcgatctatatatctagccagattattcctagcttgagtgtttcgcaactgcatatgctaggtccccggccgatagatcgatagaaagcctcctgcatgcaggccagttggtcgcatgcgtaatagctttaggacctgttccttcctgttctataattcttagcgttttagataaaattaaggctaaactattataaattatctagcttaaaaggcaaaatataaatatatagatttatctcacaaagtatactatgataaaattaaaattgtatttatttattgtatatattttgtaataaaaagctatagttatagatatattttagagatggtgtcattattcaaaacgttaaaaattacgaacggaggtagtaggagtacttgggtacttttgacaactatagctacttaaaaatcgctagctcctttaaaagatataaattttgtttcgatttggacacttagtaactacttcatatgtcccaaaatataagtaattttagagggatgtgaggcatcataatactacaaggccgagtttagtttcaaactttcaacttttccatcacatcaaaactttcctacacacacaaactttcaacttttccgtcacatcgttccaatttcaaccaaactttcaattttggcatcgttccaatttcaaccaaactttcaattttggcataaactaaacacaccccaaatttaaataacatatatatttctccaaaatcctttatattataggacagttgg

SEQ ID NO: 31990 - DNA, 1501 bp, Oryza sativa
tcgctctctccaaatctgggcgaagccacttgtggcggtgctcgagccaagaggcaccaccactccagtagaaacggccctggtgtatccctggcgggcaggtttaggcatagttgtgtacaaccggtggtagagctctattacggttgcctcgacacagttctacgctgatggttgaggcaacaactagtcttcgtttgttacggcgccgaaactagcgaagcaggaggatccgtgggtggtgatcgatgcagctatcctgaaggtggtagcggtgaccgagaaggaaagggccaccatccctgccaattctacgttctaccttaccttcgtcaatccttggtgtgactccctcctcaccatgtgcatgtcttggtccccagtcgctgtcatctttccaccatcgccgctggtcagtgtttccactagcgctatccatgtcggtcatccattaaagcaaagagataggggcattagatttgttgtgatggcatgattttaattacatgaataataatagtagaatttaaaattgtaaaatttatagtgacatgaattcaattaacccttaattcttcccatagcagcaacatttgttgtagccgtcaaaggaataagttcactttaggtccctcgtcttggtggcgagtttgaattacatcctcgaacaacaatactagatataacgcatctctcaacttataaaaccgatgtactcgaggtcccagtcaatatagtgcctgattttgaaatccccgccctgccccgcaatttgagcatctccttcccatcccccaacatcctcttatcggcggtgaggaaagccaaatcaagatagggagaactatcacaccctaaaaatctccaaattataaattgttgttaaattggaattattagaatttattttaaaaagcctagaagagaagatctaattttaataaataaattccaatataaaatggggccagataaaattttattaaatactttgcttaattctataattcctagatttttctgggatttatttgagctaaagaagtatttttaataaatggaattgcagttaatgaataatttaaattgaaaaaagttcttaaaatcctctttaggctttgggccgaaagtcggcccaaaccgttctctctctccctcggcccaatcggcccagtcagccgcccgcgcgcgcgcgttcgcccgctgacaggtggggccggcccgtcgtcttcctcccggcgaaaccctagccgcgccccgccgccgccattccaatccggccgatcctttccgtttccgatgaaatcaatagaggggaaatgatcttctcgatctcctctatcttttctcttttggaatcatcggctaaaatcgtttggaaattcgtggattcaaggttgaatcggatcggtctctctcctccgaaccctagactttccttctcgtcgccggtcgccgtgggcctccgtcgccgcctcctagccgctataaattgaccccc

SEQ ID NO: 31991 - DNA, 1501 bp, Oryza sativa
ctagctcttctattagctttatattaatactatcaagtaaaaattctcacgtaaattagctaaaaaactagcttatgagattggatcttaaccctataccaatgtgacaagagttcgtaaagtccaaactgtgagcaacattaacaaaataaaatataaaaatacccagtaacatagtaatattgataacgatagtacatttttaatttaagtttataaactattatgaatatacaatacaatatgccatctttagtaggtggaagaatgtcattcgaggtagtggaaagatgcaactttatgatttcaatacatatgtaggggaataagacaaacgaatgtaccataggatttatgcatctttgatttattgtattgttatgagaatactaaaaattccatcgtgtttgttttatggacatgggaattactatattaagcatttgtcattttaaagactttttcacaatagtttggtcaagttaggtcaaatctcaaaatcatttgtcattttaattttttttcacaatagaatgtgaagtatatactccctccgtttttttaatagatgacgccgttgactttttctcacatgtttgaccattcgtcttattcaaaaaatttatgtaaatgtataagatataaatcacacttaaaatactatgagtgataaatcaactcataacaaaataaattataattatgtaaattttttgaataagacgaatggtcaaacatgtaagaaaaagtcaacggtatcatctattgaaaaacgtaggtagtatgttattgtacgtggatattttatagagatgctagccgcgcaatctacgcgggccattttactagttttgattatatgacatctgcagatttcgcctgtaaactgcgagacgaatttattaagcctaattaatccgccattagcaaatgtttattgtaataccacattgtcaaattatgatgtaattaggctcaaaagattcgtctcgcaatttacatacaaactgtgcaattggttttttcttcgttcatatttaatgcttcatacatatgtccaaacatttgatgtgacgaaatttttgaaagtttcaaggaaactaaacacagccatatctgtcaaagagcttttacgacaaaataagaagcaatcaaccctttttatctggaccgtggaacgtccatcggacggtcagtactcagtagagacaaaagtggccaaccgggggattaaacaatgtccgagggtttttaggagaaagtaccaacgctctggcccacacgtcactggtcggttgcgttcaccaaaggccattcatcagtgatctactgagccctcctccctccgccgctcgccgccgttctcgccgggttccggcgccttaccaccattcccgtcctctctcctcccggagaaatctgagaagaaatccagcgattccaggggtatccggcatggctgatcgcttcttccccaacaatatgccgggctatgccgacg

SEQ ID NO: 31992 - DNA, 1501 bp, Oryza sativa
caattggtaaaaagatgatgcaaaaagctattcctgagactgaatgccattttccttttctaacatcagcaacaaaacccctcaaggacaagacaatttttaagaatgcaaaaccattcggaacatgcaagctagccactaagttaaacaccaggattttgaatcttgattcttctacagttttacctatgtcataattgaaaagacaatgatgaaagcatagtaacataccagcatgaaagcgagaaatagtgggatgctccaatacaaaatcgcaaagatcaattcgaccaaacatgtaagctcctttcctggacctgtcacatgtaacaccaaacatgaatataaaagcagacacattcatgccattttcaatccataaccccgagcgctaaccaaaatatgaggctacgagcaaagaggtagtggcaattgttctatagacaatagacaatcatgctaagggtgaagagagacagcaactgacacgtcaagcttgtcaacgatggtgccgtccttgagaacctcgaggaagaaggggtggcccggtgcggcgctccactcgggtatggcgtacggggcacgcggcctcggctgctgctgctgtgatggcggcggcgccgccgcctccgccatctcaatatccctggagcccctacctaagttccccgccgcctcatccgcctcggaatcgctagcgctagtgcccccttcggccgacgcgtccgccccctccacctccggctgcggcggcgccgcgggccgtggcggcggaggcggaggcatagaggagctagtgctcgcaccctccaccgggagtggaggcggaggcggcggcatggaggagttagggttagtggattcgggcttggacgccggctccaacttgggcggtggcggggggggcggcatggaggcggaggaggggttagggtttcgaggtggaggcggaggcatggaggggtccatgggagtgtgagtgcgaggtggaagcgaagcggggagacgagagagagagagaggattcgacggcgaggttgggagaggtggtggtcggcacggtgaggcggaggcggctcggcgacggcgacaagggggaagaaggcggcgagagcgcggccaagtcggcggggcgttggctaagcggtgcgggttgggcaatctacgccgtccatctcccaaccagcggtccggaatcaagattaacggctcatcttttcgcttaaagcttatgagtcaaattttgtattttcaattttaaattcggagttgattttgggatttttttttattgtagtatatttttggtctttgctcttatatcgttaagaatacgtatataaaagttttattcgcaaactatttttcatttgcaaatacgttatcgaggggtgaccctctctagcgggtgatcgagagatccccttttatgagttcgaccgggggaaagggcgcgctgatcaagatcatgtatcagcctagagttttctgagaccacgcg

SEQ ID NO: 31993 - DNA, 1501 bp, Oryza sativa
aaaaatcttaatcttaagtggcatcttaagcttctaaataatcttgtttctctcaatataaccattattaattaaagctagatacatcgacctaacagaaaatattccattctgatgatattttagctaataaacgaaatatcatatttgcaaacgaaaacagtggttccgcctaccacgacttctgtttaaggttttggagtagcagtacatgagcaatattccaaatttaaaacataagatgccattctatttaaggtaacgagatgatccgtcgtagtagagtgtacaaggactacggatgtctcaagacacatcctaagttaggccgtgtttagtttgtgtgctaaaatttttataagtatagggacacacatttaaaatattaaatgtagactaataataaaacaaattacagattccgtatgtaaactgcaagatgaatttattaaacctaattaatctatcattagcaaatgtttactgtagcaccacattgttaaatcatagtgtaattagactcaaaagatttatctcctaatttacatataaactgtgcaattagcttttttcttcatatttaatgttttatatatatgttaaatatttgatgtaatgaaatttttaaaaattcgaaggaaactgcaacattgccttagctagctggagtagtatttggagaagaacgagaacgacagaagtacagaaccaagcgaccggccattccctccctacagtggaggctgtctgttttgcatggctcaacgcgcatctccacagtgctacggagcatacgctatagtatagcctataggcaacggatggtcctatgcaaaaaagaaatgcgtagtctggatctggccaagtgtccaaaaaataacaatgcatctatccgtcacatgcggagaaagctgtcgcgtacattggaggccatcaagctatacaaccagttaggggtgtctagatagatacatataaagttttggcgtgtcacatcggatattatataaattattatatgaggtgttcggacactaataaaaaaactaattacagaatccgtcagtaaactgtaagacaaatttattaaacctaattaatctatcattagcaaatatttattgtagcaccacattgtcaaattatggagcaattaggtttaaaagatttgtctcgcaaattagtcgtaatctgtataattagttattttttcagtctatatttaatactttatatatgtgttcaaatatttgatgtgacatgatgtaaaatttttatgtgcgatctaaacaggacctaaaattttagcataataccatatcaaatcaatgtgtttttgctgagaccagcacttttcctacagtaagtttccccgcggagtaatcaataaactcccggtgcctaatgccctaatctcatagtggggcccatatggcagcgccctgcactgacgtactgacagctcccagtgccccgaactctcgcaaactgccgccgtctc

SEQ ID NO: 31994 - DNA, 1501 bp, Oryza sativa
agcataaaaatcatcatgcaatatcccatcccacacaagttaaaggatttagagtctagccaagtgtaatacatgtcccggtgctcaataaccgcgagcatggctattcgaatagatttggttttactcacactgcagtggatgtacactttacccgcactccgcgactgcccaacacatgagcctcgtcccaacacatgagacgcgccacggcaaagccttttgataacctcgcattggcagtacccgctccatgaacttaaattctcatgcactctaggcgtccatgtttctagcagtgagaggagttctggcgctcccgggaaagagaagtctcacacacatattaaattatggctcaagttaagttctctctctcacacactcatggcagtcctaccaatggcgacaccgatgtagggcacgcctctcggccctacctcaacggctatcccaccgtagcgcacctgcctcactcaggggtgaaccatctatgcagggatactgcctccgctcggctatctactccgctaggtctatacccatacgagaagtacggttgtacgagggtcgtttcatgcttaacttcatggctcggtccttaattgaccggggacggtactagccttttccagataccacccaaatcctccgtccgccccagtcgaaaacagttatttagtttatttctcctttcacaaatcatgtcctcaatatcatggcaatgtggcgctcatgtctccacatgccgcatctcaattaccttcccaaagataattgcccaagcatatagcatttgacaaatatgagtatgcatgattctagaatagcatttctaagcatttttcatagttgactagggactcatacgtaaacatggttacgaaggaataaggggcaaacaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttggccttcacttggatccgcaactccctcgggctctatagttacgtgcgaaaattgatttgaattcggttagaattcaaataaaaatccaaataaatccaaatggaagtcgaacgcgtaagtcgattcttttatattaactttactattcgcgaactagggcaaacccaatttcgatttttatatcctaaactattttgcgggtataaatattttgttatcataagtttttaatttaatctacccgagcattatatccatataataggttggaaatttctatcgcaagctaaatatcggacggaatcctaaaattatcttataatattatacgatttaatttttgtctaggactaaacgactaaatataatatacgtctaaaatttctagtgattaaatccgaatttctaacgtgaatcaattacttatagagattacccaaaataatctataatag

SEQ ID NO: 31995 - DNA, 1501 bp, Oryza sativa
cgataagttaattcctgtggatgtctacttgccgggctgcccacctaaaccggaggcggttatagatgccctaacaaaacttcataagaagatatcgcgagaaatagttgaggatcgaactcctttcttttctatttcttctattggctggtctggggaaagcggatcacacgaagatctatagtgtttaagtccatctttctcttcctgcaatctactgagatatgcctcagctgcaggtgctttgtatctctggtcaagagttggcaagggatacttaacccatgccatccctttcaaccttggaaagtgttatcctagaatctatcattctccaaaaatccctaaaggccccccgggcttgacaagttcagcaaaaccgtagagaaagcaggttacacctagcttagcctatccaatatccgattcaaaaagagcttggattgctgcctcccgggggacaaagcaaagtcaaagcgcttgatcctttgccccatacttttagatcttcctccccaacaagcaacgggttgagcccggaagaagcagggattgaaccagggcttgttgacagagcagatatcaaaagcctatgttatctcattttcagggaccgagcaagggatgagcgccctctgatctaacgaccaaacaagcaactgcctcaggttttgaataaatcactgatggacggaagggagcgggggccagctcccttcctatgaaagacccgagcttactgggatgatacccctttacatactaatgggtgtaaacaaatagtacgcccctctactaaagtgggttggaaagcctgtatgcctaatctatgcagggtaggtgcgccgctacttatttctttctcactcactacttttttctattttcttttgtctatcgaaacagcctaggattcaatttgatttatcctagtggtgacagcttatgcttgtccttggaaccgggcgcggccctctttccgctattatgagcgggttttgggttagccagagcgggccaatagggataaacaaagtatggaagtagttgtgaggtaatcagatggctcaagataagttggagacgtacttgagatagataatttatgtatttcgctatttcgaatacctaaactcaagcggtgctaatttgctaatccaagccttatcaataataccaacacgccgtctgatccaagattagcaacctctctttctctcatagagggaacctcactgacgcattcagggctctgcagttgaagcgttccttcggaatacaccacaaatacactggtggatgtactgatggacacgacgagtacttcttctggggggccttccgtgaatcagtcggcgcgtgttagcgcattcggaaccacacatttttatacgattttcggatcatttgattttcgttttgaaaactttaaaaccttatcagagaggggccaccccaacatgatcaataggctgatggccttaccaaaccgctctgctct

SEQ ID NO: 31996 - DNA, 1501 bp, Oryza sativa
gttcctataagtttaaaagctaatgctagaaaataaattacgatgaaaaaccttaaagtaaactctgaaactaagttttaaaattcaaattttgattgcgtcagataaaccaacaagcaaatgatggagcattttgtttttgaatgctataagtaaattgaggttgtgtttttctcccaatgggttgggagaaaagatatctcattctcaacacgcatgccttctgaactaaagtaaattgaggttgtgtttttctcccaatgggttgggagaaaagatatctcattctcaacacgcacgccttctgaactatttgacagtacgttggttgcaaaaaattctctataggaaagttgctttaaaaattatattaatatatttttaagtttaaaataataaatagtcaactaattatgtactaatagctcacttggttttacgtatcttatcaatcttcttttcccccttctctcacagcctcatcggttgcccatattatctaatataagttgtttattagggaataaaaaataatatataggtaaaacttttgtatatgtgttcttagcgacttaaaagccaatataaaaaaactgcgtcaaaattgtcttaaaattaacttcaaatttaagtttaaaattttaaattttgactttatctttgattaataattaggtcaacagtcgaaacccctcaattctccaacacaattaggtcaacagacgaaacccctcaattctccaacacaacctgagactattgggctttatttccattatgtgacagagccaactgaaaggcccaaaaccaacagcttggcccattttcaagacagcccaacaggcctctcgcaatttccgttgaaagtagtagtaacgttcgttttcgcatcttcttttttcttaacacagtttttttttctttttttttaaaaaaaaacatgctcttgttggtgaattgaatcggttgtctctgctgcagggtgtaactcaggtaggatagtaaagccttttcaagttggctattcttttaggtttgaagtttctgttttcctttgctgcaaaaaaataaatacaaaagtctacaatggctcacagctggtcagaaaattagaccaacataatgaaaacgcatgacctgttctgatcaacagcagcacatagaaatattcttcttcttcttaattttccagccaaaaaataacctaaataataccctggaatcaatctacatacgtgcaagcactttgctgctttcaaaaaaatattataattttctttatgtacgtatgggttagctgcggcaaaccttgaatcagtacttcaacagattttttttttttgaaaattttattatatatgaaattgacgtgaaacaattcaaactctggaacaattttttttccctctttgtttcgccagcgcctataaatttgagcgacaaatcccatcgtttctcctcaattccctccaatttttcccccaccggagttcaccgccgg

SEQ ID NO: 31997 - DNA, 1501 bp, Oryza sativa
agaacgagagtttttaaaactagcatattggaagattaatcggccaaaataaccactttttcaaaacctatcattaagggcgtgacgacgatatacgagaggaataaaaaaaaactcgtgattggtgtggaggggaagatctgcttatgaaattgttcaagaaagagtcgtctcatttccttatattgaattccttctatggttccacatgagaaaccagtacgaatataacctacatgtccaatcgaattatgagctagaggtcttttgactttcgttagattatcttgaacataggtgcgagtaagttgtattgtttggtctttatagctacagtttgatggtttggtcgttgcttcctcgttttctatttattcatctaattaatctccattataacctacgagacaaagtgattaactatatgattaacgagtaatatgctgcatatgcattggagcattgtggtgttgtacgcatggagcccgggcaattgcccatggtggccaggcgctgcatccgccaccaacagtcgacgtcgcggctgatgagcgtggcgtggagcgcaatgcggccggctctccggcccatgagcttggtgaggccgacgccgttcactgcgccctcggtctccacgtgcccggtggcgatggcatgctgcgccgcgtccaccgccgtgtggaacccgaacgagccgccgctgctggacctcacggtggattgtcgccgcgccgcgcatcatgtcgtccccaccgccgttggggtgggacggaggaggagcagaggcggcgcagggggacgaggatgcaggaggtgggccagcgagggaggagcctggaaggtgaggtaccggtggcggtgagggcggggagaggaaggcagcggctcgaaggtggagtgcggtggtggcgcgcaaggtcgcctcctactgcccacctcgctcacctgcgggaagagaagatgaagagaggcgggagggtagaagagagaagtgaggatgaagaagcagagagagaagggagagggaagaagggaggtgaggttgacatgtggggtccatgtgtgcctcatcatttttaattattttttaactgacatgtggggctatgatttttattatttttccgggatcaaattgtcacgtaaacgccacgtgggatgacgaccaacctaccacgtggcgccacgtcaatcaaaattaccttctaacccgccgagggaacttgtttgcaccggttttgacagttcagggatcggttgtatctttttgggttaaggacaaaaatcggattcggtgtaaagttaaggacgtcaaatgaacttattccaatcaattggtatgtctcatattttggcgcagaaaacccaaacttaggcccatattttggtacctcgggaatgggccgggtacagtgtgaacacgttccagccatatataaccccttcgtctccagtccccatcccccccttccctttcctccacccacgccgcgacgacgag

SEQ ID NO: 31998 - DNA, 1501 bp, Oryza sativa
gtcttactaaaaaaattgtaaatatcatttattttgttgtgacttgttttatcacaaataaaataaattataattttaacttatgtttttacatatctatattaaatttttaaataaaataaatgataaaacattatacgaaaagttaacggaaatatatattattttggaaaagaggttgtatgtactggtccctctcacccgaaactcactcctcacacatgggttgtgtttagttcccttcaaacttttaactttttcgtcacatcaaatatttggacacatgcatagagtattaaatgtggataaaaaaccaattgcacagtttgcatgtaaattgcgagatgaattttttgagcctaattacactatgatttgacaatgtgatgctacagtaaacaattgctaatgacggattaattagacttaatagattcgtctcgcagtttacaggcgaaatatgtaatttattttattattaatctatatttaatacatttgtaatgtgtatatataaaatttttttttaccaaaacaactaaacacggccatgttctacgttcgttcgatcttcccctaaaggcttatcaaagtcggccgctttcggccacaaaacgcgtgatggtaccgagaatctcgaccgttccggcagtgtatatcctttgtcacctagatatccaaaaaaattgtaaagtgttttaacaatgtagtacaggttaagatcgatcttatctatatcacttcacaaaataaaatacttaattcagtttatacggagaaacataagagaaccaaaacaaaataaacatcttgcatatttataaaagtgaaaaaataatataacttttttttagaaaaatgacagtttggatgccatgcacaaataactaaataagagtacgtgtgttcacgttagttgatgatggtttgaacatgaatatgtagaccattttttaaagaaaaatgttgataatagtttggaactttggatagcacacgcacgaaatgagagcatgtgcactggcactgcgtgcaggaggatggctgcttgaacctggaaatactcttttttttttttgagctatcgccttcgggcgctttcgttctagcttgttacaataaatgtaaaaattgagcattgaaacaaatagtttaagcgctcagttataaatatttaatatttaatatgatatttggttaaacttgaagaattccaatcattaataattcaagtgcttagttttaataaaatgctatcagtatattttgctcaaaaagtactattattatagttgctaaaaagtactatcgtaaagttacagatttcattactctattacaaaatcaattgttttaagagttgtaaaagttcgatacattctttctcctaaataataaatactatgagggagattgtcgacgtttgatgtcacgattccggtatttacatagtatggggatcgttgataccatggtatatgcgagattgaggtaaaagaga

SEQ ID NO: 31999 - DNA, 1501 bp, Oryza sativa
tcggcgagagctggaagccagcgatggctgggaatggcgtggtggcgttgttgccaagggcccacataccatacaccgtgcgaacgccgcggcaaagcttgatgcgaggcttgtttatctcgtctagcagtagcaggcatgggtagggtcaatgggctaatctgcgtccggcctatcctgaggcgttgtttcaaaagatctatacaacaaaactaacactccgttttgtattataaaacgctttgatttttttcaaacctttttaagtttgatctttgtaaaaaattaacatcttaatatcaaattagtttaattaaatttaacattaaatagattttgatagtatgattattttatgtttaaaatattataatgttttttataaactttgtcaaacttcacgaagtgacttaaattaaagttaaatcgtcttataatataaaatggaaggaataaagagtatattacatttgttgtacacaaatttatttaggtgggtataattctatatatgaacttattatgaaacattcgctgtaatacacgaactcgacatggtcagggtggcgaggagctccgagtgatggcagatggactctccatagatcgaccccctgtgatggtgcgggaaggtgcaagggtgagcagccacaccgtacgccggtgaaggagctccttttcctcttcctcctcctcttcttcttcctcctcctcctcctctctctgcccttcccttctcgatgaacaaaggagccgaagttgcagcctgtgagttatatccctccttccccgaccactactactttctgtccctccatccccagctccctccctccctccgctcccttgacatggattggagaaggagcaaggtgctcgcagcggacgcagggctcaagctcctccacgtgcaactagcctcggtaggtgaaacctctctcactttatcgatgctcagctcctccttgcccccaacccttctcactaccgctcagtcgacgttgaccgcctcctttgcttccgaatagaccacctcttctgccaccaacctccatcttatttagatctcattggcttcgacatagcctaggcagagctcctagatgtcgaggcaacaaagctcggggctcgcgaggaaggcggagcttggtggcagtctgacgagatcccatggagagcgaacccgttgagttctggtgagatccgttacccttgaagccttatggagctttgcctcttgttggcgccgtccttgaagccttgccaaggcctgcctctcaccaacaccgccattgaagcctcatcgagctctcttaccaacgccgatctaaagcttcacctctatcggcttcggctcagcgacggaggccacaccatggggaagagggaaagaggggacacaaagcagaaagaagatgtaagtagcaatgacaggtggaccctctctcttatgcaaccaatgtggatctattgtataggtcaataggtggcatccacgtgt

SEQ ID NO: 32000 - DNA, 1501 bp, Oryza sativa
gccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatccccaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagatcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctcgccacgggcgacggcacagagctgcctaacccgtggaacatcgagcaccttcgtcgcttctacccctagtgggggtcgggtatcatgtctcgggctcgggccaaccccgcaccccccgggcgtgcagagttggccgggggctaccacatgcatatacttaccttttttctcttccgtatttcaataaaagcattttcgatttcttgaggactgtgtctgtgccatcgttttccttttgaagaatcttggcttgaattagcacgctcgtgctcgaccttgccctcggcggcccgggccagctaaaatcgccaaacggggcccagaaccgagccgtgccccggggcgtggtgaacttcgggggggaatcggcaaaggcccacaatcgggtcatccataacccttggtcaccgcgctcccggcctggccagtctcgacacgtggatctccccaggcactagccccgacccgcgccgtttgaggctgggacctgggcacgagcccttgttcaagccaagacaaagaaggaccgcggcacagaccatcctcgtctcatacacacaacaagcagagctgacgcagaaatttcctctttatttgattacagattaaatcagtctatacaagaagggggcccgaaggcctcggaagaagaagcaaaagttattaagattggcgggggcctgggggctcactccgacgcgcccgggacgt

SEQ ID NO: 32001 - DNA, 1501 bp, Oryza sativa
tcgagaatactgctccacagatagtcgttgaaaagaatgtccacataatattttaaaccaagaaaagctagtcccctttatatccttttgctgggtcttgcttcactacccatctttccaaaaagttcgtgggtcttaaaagcaaagcaaactagataacataactaaactgagacattttagacaacaaacaaaattcctactatctgtttttcataactagccagattgtgcctgattcttttggccatgcaagctgtttgaacctagtccatcaatcagtctctttagcttctgactcattaaccctcttcaacctgattttagtgggaagagcattgttgatgttaaccgacattgtaacctcagtagcactaaccatttcactagtaaaccaactaaaaatgtacaaatgcagcttgttatatatctaattgtatcttcatcactacatatttgccttcacagttatctaaaacatatgctttcatattcataaacatttttttggaaagcggagtaccaaagcactgttttagtattttgcaatcctcttattacttgtgcattggacagatgcccaacaatttgaatggagagttccaggacgtcattgagatgccttttactcatgaccatcatggatcaaatgatcaaccctgagattgattccacaactgaagcaagagatcaatatgtgccatgggctttcagcaaaactgtgatatatgagcatgttgatatcatggtactagctcacagctgatcactgaagtataagcatccaaaatgcttagttagtgctatttttctcatgttcatagcagcaattgacctcctgtggaagcctctctttggatgttccatttgctgttatagaaagttgggagataaaaaaaaaaggatgttcacatggagatctcaagcaatttgttctccactgaagtagtctacagtcttgaaatggcgagaagcttcattttgcaagaaggtgatttttctgtggtctcgtcaaccccaggattattacatacactagctagcattgtgaggctacagaaattgttctttgttgtacttgcttagcccatgttccatctgacaagcaacataggcagaaatgcagtcactgattttgtatttgttgaaaaaaaaaataaatgggcttggcctgatgtagcaagcatttgaattttgcaacgggtgcatattggcacagatgtttttattccagcaaagctgtgaattctgaaagagaagaaaagagaactgtgatctagtgttactggtgaccttgtgtccttgttaagacataattcactacacactggtattggtgaccttgtgaagcgataatcatctgatctgaagctgatggtcatggcaaaagcagccaaggaaattaatctcatgaaactcttgctcattgtttcactgaatctgataaaacatgacatggcacgtttctgaagcaatctgaggtctgaacactacatttttg

SEQ ID NO: 32002 - DNA, 1501 bp, Oryza sativa
ttatgaaatatataaaactatatgtgtacatgaaagtatatttaacaataaatcaaatgatatgaaaagaataaataattgcttaaattttttgaataagacgaatggtcaaacacgtacttaaaaagtcaacggtgtcaaacattttaaaactaagggagtaagtttgtaaaatacaggagcatgatactaatatataacaatataacacacacgcattaattaatctggttttgctcattaattctgtgttaaccgtttgttttagattttttttccggaccattttctttgaacatactatacttatcatcttaattatgggggaaaatgacatattgtatcgagtatcgacatatatattgcgcgtgcttcatgcgtgacggccggcatgtacataaaaataattcggatatggccctacgtagccttgggattgggcccacacctgacagtggtccagggagagaattggttgagaaaatacgttgccgggcccatgtggttatattatgctacaatggaggcaacgcgggttttcattattataataaaaaattagtttatttgatattgtagagtagtttctatataaaaaatttttacacgatacacagtgtttgacggtttgaaaacatactaaaaaaatcgagatagaatctacatcttaatcagaaaataacgatatataggccatgaaaccatagtttttttttccacttagggactgttcatttgagcaaatggtagtggtaactttcttgttatccattatcatgcttactaaactgctaaacaattttctttacaaaactatgtatgtagaagtttctttccaaaactcaattgaacttattttctaagtttataataatttgtactcaattaatcatatactccctccgtttcaggttatatgacgttttgactttggtaagagtcaaactgtttcaagtttgattaagtttactgacaaatatagtaatatttataatactaaattagtttcatcacatgaataattgaatatatttttataataaatttgtcttaggttaaaaagttactactattttctataaatttagttaaacttaaagtagtttgactttgactaaagttgaaacgtcttgtaacctgaaacggagtactaatgacttgtttcacagccaacagcggccgagaacacagcctaaaggcatggtggacctagaaatttcatagagcataaaaacgttcacaaaatggctagatgttgggatcgtcaaacactgataatgcaattttcccgtcctttggccgtgccaactaacccgggcaactgctcaaggtcgccatacattggatcgactgctgattcgggtggtcttaccatgaactagtacatacaattgacactcgaacttattgtttcttttaacttgtattagttgaaattaaacatgtatgatcgtggagtgatatatgttatattaattcatcttattaaatatttttagat

SEQ ID NO: 32003 - DNA, 1501 bp, Oryza sativa
acaaccaattatgtccatctacactagtggcagcagctagttgaccagtatatttacctgtcaatcttgttgaatcaacaccaacatagggcctgcagccattgaggaagccatctatgcaaggcttcagaacaacaaacatcctcttgaagcacattttcttccctatcttctgtacatcaatctctacaatagaccctggggacttcctctccatctcagatttccaattaaaaagaaattggaagctctcttcatatttaccatgtatatgttacaatgcacacttgaacccagaccatgccttcgaatacttcaactttatctgaaaatcttcttcaagcttgtgccttgcatcactagctcccttttttgggtttttcttgacccaatccccaatcctgtctgcaacccaaccttgagttgccatcttgttttcttgcaatttggtagatgcacatgtgtgctcaaagggaagaactttgatctgcattaaacatgtataattaacaaaattgcattacacaaacataatcaaaagcctaatcaaaataaataaatgaagcaaaccatagcacctgtatgactttggtcccaggtagctttgatgcatgaacacgccaaggacacccttcagcagcacaatgggctagaaaacgtgttggatctgtcttcaaaccagcaaacacaaaaccttttttaactgcatagtgccttattgcttttctgaaagcaattatatcaggaaataatgcatctttctctatttttggattctcagggtcacgtatgacattaaagacctatggatcttcatcagtaacctactcctcaggagctctcacccctgcaacaggaggctgagaagactgaccagtgccagtgtttccatcgggttcagcaaactgtggaggctttttaggttgtgagggaacatacaaatgctcatcatcgacacccacatattcttcctcattgtcaaatatgtctggttctctaacaggttcttcctctattgcaggcttttcaacaccttcaacattgggagcgggctgttcagaaccaatgatgggagcagagttgtcaggaggcacaacacatatgggttctacttcattctcgacaagggtggataaaggctcagatgtaccatccatcttattgtcaagcactgaaacaataagattgaattggctctctgttttgtacatttcgaataggtcaggtagctgactattgtccacaagtctaacatcctcaccaatcgccttgtgcaaaaaccagattgaaggagattgatttgttccccaggtgaactcaacacttaaagtattcatcagaaattccatggaaaagctatctgaatccacaacccaatgccgagtagctcctttcgtgtaagatttcctaccatctgtttctatcatgacataagctccaaccctaacctctactgaaaaccagtgcctaccatgaaaggagagaacatcaactgaaaatc

SEQ ID NO: 32004 - DNA, 1501 bp, Oryza sativa
ctggaaccccaggtcatcgtcgccatcgttgatgtcctcggcggtggccttctgcttggcctcacctcgccggttgccggcgggagccgccggggtcttgccctcacggcgctcctgcctcttctcctcctcccacttcctcgtccgctcagccaagcttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccacgaagcgccctcgacggcgaggacatgaccctcgtcgtcggaacgggccggccccttcttcctcctcctgttccgccgctctgaccgagtggcggacccgggggcggccggagctgtcacaccagagccggaggagttccaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacaaaaccgctgaatgtacgagcgaagagactcatcgtcccttcgctgtaccgcatgcaagtccgcttcttcacctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcgcccccggcggcctcgatcccggtcgtgtagatctggagaaactcggcggggttgacgcttccgtcgtatttttcggtgacggtgggccggaaccttgggggccaacggacgttccgaaggctcgccacaaaggctcgacagccggcaccgccaaccggggacacggggggccggcccccgtgcccggaccgaagtggcgctccggacgaggaagcgccctccattgcgtgggcggcgtgacgagcgtcgcgccggcgctcgatatcgaggcgggcatccggccccccacgcatatctccttgggtcggaggcgtcgacgagggaatggcggacgaacggcgggtaacggccgccgctcgccgcgccctccgcctcgacgacgtggagccggcggcgggagcgccagaggtctcggtggcggaggaccgcccgccggcgcctaggcgctgctgcgccgtcatgaccaagtcggccacatcatccagccaacgccgagctggagtctctggatcggggacgacgggcgggtgacgcaggagcgcgcccgcagcctggagcgcaccctggggcgtgccgccattgccgtagacgaggcggcgacgcgccccgtctcgccgtcctcccccgtcgcccgcgggcggcgaagtcgcggatcctccggcctcc

SEQ ID NO: 32005 - DNA, 369 bp, Oryza sativa
ggtgtcccataatacctatggtcgcaaattagctatgcatagtgcgctatttgtaggtgcatataaataggtttttctttgcaccacgtgttgagttctaaatgactttacaagctcacttttcccaaagaaaaattacaaaggtgtttcatgttttgctaatacttatactcgaaaggcacagatatcaaggctttttattatgttataccaatcacatttagtcatttgttcctctcttttaatatatgcagaatgaagtgttgatgcttttattcaaagttgatccccaaagtgcaatgtccgtttatattcttcataagatggccaaggacaaattaaataaattatcaatgaaagatgctaagt

SEQ ID NO: 32006 - DNA, 1501 bp, Oryza sativa
ttgacaccacctcttcttgcatgtgcttcccacctacatccttcaccgctaagcgagcacaaataaaaccctatgtctttgagctatatagggctgcctacttgccccgatccatcttcctctcttgatttcttgctcctatgcaggttcaattcttgtggtacgagatttgggcgtacgagataaaaaaccctaatatttgcttggttctttcacgcccgaaatttctatccaaaattccaaacgcttacatgtgtataaatcctcgtccaggaatcagccgaggcacacaataacaaattgataatagagtacaaattattactctaatcaataagcgaacaaaatgtcattacagaggtagatagttcctctcaatcaataaagtcctaagcagcggaaaaaataaaagaaacagcgcagacgactcctctccacaggcagcttgaccagggctacgcctaatcatcaactccatcaacatcactgtagaactcctcctctgattaatgattgcaaggtgagtatatgacatactcagcaagccacacagcaaatatgcaagtgcacaggataacaaaggatggcatagtatagtctcatttgcataaacaacatttaataaatatttcagaatttcataaaacagtagagtattaaataaacagtattaaaccaacgctatacaacataccctgttgtataggcccaaccatcatgcacaaccaatcccggctgcacaagtctatctccaaaccaggaattaaccattccaaatcaggagctaaacaagttaataacatcatcatttaatatagtgtgggggtgagactaatcacgaaagacattgttagacccgcccataaccgcggacacggctattcgaatagtttaaactctgatcagaagtgtaccactgtacccacaagacacaacctcaacatcatgtcaaccatgcgtcgcgatacttgacaagtacccgaatagagagattgtgacaataccctctatataatacaattcaaagcagtgcaccgttcccggatcataatcacccccttataaacaaggtatggactccccagtgacccccgtgggcttatctccgccacttcacagtctggtgctctactatgaaccatactatacagaaagtaaagccgttgcccacgctggcttgtggttggcacggtaaatgtttcacaaccgaaaatcgtgaaccgatccttaattgtcatgagcacaaccatcaaaaccatatgctcacaacccaccattatcatattttaattgtcaaattaattaattaaccaatcatgattaaccatcatgagctatcattaagccatcattaaataatagtgaatcttaaattatcccattagtgaactaatgtttctaagcatggctaagcaattatacctaacatctagctgaaccattatatgaagctcaactagtcaaattataatagcccaaggtatcaaagaataaagtaaat

SEQ ID NO: 32007 - DNA, 1501 bp, Oryza sativa
accgtttagtagttcggaaagcgtgcgcgcggaaaacgaagcaaaactcactcacaatcacccagatcacccaggaaagaacacagcctcagtcttcattctcgcatcgcatttggctgccgtcatcctcgtgatgtcctcgtcccaaggctgacaactcacatgatttgcttggacattggtgatggcaaggacagctacggcatgagggcagggacattttagtacatacaaaaatattgcctaaaaattatttgaaacttgtttcaggcgtacagtgtggtatggatcaaattttgtgcttcttatgatggtatggtttcagttatataaatagtaatagattttaaaacctcaaaagttataatattttataatgatatagatcaaattaacgcaggattaagagggcagaaattgactcggcacgtttctgcatactgacacgcaactgtctgtcagcgtcaaaattaaacatattctttttttacgcaaaattaaacatattcttatgcagcacgtggtatcactggcaaattaggctgttgctttctgaagcggtgctgtgtgttggaatcttggagaggaggtggatatgtactaaaaaactgacctcttaatatcgtgctcatttagaacgtagaatctgatatagaataaataaataaatgctgctactccatccaattttctctactaggggttatcagttataaggcgtgctcgtagtaaaaaaacaaccgtaaaatttgaatttctttagaagacctaaaatttaaattctattaggtatatactcgactgcaacggattcatatgactatatcattgtgaataggtgcacaaatatgattactccctccgtgttttaacatatgactccattgactttttaataatgtttgactatctgtattatttatttttttgcaaatataataatatttatgacatacttaatgaatatttgatgataaatcaagtcacaataaaataaacgataataacatatttttaataaaacgaataatcaaacattggtcaaaaagtcattggtcaaaaaatcaacgacgtcatacattaaaatacagagggagtattttctttaccatcacgcgtgaggggaggcaggctaatgcgacattatctttaaaatcgaatggaagtaaaactcaaaatttacaaagtagggcaggtcaaacagttctctttcaataaaacttgcccaccaaagtttaagttctaaacttgacatgtgtggtcgtatttgtcgattaattatttttccagtagagagcgatgaacgatacaattatgacaacatacttatagggtcataaagattggtagggtaaagttacgctgttcaattaaatgtggtttttattagggataatcctaatctacgttatatgtaatatgagagagtatgagcctctgtggcacgaattgagatcctctgcctttaaatacatcatgccttttattactgacacgtgat

SEQ ID NO: 32008 - DNA, 1501 bp, Oryza sativa
actcctttcttttctatttcttctattggctggtctggggaaagcggatcacacgaagatctatagtgtttaagtccatctttctcttcctgcaatctactgagatatgcctcagctgcaggtgctttgtatctctggtcaagagttggcaagggatacttaacccatgccatccctttcaaccttggaaagtgttatcctagaatctatcattctccaaaaatccctaaaggccccccgggcttgacaagttcagcaaaaccgtagagaaagcaggttacacctagcttagcctatccaatatccgattcaaaaagagcttggattgctgcctcccgggggacaaagcaaagtcaaagcgcttgatcctttgccccatacttttagatcttcctccccaacaagcaacgggttgagcccggaagaagcagggattgaaccagggcttgttgacagagcagatatcaaaagcctatgttatctcattttcagggaccgagcaagggatgagcgccctctgatctaacgaccaaacaagcaactgcctcaggttttgaataaatcactgatggacggaagggagcgggggccagctcccttcctatgaaagacccgagcttactgggatgatacccctttacatactaatgggtgtaaacaaatagtacgcccctctactaaagtgggttggaaagcctgtatgcctaatctatgcagggtaggtgcgccgctacttatttctttctcactcactacttttttctattttcttttgtctatcgaaacagcctaggattcaatttgatttatcctagtggtgacagcttatgcttgtccttggaaccgggcgcggccctctttccgctattatgagcgggttttgggttagccagagcgggccaatagggataaacaaagtatggaagtagttgtgaggtaatcagatggctcaagataagttggagacgtacttgagatagataatttatgtatttcgctatttcgaatacctaaactcaagcggtgctaatttgctaatccaagccttatcaataataccaacacgccgtctgatccaagattagcaacctctctttctctcatagagggaacctcactgacgcattcagggctctgcagttgaagcgttccttcggaatacaccacaaatacactggtggatgtactgatggacacgacgagtacttcttctggggggccttccgtgaatcagtcggcgcgtgttagcgcattcggaaccacacatttttatacgattttcggatcatttgattttcgttttgaaaactttaaaaccttatcagagaggggccaccccaacatgatcaataggctgatggccttaccaaaccgctctgctcttgagctttctttcctcccttatggcggcgcattggggcactagaaatcaaagaaatctgctatgttatgtgttatgagtttgggacccagctgctgatgttagagctcttttcgaaag

SEQ ID NO: 32009 - DNA, 584 bp, Oryza sativa
aattagatcatataataacagctggtgcatgcccatcaaacacgtcactgtgctatatagaaagtttattgaaccattcccctgcataaaataagcaattggcgcgtggtgaccacggtgtgggaatcgtttggtccatgtggtcagagaggactctgcattgcttgcataacaaagaaagcaaatattaaaagtatagatctaattggaggcagttttggctttcttgggtgtgggaaggtttgccttcatcctcctctcctcgagacctcccaacacacactggatagatacgccaaagccagcctcctctttggccgatgcagctgtagttagtaataattaaagaactaatatatgtttaaacaaatctctggacctaattggtgcggtgatcagctggtcgcttgttccttcatttagtcatgcttgaatttgttttctcggatggcatggcatatgttttgactttatatgtcaatggtttaatggctcacggtttctgtggcatgcatgtcacaaaactttggctgaactttgactcagctgaaacgatgaccaattaatttgagaacctgaaaaga

SEQ ID NO: 32010 - DNA, 1501 bp, Oryza sativa
tcctttcttttctatttcttctattggctggtctggggaaagcggatcacacgaagatctatagtgtttaagtccatctttctcttcctgcaatctactgagatatgcctcagctgcaggtgctttgtatctctggtcaagagttggcaagggatacttaacccatgccatccctttcaaccttggaaagtgttatcctagaatctatcattctccaaaaatccctaaaggccccccgggcttgacaagttcagcaaaaccgtagagaaagcaggttacacctagcttagcctatccaatatccgattcaaaaagagcttggattgctgcctcccgggggacaaagcaaagtcaaagcgcttgatcctttgccccatacttttagatcttcctccccaacaagcaacgggttgagcccggaagaagcagggattgaaccagggcttgttgacagagcagatatcaaaagcctatgttatctcattttcagggaccgagcaagggatgagcgccctctgatctaacgaccaaacaagcaactgcctcaggttttgaataaatcactgatggacggaagggagcgggggccagctcccttcctatgaaagacccgagcttactgggatgatacccctttacatactaatgggtgtaaacaaatagtacgcccctctactaaagtgggttggaaagcctgtatgcctaatctatgcagggtaggtgcgccgctacttatttctttctcactcactacttttttctattttcttttgtctatcgaaacagcctaggattcaatttgatttatcctagtggtgacagcttatgcttgtccttggaaccgggcgcggccctctttccgctattatgagcgggttttgggttagccagagcgggccaatagggataaacaaagtatggaagtagttgtgaggtaatcagatggctcaagataagttggagacgtacttgagatagataatttatgtatttcgctatttcgaatacctaaactcaagcggtgctaatttgctaatccaagccttatcaataataccaacacgccgtctgatccaagattagcaacctctctttctctcatagagggaacctcactgacgcattcagggctctgcagttgaagcgttccttcggaatacaccacaaatacactggtggatgtactgatggacacgacgagtacttcttctggggggccttccgtgaatcagtcggcgcgtgttagcgcattcggaaccacacatttttatacgattttcggatcatttgattttcgttttgaaaactttaaaaccttatcagagaggggccaccccaacatgatcaataggctgatggccttaccaaaccgctctgctcttgagctttctttcctcccttatggcggcgcattggggcactagaaatcaaagaaatctgctatgttatgtgttatgagtttgggacccagctgctgatgttagagctcttttcgaaagag

SEQ ID NO: 32011 - DNA, 1501 bp, Oryza sativa
  unsure (1)..(1501): unsure at all n locations
gggtaagagaatagtattagaaacccatataattgctaacatatttcaaatactanngaatcctttatantttgtgtacatatgagtgatcgctaactcatggctagctaactcatggctagctagtggtgtactagtatagtttattgtacttgtgtaggtttctttcaaagttacatgtttatgaattattgttagctttatcgtgcttctgttgaaaaaaaggccgcaaataaaagagagaactcccttttttttttgagaactcccttttttttttgcaaggaagcatataaaagagaactttgtgagtaacgatatgatgatgtttaatggaccaaaggttataacttagcgtaaccaattgcagatacgctaaaactattatgcgagctagtgtatgttaatttcttcctcatttacaattattttctctaataattaactaacatatatgaaaaagagcaatgttcccgtgctctaaaagagaaattaccaaatgatcataatcgttcattattaagaataaattagtaatttaccaatacaatgattagaggtaactttgttatttatgttttttctagatctattatttggtcatccattccgctggcattgctcacacctatattccatcgaaaaagccaaaaaaaaagttgaaaaaaaggtctagtcgtcattgctaaatgttgattatatccctccacacttttttttataataatgcacctccacatttctaataccgctaactgaagtggtagtacaaataaatctaaacccttcaaccaaatgagaacaacggttcatattgctttttactaccaacagagagcaccgtagtatggctcatatgagaacttacacgtactagtgctagaattactcgatccgatcacaaatacgtattgatttagacattggtctggtctcacacaaacattatcggaccacttatttatatcttaatatatttacaaattccaataaaattgtatttttcatgaaaaatatgcatggcttaggctttattcgattttttttgtttgcaccattaatagcaagataacaagaatgcctacacttcatctatttcctatacatgttaaatatatcatgcaacaagtctattgtaaattattcacttgtcatctttttgacatgtgtgctcaaatcctatatacttatatagttcatccccactaagtatagttaatgctatttctctcttctctcattaagccacatcaccctaattatttctagcctttggctgatagatccatagttcaaattatctcttctttcttctctcataacaccatgcaatctcaatcatttttaggctcaaaattcataagtatcaatttgttttagttttaataattatattgcatcttatttatacatattatgtaacttaatttccggcagcaacacaacggggtattcatatagtataattcaatgacctttcaattgattatatgtttcaagg

SEQ ID NO: 32012 - DNA, 1198 bp, Oryza sativa
atagtttaactctggccagaggtgtaccactgtacccacaagacacaaccttaacatcatgtcaaccatgcgtcacgatacttgacaagtacccgaatagagattgtaacaataccctctatataatacaattcaaagcagtgtaccgttcctagatcataatcacccccttataaacaaggtatggactccccagcgacccccgtgggcttatctccgccacttcacagtctggtgctctactatgacccatactatacataaagtaaagccgttgcccacgctggcttgtggttggcacggtaaatgtttcacaatcaaaaatcgtgaaccggtccttaattgtcatgagcacaaccatcaaaaccatatgctcacaacccaccattatcaggttttagttggcaaattaattaattaaccaatcatgattaaccataatgagctaccattaagccatcattaaataatagtgaagcataagttatcccagtagtgtgccaatgtttctaagcatggctaagcaattatatctaatatccagctgaatccatatatataaagctcaactagtcaagttataataacccaaggtatcaaagaatagggtaatcaagaacaaaagggctataacaaagcaataggttatttccacccaatgacattcaaaaataaatgcaatagttgaatagaaacaatagctttaaacgggatcaacatgctcaaaggattgtttgggatctgtgtgacttgccttgctggccttggaactcttcaaagtcttctcttgcaaattcagactctcgggaacgtcggaatctaaagagaaaagagcaaaaacactaaaacagcacataaacaagcataaaaagtacatgtggatatttttaacatgtagatctcaattttagaaaaatttagagacttgaaccaactaaatccgagctaagatgaataagttatgaatttttaaagattaaatcggattaaatcatttatatagattttaattgaattatgatgcaataatgaataattttttaaaaggaaaaggggattattgcgtcagtggctcgggttcacggtggaccgggtgcacagcggcggtctacggaaacgaacggccgggatcaaccctatccaaaacagacggccgagatctaatcggtctaccgcggctcacgggaaacgacgacga

SEQ ID NO: 32013 - DNA, 1501 bp, Oryza sativa
tacatggtgcattaatgaatttagtaaatagatgaaatgtggttcgttttattactgtgagatgcgcaatttagtttatttatatgtttcatttatttttctaagtgacattaaattcattgtaatagattgtagcactcaattgtgtatttttgttatttaaaaaaaaagaagacgatgtctcagcaaggcaaaccaatatcgacgacaactagtgggtcctcaagggcacgtactcctaggacagggaacaaaatccctaaggaacggttccgcataatagcggtggacgccgtagggttgccgacatctccaaggaaaatattgagccgatttaggtctatctgcggggtcatagggaggcagaaattcagtattctgcaagatgacatcaagctcgtgccggccgcagagaaggacattgcttggctaacgttcaaggagagctttgattatcctgcggagcatgaggactatctcaggcgggctgctttcaaggttatgggcaatgcttggaagaacttcaagactaagctagtcggcgagttcgtctacaacccggcgaatccagatccaagagagaaatttccttggatcacggaataggtctgggaggaattccatgcgaagaagttgacccccgagtctagagctagaagcgaggcatatcgcttgctccagaccaggaaccagcatccgcaccggcttggcaccgccggatatgctggtaaggaagaggaatggcagcgtgaggatgaagaagcggaggaatcgtgcacaccactcgtgtttggcgatatcccacaccctcgggctaggaactgggccagggccaggtaccagaagaatgatgatggcacaatcttcatgccaaatgcagaagatcaacgagtatacgaagctacagtaagtgtctagtcaaactagatgttcgcattgtttcccatcgtgcagtttatttaaccccactaaattgtaatgcagaaggagttggttgtcgagcaacaagtctcgcaagaggcctgctctcaaagacgcgaggacgacctcctcacgaaagcgttgggcaacaaggaacactatggacggacacggggcgttgggtcttctgttccctggaagtatggatttccagactacgcgtggcagtacaagaagcggacttccaacaaggcggagaaagatgcacgccttgaagccaagatccgggcgtcaataagagctgagttgacatctgaattcgacgaaaagctcaagtcgatgagggccaagattaggcaagagatccgagaagagcaacagaacccctaggccgccgctgctgctgcgcacgaagagttaggaagtcccacctaaaaacgcagcagttgtgcatcaactgagttggcggaaaatccaacatcggtcgacagcgccgtcgaccacataacggtaactgtgaacttactcaatacatgaaagacttaacgaatccatatgatatataatattctaaaaaaat

SEQ ID NO: 32014 - DNA, 1034 bp, Oryza sativa
atatacatatattcagattcgtcgtactacattcggtcttagattcgttttatatgggaaagagggggtacatgtgtagtgtagtgatgtgtatatgcccgtgcatttttcgaaaaaataatgcataaatccaaccatttgttgagtggaagagtcgctgcttcttccatgttctaaccgacgccgtcgtcacacgcagcacatgtccactgatacgtacgcttcatcgatcgcccacggctaagcagccaccaccaacaagtcatccacaaacaattccatctgcatatatttcttgaccaaagaagagagagagagagatgtgactttttaattctcgaggggggcagattccacgtcttaagattacctacttgatctcgctctcctcttaagaattgttcatgatcgatcgacggcaagtcagcagcgaacaaacgtcagttcgatcgaaagagaggtaggccggagattataataattgattaataatcattcaccacttcagcaagttgcacagacatgatattcctctcgtctcttttgtggcttctttttttctctggatacgaatacgaatgaggcgaggaatcgttcttttgtccaggtcagggagatgtgcgatttgctaacctgaggagataaacaactactactccagcgttgtgttgctccaataattcagacactgacgcggacatggagaggccgggcagcgaaggagagagcacggtgccggcacttgggccagacagagataggcactgcgatttttggtccggaactgatctgtgcgtgacttggcaaaagtgtgtgcaatcatccatgcgcatctacagataaagatcaaagcaaaaaagaatggtactcatatcaatcaactctataaaagtatctctcactcaagaagaaacaaaaagaaccggtgaatttttttcatatttctaagattccgagggccctttgaatcgcatgttagaaaaaatggaggaatagaaaaaacacaggattttgacaggaattgaagtgtaaaa

SEQ ID NO: 32015 - DNA, 1501 bp, Oryza sativa
gagatagctagcttcatcctctgcgaaataattaaccccaaaggaatgtttaggcttaaactaaaatgatgaacaatgttgaacttttatgtttaggcaatgatgaacacttgttatgcaactgtgatgatgtaactgtgatgtttatatttatgtatatatttcatatgtttatgttacgacttgctaaataaatatttgatccaattaactcggttttgcaggtgaaacatgataaatatttgaatggatgtgaaatatgtgaatggatgtgaaatatgagatggctgtgaatgtgtggttgtgtgaaatatgttgatgtctatgtatgtgaatgcatatgtatatgaatgggtgatgctggggagctggggatattagatatctgtgtttgtttctgtcatttttgcagcgggcatggctagcaaaagcctaaggctagccaaaaaacaaaatttattttttttttgtattatagtcatctgtgacgggtcataactaaatgcctgattgagatgagatcatttgtgacgggctctagtttagccccgattgaggtcagtagtcatctttgacgggctatagtttaggcccgattgagatgagtatcatctgtgacggggtctagtttaggcccgataaaggttagtagtcatctgtgacgggcgctagttgtggcccgatagagataggtcatctgtgacgggctgtagtttgactggtcgtctgggacaaagctatctgtgacgggctttactcagggcccgattgagatatattcattcgtgacggccgtttgcccgattgagataactcttcacatcagtgacttctagcctgtgacggacgctgtgcccgattgagatggggcttaccgctcgattgagatgagggtatccgttctagtggttgtaattatgttgcttcaatgtcaatttctcatcgaatggaacttggtagtttaatattgaaggactatatctcaactatgctacagattgaattaaatggggtaactgcacacggacactttacctgcacatttgacattgactcttaattctgaagtagttggtgttgcatagtttacttatcattttataaagtagtatagtccatatttccggctctacaatattattgtcttattgataatttgactcaattttttttttgctgatgctgaatatatcatggcgatcacaagatattttggtgtcatttctgtacaaaggaaatgctccttgcataagtagatttgccatctttttgtgtcatcaggtagaatgtacggttcctcttttgtaagtggattgtatagctatcctatatatgtactatacatggcatttccaattagatggagatggtatattgtcgaaacaagaattcggcaataataaaaggggtagcgcacaagacctgaaagtggatggatgcggagacaaggatttagacaggttcaggccctctcgataagaggtaataccctactcctgtt

SEQ ID NO: 32016 - DNA, 1501 bp, Oryza sativa
ctcctgagaccttcgcagtcgaaaagataaccttctctcgaactagattactccaaagccgagtgcttcaatcatcttcgccatggtctcccgagtacttttaccaaatctgaagactgtggagggctgaaaaatatagtcaggtgcatcgactagatgcacctaataggtgtagcccctgacaatgtggttaattgaacaaaccaagcatatagtcaaggaataaataatccaaccaaccaagtggttttgataatcgtaattaaccaagcaacttgatattaatatgtagcatatgcggtgtaaatccctgaataacatgatccgagtgatataccgactgctttgcaaaatatgatgagtgtaacctaaagttggctacattattgaaaattcacatagcaaaacagctataaaaaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccaagtaaataaacttataaaggatttaccaaccgcctagaaaatgaccacaatatataatcagcctaagccataatattggtcaataaaaatgcacacttacgtggcgaaaagcaatgatattgtatccaatcaattgcttaaaaacccaaacaacaccttgacttatatataaaaaagtcagcgggacagctatataaagctttactgtttgacaccttttaagatgcattgtaccaactcctaaaaagttaagtaactgcggtataaaagaattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacaccctttaaaggatgacgcatataacatgctcccgagtaataaatcttccgggtaatatagaccaagcgtagctcatatgaatagcttctgatccgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagttggcggcagtcaggtcagccagcaatgaatatgaaggcgctc

SEQ ID NO: 32017 - DNA, 1501 bp, Oryza sativa
ctactattactgtatcatattctattttttattgaaaatgtgtatgtccaataacaaccttcttagaactatgtttacatagtgtcctaataaacttctaaatcaataagattagctatgtagtgtctttttcgccttcctccgtatgtactagacaagttcatgcaccaaaacaaacattttacaaattcgtgcactaaattacacccatctgacaagttcatgtaccggcaatgcaatttactctttaccttatattcaaatttttagttggcactctgtacttcactggtcctccaagtctaaatactggtactaagtactaatattgtaatatctctgatttgatgtctgaagagcaagaataggttattaaatccaaactggtttgataagtatgctagttggctatattacagtgccaatgacgacaatttacaatatctgtagcaatggccatgatgcgttattttttatcaggtgatatatttttttcttcgagaaacacagcacaaatataagcgttcacaacatgcgtacactgatccttataaaaaacacacgtacaccttacctttatgtcaacaggtacgtcgcataccactgaaaaaataattagacataaatacgaacggccgtgtcaagtctggaacttgaaccctgttgagttacgctcacttcacttctaaccagttttatgtgttatgaagttatctataagctagcataattttcataatatagatgccgcccacccatttgcaacgtagtaacgcgaatattagggaatgacataatatcaaataattagaaagaatgaggctttaaacccaggtcatctagcccaccacgtagtaatgcgcgtacatatgtagcatatgctataaggctggatcgatcatgcatccatgtcataatatactaccataccataccactttcgcgaatataattgtgaatataagtatttttttcggaataagtgaatataagtatttatgctgtgtactccatagtcgatcacgtatatatatatccattcagctcgcaagaatatattctatcttgtgccggataatcttgcaagtacaaaattcagctactattgtagtactccctccgttttaaaatataagagattttggagggatgtaatagtactattgtcgaaacatgatttcggcaataataaaagggggtagcgcacgagacctaaaagtggatggatgcggagacaaaggatttagacaggttcaggccctctcaatgagaggtaataccctactcctgtttggggatttgaatccgccgggtgtattatagatctgacgatctagttgtctcatctgccccctagagggcctcctgcccaccttatataggatgaggggcaggattacaagatagaaaccttaaccaatacggtatcggtttcctaaatctactttacaatattatcaaaccaggagtttaggccgttccgtaatatacaaggaaacgt

SEQ ID NO: 32018 - DNA, 1501 bp, Oryza sativa
ggcatagtatagtctcatttgcataaatagcatttaacaaatatttcagaatttaataaaacagttaaataataattaaacaatattaatccaatgctatacaacataccctgttgcataggcccaaccattctgaacaaccaatcccggctacacagttctatctccaaaccaggaattaaccattccaaaccaggagctaaacaagttattaacatcataaattaatatggtgagaaatgtaagactaatcacgaaagacattgttagacccgcccataaccacgggcacggctattcgaatagtttaaactctggccagaggtgtaccactgtacccacaagacacaaccttaacatcatgtcaaccatgcgtcacgatacttgacaagtacccgaatagagattgtaacaataccctctatataatacaattcaaagcagtgtaccgttcctagatcataatcacccccttataaacaaggtatggactccccagcgacccccgtgggcttatctccgccacttcacagtctggtgctctactatgaaccatactatacataaagtaaagccgttgcccacgctggcttgtggttggcacggtaaatgtttcacaatcaaaaatcgtgaaccggtccttaattgtcatgagcacaaccatcaaaaccatatgctcacaacccaccattatcaggttttagttggcaaattaattaattaaccaatcatgattaaccataatgagctaccattaagccatcattaaataatagtgaagcataagttatcccagtagtgtgccaatgtttctaagcatggctaagcaattatatctaatatccagctgaatccatatatataaagctcaactagtcaagttataataacccaaggtatcaaagaatagggtaatcaagaacaaaagggctataacaaagcaataggttatttccacccaatgacattcaaaaataaatgcaatagttgaatagaaacaatagctttaaacgggatcaacatgctcaaaggattgtttgggatctgtgtgacttgccttgctggccttggaactcttcaaagtcttctcctgcaaattcggactctcccggaacgtcggaatctaaagagaaaagaacaaaatcaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacatttatatagattttaattgaattatgacacaataatgaattatttttgaaaaggaaaaaggggattattgcgtcagcgggtcggctcacggtggaccgggtgcatggcggcggatcacggaaacgaacggccgtgatcaatctatccaaaacgggcggccaagatctaacggtctacgaccggtctacgacggacggcgtcga

SEQ ID NO: 32019 - DNA, 616 bp, Oryza sativa
gctagaggaataggaggttggtgcaagtttagcgaggcgaaagtattacttcacaatcgtgggtggcgacggagcgactaggatcgcacagagcccgagagttaactgtgtggcgtgttgtggaggtcaagggaatagtgaagctccgaccactgtacacatcaaggcgtggggtgccaggagcagcacttcgaccttgggtttggttctgctggattttacaaccaacggtccgacgtggggcccgtagaccgcacgaacatccccatggaaggcgtaaagttccaaccggcggctttttagtggctaataggtattttgggataaaataaaatatttgaaaataaaatataagtttaaattggaaattcaaatataggagtaaatcaaatataaactcaaatggtatttaaataaattaagaaaattcaaataaaatattaaaatactaaatttggtatcaaaatgtagagtttgaatttatatgaatttaggtataagtttcactataatcggatctacactttaggagatatgggcttctaaagaataggatttgaattaaataaggaaaatacgaaaagttactgtgtaggggcccacctgtcagtataga

SEQ ID NO: 32020 - DNA, 1501 bp, Oryza sativa
aggaaattccacataaagaaattctcatttagctcctgatcttactaactcttaactgactatcccatcagtaataactgctggcatgactgtccttcttctgacctgacttcggtgtcatccacctaaatgggttgtgtagttgatatctcaaaactaaactgaccgactcgcattggaattgacacaacttgaggaactggggtgctgcgaatagagctgttgtcttgatgacgctaacgccttgccgttgaacaaccttgcaagaactgaccttgtaaaccataaccactataggtagcacttgttgcctctgggattgggggtgacttagctgtgctggtctgctaaagacttggtggcgtactgtctgaggttgcaggtgcttgctcttggaaaacaaactgactttcgctctgatcctgattccggcttgcatctgagcttgtacttgttgttggagacattgtcgttgcatctgctgctttggactctgcggttgctacatcaatatctggcacatccatcttccaatcttggctaaccagagcgaggtgctctgacttagctggtagcttgttgtcttgaactgatccactgactctgactgcaacacactactgctggagttatttccgctacatttgactaggtgtcgaacctgcatctcccacatcgatacacccatcttctgatcttggacaccaaaagttgatcatgagcaggtttcatctggcattggggcaccttgcagctttcaactaaaccattgatctgtggctttaattgatcttatctctaacactgaccatctgctgccaggacggaagagaggtggaagagaggggtcgctaaagataaggtactaaaccacttgcctactgatatgttgttaatagatttttattgttcaagttgcttaagcaaacaacctagtatagtcgcatccccaccaatgatgcaaaccatacccctacacacaagcaaacaacacacgatctagaatctaacgaactactcttccgggaaggattaggtttaggtgaacttcgggaaaactcttcttgatcttcgcggaacgatgactctgaactaatcttcccgctccttgcacgaagcttgagactcgacttgacttctggacgggcatgaagctggcggtttctcctacatgtttgacaactaaaagagttggagggacagggaggaaaaattttaataaactgtttcgcaaagaaatgccgaagggcgagaggagacaatttgcgaatagggttttcagaaaacttgtccttagggtttgaccatttggctcaacctacagtcaagttgcctctgataccactttgtcacgcccagaaatttagtccaaatttctagactattttgtgtattaaatccctgtccaggaccagccagggtacacaaaacgacaagtaatatacagttccaaacgtaaataaagcgtaaaatacttacaaaagaggcacttagtcctcgc

SEQ ID NO: 32021 - DNA, 804 bp, Oryza sativa
tctggcgccccaaaaaggaccatttctgggataagttttttcaggggtctatttgcgaaataagtttttcaaaaggaccaaaatgtgaaaaatccagcctagctacctgctgcgagattgttgtcaaggctcaccaagtgacatgttgttgcaccattctctcttgacgaagtctaaaataaaattgtagaaaatcatttttttttctagtgacaacaatcgctcatcataggtctcacaaggcatgaatgaatttaatagggcgtaaatgagaagtttggagtccaatgacttgagtaaccaaatttcataagtaatcatgagtgtggaatgttgttacttgaatgatcactggatctaaccaagcctaccttcagcttaaaacaaagctatgcatatcagaaattaaaccaccttttacacatatatctagtaccgtgatatatatttctcataccccatatatatatatatatatatatatatatatatatatatatatatatatatatatatatatatagacacacactatatatatatacacacacaccgctcgttgtcttacttatcttacatcctgtaagtaacgctgtgtttgtctgtgcgattggaaagagttattctctcgtttatcgtcaggggcggtaccacccattaggcggggttaggcggccggcccagctacggcccgtgccgccccgaccctccatatccttcttggaccgtctaccaccacatccaattcacaattggcccataaataagcagcccaagtgtccaattttaatcctgcgtatgtga

SEQ ID NO: 32022 - DNA, 622 bp, Oryza sativa
tgtcacgcccataaattcacgaaccagaatttctaagctgaatgtacattaaaacccctatccaggaccagctagggtacacaagcgacaatttttgacatacagatccacgtcttacaaacatataaaagatttacaaatgcaacagaaagataaaaacgagctaagcttgaagacttgactcctgcagcgaggcgactccattccacaggcattcttgacggcggcaacgaaaccaacttctctgagacagcccaactgagaagaacttcagctctggtgtggggaagagagagcaagattgagtactatccactgcactcagcaagtcataccagaagagaaggtatgatgcaagatatatccaaaggaggctaaaggtttatttgcataaagcaggcatttaaaagcagtagttgaaagcagtaaaactgtaatagtaattaatcaatattaaccaatcactgctcaacactacaccacgttgagacagggccaatccaccacctgaactaaccagttccattaagctaaactaggggtgagactaatcacggtgaatccggttgattgcccataaccacgggcgctgctattcgaataattttaatctgatcagagg

SEQ ID NO: 32023 - DNA, 1501 bp, Oryza sativa
acagaacagttaagcacaagtactgtaacaccttaataaaaattgcacatgtaatacacatcttaaaggagaaaaacgaacgaaacaatttcagcttgaaagttttcactcgatgaacatacaatttcaactaggtagcataattatttggatccacaaataaggatagaagcttatactctggaagaatgtctccctgcttatgcaataatgttcatgctttataggagcttaaatggccagagtacaaatttcttcctataagggcagattactcaataaaaaattattggaataattcattaagaaaaaggttaggtggctataatgccacaaatattcttccagttcaactacacgtttctaaatatttccaatggttatcgaatctatcacctgttgcgaagttaaaaaaaaaaaagagctgatcatctattgtacagatcacttggagtagtagacaatcctgatcctaaccctcagtgacgagcttccaatttaaaagaatctcaattcatgttttggatgcaaatttgtgagccacaatgactttatgtgaggcatctataggtgacgattgtactattgatgtagcaacatgctcaaaacagtttcttcgcgcgcgtcttaaaggcactgcaaacaattttgcttatagacactggaaaaggttagggaatcattttggtagtttcttctcttcttaaaggcattacaaacaattttgcttgtggaggttagggaatcattttgcttgatgagaagaactttgatattaaccaggaatcagaaaaatgggccattatataccagcaaagacaaggtgaagcaggcatacttcattataggcttctcgccttcaccatacctccccatacgaaatgatgaaagagaatgagagtaaaaatacccagcagtgaacatattttgccaggtaagtgcatttcaagtcgattgaatgatctacctctggacactcgtcgtaagaatcacaaaacacaaaatgaaagatgcatgtactccctccgtttcacaatataagtcattctagcatttcccacattcatattgatgttaatgaatctatacatattaacattaatatgaatgtgggaaatgctagaatgacttacattgtgaaacggaggaagtacatcgtagtgtgttataaaacacgttggatatcactgctttctttttctgaaaagttctaattatctggaaactacggcaagaacaatgactgatgagagaaagcacacatgaaaagaaccaatcagcagtgactgcaaagtcgcaagcttatcgggtgactaaatcacatatctaagagcttttcaaatagataaactgaaagcactatcaaaatggtgcataatctggaattagaaatgtctcatttcagccatatcgctatttatgtagaaccgcaagcatatttttttttttgctatcaaaacttatttcatcgaatatatagaaaaggtacataggcacaatt

SEQ ID NO: 32024 - DNA, 1035 bp, Oryza sativa
ttttcaactgttggcaggtaaagatttatctaggtcaatgtaatatgctcctcttcctttcgatcataaaataattgatctatatatttctatttagattgatgttttgttatgttccagtgtcaagacaattcgaacatgctatcctcaaaccccaaatggcactggtccagttactaatagatctgccaagctagatatgctttttgctaacaaggtaattacttttaatatttccattactcaaacaccactttgttactgatcactgagttctagtaattcctgtagtaatcttccctgaacaatgtattcttgcacagtagcaataattattgagcataatacaactaccaaaagatttatggaaattaagagtctaatgaggatttagaaaaaaacctagtgggttaactccattacaacacactggtccttacatgtgagacatctcagttccttgattgggggttcagagtctgattatatggtgcaggaaattctggaaacccaattgccatcttgacctatggttattctgtttgcactagattgcatgaataaaatcatgacacggtcgatattttgctttatctgatgtgttttgaggaaaaaaaaaactttatattctatatatatgtgcatgcatattcattatttcatttcagtatttttaggggggaaatatttcattattttttcgatgtaggtccagatgaaatgatggataaacataggaagtaataataagatattaattaacttggctcaaatgaataatattccttgttaacaaggttatttctttgttccatttttgttgtggccgacatatgtgctacactttttgtcattgatttcttgttggattaatatattttccccttgttggcagctgcatgcttttgttgagtacgatactgtagaggatgctgagaaagcggtatggaccattacatgatgcattgtaatattttcatgaacatggtaatcactgttgcacatgcatcatctctgatattttcttcatcctat

SEQ ID NO: 32025 - DNA, 1097 bp, Oryza sativa
aaatgcctgctttatgcaaataaacctttagcctcctttggatatatcttgcatcataccttctcttctggtatgacttgctgagtgcagtggatagtactcaatcttgctctctcttccccacaccagagctgaagttcttctcagttgggctgtctcagagaagttggtttcgttgccgccgtcaagaatgcctgtggaatggagtcgcctcgctgcaggagtcaagtcttcaagcttagctcgtttttatctttctgttgcatttgtaaatcttttatatgtttgtaagacgtggatctgtatgtcaaaaattgtcgcttgtgtaccctagctggtcctggataggggttttaatgtacattcagcttagaaattctggttcgtgaatttatgggcgtgacagtagcgaagtatctgctaaggtttagttgtttgctagtcattgctagagttgggtagcatgatgactgagtttggtatcttctctagccggtgtccacgaatagcatatcggctagaggaataggaggttggtgcaagtttagcgaggcgaaagtattacttcacaatcgtgggtggcgacggagcgactaggatcgcacagagcccgagagttaactgtgtggcgtgttgtggaggtcaagggaatagtgaagctccgaccactgtacacatcaaggcgtggggtgccaggagcagcacttcgaccttgggtttggttctgctggattttacaaccaacggtccgacgtggggcccgtagaccgcacgaacatccccatggaaggcgtaaagttccaaccggcggctttttagtggctaataggtattttgggataaaataaaatatttgaaaataaaatataagtttaaattggaaattcaaatataggagtaaatcaaatataaactcaaatggtatttaaataaattaagaaaattcaaataaaatattaaaatactaaatttggtatcaaaatgtagagtttgaatttatatgaatttaggtataagtttcactataatcggatctacactttaggagatatgggcttctaaagaataggatttgaattaaataaggaaaatacgaa

SEQ ID NO: 32026 - DNA, 1501 bp, Oryza sativa
taggaaattccacataaagaaattctcatttagctcctgatcttactaactcttaactgactatcccatcagtaataactgctggcatgactgtccttcttctgacctgacttcggtgtcatccacctaaatgggttgtgtagttgatatctcaaaactaaactgaccgactcgcattggaattgacacaacttgaggaactggggtgctgcgaatagagctgttgtcttgatgacgctaacgccttgccgttgaacaaccttgcaagaactgaccttgtaaaccataaccactataggtagcacttgttgcctctgggattgggggtgacttagctgtgctggtctgctaaagacttggtggcgtactgtctgaggttgcaggtgcttgctcttggaaaacaaactgactttcgctctgatcctgattccggcttgcatctgagcttgtacttgttgttggagacattgtcgttgcatctgctgctttggactctgcggttgctacatcaatatctggcacatccatcttccaatcttggctaaccagagcgaggtgctctgacttagctggtagcttgttgtcttgaactgatccactgactctgactgcaacacactactgctggagttatttccgctacatttgactaggtgtcgaacctgcatctcccacatcgatacacccatcttctgatcttggacaccaaaagttgatcatgagcaggtttcatctggcattggggcaccttgcagctttcaactaaaccattgatctgtggctttaattgatcttatctctaacactgaccatctgctgccaggacggaagagaggtggaagagaggggtcgctaaagataaggtactaaaccacttgcctactgatatgttgttaatagatttttattgttcaagttgcttaagcaaacaacctagtatagtcgcatccccaccaatgatgcaaaccatacccctacacacaagcaaacaacacacgatctagaatctaacgaactactcttccgggaaggattaggtttaggtgaacttcgggaaaactcttcttgatcttcgcggaacgatgactctgaactaatcttcccgctccttgcacgaagcttgagactcgacttgacttctggacgggcatgaagctggcggtttctcctacatgtttgacaactaaaagagttggagggacagggaggaaaaattttaataaactgtttcgcaaagaaatgccgaagggcgagaggagacaatttgcgaatagggttttcagaaaacttgtccttagggtttgaccatttggctcaacctacagtcaagttgcctctgataccactttgtcacgcccagaaatttagtccaaatttccagactattttgtgtattaaatccttgtccaggaccagccagggtacacaaaacgacaagtaatatacagctccaaacgtaaataaagcataaaatacttatagaagaggcacttagtcctca

SEQ ID NO: 32027 - DNA, 1501 bp, Oryza sativa
ggtaatatttcttcaagtatttgccattgagcgctcgcccgtaaacttcaccatcaagcccttgcaacatatatgcccccttagacacaaacttatgaatttggaacggtccctcccaattcggcaaccacttgctaaatttactatcatgagtaccaatcggcaaaatcagcttccatacaagttcaccttccgaaaaatctttaggtacaactttcttattataatgccgagcaacacgttccttatccttagtaaccttcgcaagggctcgcaatcgtgactgaaccaaatcctccctctcatcagccataagattgtaatactcatctgctgtgaaatcgttttgcaactccgttcgtcgagagccgattctaacttcccatggtaaaacagcctcatgtccataaacaggtttgtaaggaggaacttggatcgatccatgacaagccatcctataagaccataatgcttcggccaatcgagtatgccattgccgaggataatcagaaatcttccgcttgatcaacttaatcaaactcttattagatgcctcggcttgcccattagcttgtgcataataaggtgaagaattcaacaacttgatacccacgctatcggcaaactgaataaactcatcggacacgaagattgaaccttgatccatagtgatagtttgaggaagaccaaatcgatagattatatgctcttgaacaaattgaatagcatcccccgaatcaactttcttcaaaggaatcgcttctacccacttggtgaaataatcagttgccaccaatataaatttatgccctttactcgatggtgggtttatcataccgataatgtcaatcccctaacctctaaattgccatggtttaataataggattcatagccgacgccggtgctcgctgaattgctccaaacttctgacaatcctgacaccccttataatatctgaataaatcttccagcattgtcggccaaaagtaccctgcacgccgaagcaaccacttcatcttgtgagccgattgatgagtaccacagatcccttcatgaacttcaccgattgcaaccttggcctgatcggcactcaagcacttaagtaataccccatcaatcgtccgataataaagctcatcatccaacagtgtatagttcaatgccttatatcgtaatttcctagaagccgattgagatggattactcaaatactgatgcacatcatacctccaatcatcggctgacattgctgcaatctcaactttaacatctttgatcatcggcttataccccgatgccccttgggccaaatcattagcttcaagattttgttctcgagatacatgcttcaaagtaaccagccaaaactctttcattagttccaggcacttctcattataaaccatcaatgtatcattcttgcattcatattctccagccaattggctgattactagataagaatcccccatgatttcaatagtatcgtgatatgacca

SEQ ID NO: 32028 - DNA, 1501 bp, Oryza sativa
ttttattttagagtacaacgatataaatgacacggatgaataagtttaggaccgactgtataatttaccataacaaactcaggttatgcattaatcataactattattagaggatttgtgtaatttacttgatatttttttattgaatttcggttttctgaaagatcagcaagaattgttactgacaaccgacgcaccgtgctaaagaaagaggaaaaccattatcctcgagtgttgtgaacggatcgtgactttactcgtctatcaatgacaaggtcaaattgtacggtacgccattgttaaattgttttattccttaattatatgtctccattagattggtaaatgagtaatttgtctctactctctaggatctatgtgcactaacgtacgaagctaaggttgacatgatcccattatcacgtttataaagcatttttttaatgatattattgatctggaattcatgttatttcagaaagatgtggcggccgagatccaccaacttcactgaaaattatcgaaccacctacaatttcttttaccctaaaaaactttgatttttatattaattgaaaaaagtgccaaagaaataatgaacagaacttcaatttcagtcaaaattcccccccaaaagttctgaaccaaatttattttcttagtgttaaattatgtggccattttgacaacaaaagattatttttggtttaactatcttaattaacaaagtgtaattatccttaaaaaagacagcgtaattctacgaacattgaactccgtataattttttgcatcctttttcaccgggctcggcgaagcggcagccaattatttttaaggatcaatacattaacaagtaagactcttcacagtgctcctagctggagggttacctcgtttgtcagtgctcctagctagagggttacctcgtttgtcagctagttcaaaatctgatgtggatgaaaaaaaggtggcgggacccatatctttgctaaggaatgcatccctagctagggtacggtttcctcatgccaaaagggaaactgtgagtggtcccctcacatgcttgcgtgcatgggagggagagatggaagtgaaaagagagatgagtggggcctactaatatatataggtgggacccactaacatagatattgtctaagacacatgcattgtgaggtgtggttctctaaccggtttctagtctagctggaggccttgggctcctcaagtgcgctaccgcacttctactgccctaacaacaaacatggttgtgaagtagtatgaactactcccaagaaaaaaaggtaagtgtgtgctggtggaattatggcccaccagattttaaatttacatatacgggtactctttcaatatatattttgtaagatcagacacatgctacgaatctccaactttgtaagtgtgataagaggcggtcttcattaagtggtatatatactcctacattttgtgcaaccgaagaaaaaaaaactgggtc

SEQ ID NO: 32029 - DNA, 491 bp, Oryza sativa
gtgtagctttcctctagccgacgtacccagacgagggtgggcgtgatggagttgggtcggccggggtgtccgattgatcggcttccggattcaccgcggcacgagataggggctgcccgttgcctgctagggacgggggcgaaccctgaggtgtggtgcgatcggttagagggtgttatgcgaagggtcctgtcacgacctctttccggtatgtcgtggtgtcatgtcggcgcacggaaacgtgtggtggggctgtgtcttgttggtacagttgtacacctctgatcagagtaaaactattcgaatagtcgtgcccgcggttatgggcggtcgaccagattcaccgtgattagtcccaccttaataaatcgactcaatgcactgtagttcaggtgggttggttgggcctgttcaacgtggtgtagcgttgatcagtggagatttaatgttactttaattactcaacagttttattattttgctcaataaaa

SEQ ID NO: 32030 - DNA, 1501 bp, Oryza sativa
aaagtcggaagaggaaatcgggtttgaaagcagagcaggaatcggctgaaatccagatcggctacgataagatcggctgggtctgagtcgtgttgggtaagtcgatgtagccgattccgacaatacgacttgtacgcgacatcgggttcaagttaatgtacttcaagatgattgccacgcatggatagagtcctgggaaggcaattgtatctattaattaggatattttatgtaaattccttatagacaaaagtctgccgtaaagacttatggtatcttagagtttgttagagataatagtcgtgtccggtatgggcatatcttgtaatcctcgggtataaatagaccccgagccctatgtaatttttaatacacatgttcaatacaatctctgcacatcgccatccttttgctttagttttatttcgacgagttcttgctttcaggttgagctgcatcgatttcgatctacaacaagaggtaacattcgtcgtgatggattgcgttcttaggattagtgcttccatcctcatgacactctagtcctgtttatgtaattcatcaagttatcatataccttatataatctctaacgatatcgccatctaaactactatcggtcaatatctgtatgcagaaggcagccgattaggttagatcttgatgttgatctagattatataagatatctaccattctatgaaactgctagcggcttgattgtctagatatggttcttcttttcatacttaatgctgcatcagttgagtttgatctattaagtcgtgtttagaatatcgatctctggcctgccttctagttgccgataagaatagcatcggggtttcagccgatcgtatctgatttagccatatttattctacatgtctcatcgatatgctaaatctgcccttgctatcaagatattgctgcatctaaatatgttagggctttgtttgatatattatacctgctttaatatcctgatatgaggtagtatcggagtattagccgatacacgctagatctatctgatcggctacgctataaacatatataatcctgttattgatatatatttcgatctaagtgatttatactgtctcagcatggtgtccgatctatgccaatcactcgatttaagtatataccaatataaggagtatatatcgttaacatctacagccgatcgagtagatttagtgtttatttacttattcatgactgccgatcgatacacagatgacatcggcccaaagataaatgatatgtcatcggcatctagccgatcggctatcatttatagatttaaccacggtttcgttgcttttatttcttgttgattacagaatcaaatcaactggcacgctaatacatccgaaggcgagttttggacctgcactggagttaagcagatctcccaggccacgtgttttctgtcaacacgcttttggcacgcccagtgggacttgattagaagtcagacgtcagttcttcctca

SEQ ID NO: 32031 - DNA, 1501 bp, Oryza sativa
caacgcaagctgacattttttaaaaaatatatttttggtggtccaatatattaaactctaattttctgcctatattataagtgcagtcgatctttgtgaaaatgactagtcggctttgctgaatgcatctatgagaaaatagatagaggcacatgttgaactcaaacatgcatggggtgaacaaaataaatatgtacctctgacgacgtatctgctcctatttatttgcaagattatttcaattaaatgcaatagcgaaaagtccaaatgcaaccctaaactgaggccgagagttcctctagcatctcaaatcaatattaagcaagatactgagtccctgtaattcttttgtctgatccaaataacccttaattgtttcgcaaaatgattttgcttatgtggcatactgactcgacggttttgccacgtttgcatgctgactagaccactacaacaaaattaaaagaaacaaagcaggagctgaaatggctgcaacactggtgaccctttgagcagagatgaaagtgtgtctttatcactaatccaagacagctttcccctgattcaatctgaaattctttgacataacaatgctaaattctgctatttttcccttgataatggtgactaaacatcctgaaggaaaaaatgtatatgaaagtagtacaaacctgcaattctagaacaaaatttctttgatagcaatattgactgtgaatttgtgatttgctcataatgtctatgttgttaggagtttgataaggactttgcagagcaagtgggtgattgattttcacatatatggacacaaaaaaggtggctaggggagaagaacccttgaacagcaacacctctcccttttcaaaagtgcttggaagaatatcaccaccacactctaataagggacccaatacttgtgaccaaaatgcaaactaaagggcttgattaatttgattttactttattaggaaatatgaattactttactgcatgtacatatacaagtgcagaggactagactatttgttatttaaaatctaatattgactagctattttagcacaaaaatattatccaggaaaaaatgcagcattatcataaaatagttttagaaaataaacaatggttgtagatttatgtagtcactaccaaaaaccagattacttctgacagccaaaaaccgtcgagaaaatccattatcacgttaggaaaatacgtcctgactttgtaccgtcagggaaatcccgtcaagactggcttgtcagcgaaattttaatttgcctgacggatcctcgtcaggataattaatactagttaaatacagtgacaatgtatacagacttctgtatatctagttgaagaacagtcgagccaatcttaccaaccagtcctctttgtcaaagtttgtctcttggagagagctttgattcttaatcatcaactgccaaaatggatcattacaacaagcatattataatactttctagaagaggagatacta

SEQ ID NO: 32032 - DNA, 1501 bp, Oryza sativa
gtaatatttcttcaagtatttgccattgagcgctcgcccgtaaacttcaccatcaagcccttgcaacatatatgcccccttagacacaaacttatgaatttggaacggtccctcccaattcggcaaccacttgctaaatttactatcatgagtaccaatcggcaaaatcagcttccatacaagttcaccttccgaaaaatctttaggtacaactttcttattataatgccgagcaacacgttccttatccttagtaaccttcgcaagggctcgcaatcgtgactgaaccaaatcctccctctcatcagccataagattgtaatactcatctgctgtgaaatcgttttgcaactccgttcgtcgagagccgattctaacttcccatggtaaaacagcctcatgtccataaacaggtttgtaaggaggaacttggatcgatccatgacaagccatcctataagaccataatgcttcggccaatcgagtatgccattgccgaggataatcagaaatcttccgcttgatcaacttaatcaaactcttattagatgcctcggcttgcccattagcttgtgcataataaggtgaagaattcaacaacttgatacccacgctatcggcaaactgaataaactcatcggacacgaagattgaaccttgatccatagtgatagtttgaggaagaccaaatcgatagattatatgctcttgaacaaattgaatagcatcccccgaatcaactttcttcaaaggaatcgcttctacccacttggtgaaataatcagttgccaccaatataaatttatgccctttactcgatggtgggtttatcataccgataatgtcaatcccctaacctctaaattgccatggtttaataataggattcatagccgacgccggtgctcgctgaattgctccaaacttctgacaatcctgacaccccttataatatctgaataaatcttccagcattgtcggccaaaagtaccctgcacgccgaagcaaccacttcatcttgtgagccgattgatgagtaccacagatcccttcatgaacttcaccgattgcaaccttggcctgatcggcactcaagcacttaagtaataccccatcaatcgtccgataataaagctcatcatccaacagtgtatagttcaatgccttatatcgtaatttcctagaagccgattgagatggattactcaaatactgatgcacatcatacctccaatcatcggctgacattgctgcaatctcaactttaacatctttgatcatcggcttataccccgatgcccctggggccaaatcattagcttcaagattttgttctcgagatacatgcttcaaagtaaccagccaaaactctttcattagttccaggcacttctcattataaaccatcaatgtatcattcttgcattcatatttctccagccaatgggctgattactagataagaatcccccatgatttcaatagtatcgtgatatgacca

SEQ ID NO: 32033 - DNA, 1501 bp, Oryza sativa
gcatagtatagtctcatttgcataaatagcatttaataaatatttcagaatttaataaaacagtagagtattaaattaaacaatattaatccaacgctatacaacataccctgttgcataggcccaaccattctgaacaaccaacctcggctgcacagttctatctccaagccaggaatataccattccaaaccaggagttaaacaagttattaaacagcatcatttaatatggtaagaagtgtgagactaatcacgaaagacattgttagacccgcccataaccgcgggcacggctattcgaatagttttaactctagccagaggtgtaccactgtacccacaagacacaacctcaacatcatgtcaaccaagcgtcgcgatacttaacaagtacccgaatagagattgtgacaataccctctatataatacaatttaaagcagtgcaccgttcctggatcataatcacccccttataaacaaggcatggactccccagcgacccccgtgggcttatctccaccacttcacagcctggtgctctacaatgaaccatactatacagaaagtaaagccgttgctcacgctggcttgtggttggcatggttaatgtttcacaaccgaaaatcgtgaaccggtccttaattttcatgagcacgaccatcaaaaccatgtgctcacaacccaccattatcaggttttagttggcaaattaattaattaaccaatcacgattaaccatcgtgagctatcattaagccatcattaaataatagtgaatcataagttatcctaatagtgtgctaatgtttctaagcatggctaagcaattatgtctaatatctagctgaaccaatatataaagctcaactagtcaaattataataacccaaagtattaaggaatagagtaatcaagaacaaaagggctataacaaggcaataggttatttccacccaatgacattcaaaaataaatgcaatagttgaatagaaacaataactttaaacgggatcaacatgctcaaaggattgtttggaatctgtgtgacttgccttgctcgccttggaattcctcaaagtcttctcctgcaaaatcggactctccgggaacatcggaatctaaagagaaaagagcaaaaacactaaaacagcacataaacaagcataaaaagtacatgtggatatttttaacatgtagatctcaattttagaaaaatttagagacttgaaccaactaaatccgagctaagatgaataagttatgaatttttaaagattaaatcggattaaatcatttatatagattttaattgaattatgatgcaataatgaataattttttaaaaggaaaaggggattattgcgtcagtggctcgggttcacggtggaccgggtgcacagcggcggtctacggaaacgaacggccgggatcaaccctatccaaaacagacggccgagatctaatcggtctaccgcggctcacgggaaacgacgacga

SEQ ID NO: 32034 - DNA, 1501 bp, Oryza sativa
tgtcgagccaagtgttgagtagatcttattgggatcataatcttgatgaaaatgatataagcattgagcaaagtgttctccagttttttctgagtgctagccatgggcgtcatgtttttgttttggactaatgagtttttgaacatggactagtctcatctttcttggcttcacaaacataaaaatgaatggacagtaagtatatgctttatatgcgttgatgatgccttgattgagacgcgagacaggaagtatagttttatactagtatattgatcttgctgctgtttcttgtcaattgatttttccttttgtttgaatgcttccaaacatcggattatcaagcatcatccatggctacgcggccataccatgagctgtgacatgccagctcaaaatgttcaatctgccaaatgtcacccctggtgatctctgattgaaaaaaaccctgaaaattgtttattttccaactagaaaattctctggtgattcctaaattgttctgcatgaacatgattgcagcctgtttgtgtctggtgatttaccacagggcaggcactgtgtcgttctgatggtttcagggcatcatcaatttggatgttgcaaccatgaaaaccagcaagttaatactcctatgtcaggcatcagacctggaccctagattggtcaggcataaatgttcttgtttagtactagtaactactcctatgtcaggtatcataattccaagggccaattgaacaaaaaataatagacttgatgaatttacatttgagtagcaaagtccaacttttgccataggggaaagcaagcagtgcatctcatcatttttttagtgtattgaatgaatatgaatggtgttctagaggaatatcccttaaaaatgagaaatgaagttaacaaatacttagaaaagcagggaagaaaatggtggttcttgtcaaacttcagagattttttttctttatattggttcaagccttttagttcacaaacaaaaggagaaaaaatatttttgaaggtgcatatgatgtgacatgatattcctttttcagtgcacaagggggtgcgcacaccactaatcatggtgttattctgtagttctactgctaacgaatcaagcatgtgccacatgtcccatgatctggcaattttttagtgtcaagggggataagaatatgttctctggttctatttcacagagagatattataatttaataagaataatgagtgtaaaggaaaacataaagttatataagttctcctaattgaccttaataatagtggattggcgaaagctcattttaggtctctgatctatggttaagtttaaatcgcttaccaggttttgcagttgagggacgtggtttaaactcgatccttggtgagggacccaaagtaaacttttttctatgggattgatgttatgatttcggcccatagggtattgaggcccaacaggtgatagtctgtaaccggaattttggcccattaggcac

SEQ ID NO: 32035 - DNA, 1501 bp, Oryza sativa
tgtgaaacatttaccgtgccaaccacaagccggcgtgggcaacggctttactttatgtatagcatggttcatagtagagcaccagactgtgaagtggcagagataagcccacgggggtcgctggggagtccataccttgtttataagggggtgattatgatccgggaacggtgcactgctttgaattgtattatatagagggtattgtcacaatctctatttgggtacttgtcaagtatcgcgacacatggttgacatgatgttgaggttgtgtcttgtgggtacagtggtacacctctggccggagtttaaactattcgaatagccgtgcccgcggttatgggcgtgtctaacaatgtctttcgtaattagtctcacatttctcaccatattaatttatgatgttaataacttgtttagctcctggtttagaatggttaattcctggtttggagatagaactgtgcagccgggattggttgttcagaatggttgggcctatgcaacagggtatgttgtatagcgttggattaatattgtttaattattatttaactgttttattaaattctgaaatatttgttaaatgctatttatgcaaatgagactatactatgccatcctttgttatcctgtgcacttgcatatttgctgcgtggcttgctgagtatgtcatatactcaccttgcaatcattcatcagaggaggagttctacagtgatactgatggtgtggaggattaggcctagtcctggtcaagctgcctgtggagaggagtcgcttgcgctgtttcttttattttccgctgcttagaactttattgattgagaggaactatctacctctgtaatgacattttattcgcttattaattagagtaataattgtactctattatcaatttgttattgtgtgcctcggctgattcctggacgagggtttacacacatgtaagcgtttggaattttggatagaaattctgggcgtgacaagttggtatcagagcctccttgaccctaggttatgccaaatggttacctatagaagccctctaaaaatgttgaaaagtagaattgttctcctctctttctcttttatttaaaccaaactaatggcacatgcagtttataattcctttaattgttctcattcaaaatttatttattattccggtgttgttagtactgtacatctattactgtactaatggccatttaccagcaaaagttttataacattgttttatttaattttgctgcaataaactaagcttagcatattgattttataactctcttttattttatttcttttgatatctgttattcaaaagtgcaaagtttgtgatcctgtttctaactgtttcaacttatcttgcaagattggtttactttatttatttacctattactttgattttctaactttattcaaattaatccaaaaacttgtgctattaattggataaatgtcttaactccctcccttcactgtctttaga

SEQ ID NO: 32036 - DNA, 1501 bp, Oryza sativa
ggcgtaggataggaaatgcgatgtagtcctgtgtggcgactctccccggagacggtgatcgatggatggatacagcgatgaaagctgagtagttttggagacagatcgagaggctgattcccgtacattggaccgtggcagtgcaaggcagagcagatacatgaatctgattacgatttacgagttgccgatttcgtagctctaatttgcagccagccactacagtgaaatatagagaggaccaatagatgatagcagctgcagcctgcaggctcaactcctccaattggtcagataattatctcgacagaatgaacatggccagattcaacctgaccctctcccgcgacaccgcgaggccacaaaccgatcgaattggagggatattggaggaaggtggagcgagattcattcatcgccggtgacctcctagagggccttgaggaggaataggcattagggcgtggaggtggatggacgtacattaccattacccctgtcgatggccacaaaggccaagattagcttcatgtatgaaacttgatgattcatagatgagggacgttaaatgtactctttccatctttcaatgagtgtggaatgggtgggccgtaatgggcttttaggtcaatctgctagcaaattattacggtttcagcccaatacatataaatgacttagggctggttttgtttgaagctaaaacttatcacaccaaaatattggtatttttaacggtaattttggcaatgtttggtttgctgccaatactacacaaaatgttgtcaaaatggtgatgctagcaaaaacttgtctatgttttgtattgccaatattttagcatggttataaccaagcaagcctttgtagattttgagctcctcggatcgtattgtatgtgctagtagcccaccaccaccactactactaccacttatacagtagtcataagagtatgtaggccccatttgtttctgattatgatgcacattttagctcggtttttattagcatattttttaaaccgctaaactttacatttcatatgaaaatgttctaattgctataaaataccaaataagtcattttttaatttttatagcaattaaaacttaattaattatacgctcttacgtgaccctacttaattctcatcttgaactgttttatcaatttagccatagtgcaatactcagtactcaatcatttctattataatcgtagttgtgagtttatgtagttcactcctagtactctccgtcctaaaaaaacaaaccatgggttttcgtgtccaacgtttgactgtccgtattatatgaatttttttataattagtatttttatttttgttagatgataaatcataattaatactttatgtgtgacttgtctttttaaattttttttcatgattttttaaaataaaacggacggttaaacgttggacacggaaactcacttttttttttcgacggagggagtactctctaagccgagtcca

SEQ ID NO: 32037 - DNA, 219 bp, Oryza sativa
tcagtagtcttagggacgagcgagtgatttccaagagacgagcctctgcccccggccgaactcatgagaaagggggtctcacgactccccgctattgaggatcttccctcgacagctggcgcgccaggtagggggcggttgcgcgtttcgagaggaaatcgctttcttccgtccctagtttctccaggccttagctgaccatggtcgaggtcctggaag

SEQ ID NO: 32038 - DNA, 1466 bp, Oryza sativa
gcgcattttgtctaaaggagtaatgcgaggtttgaaattgaggagaggttgatgtggccacgtggcacgctccgattggcccaggaggttttgacttcagttattcttggtaattaattttaaggggcaagaactatttcatgatattaaagtttgaggggtaaatttgaaccagaccctttgcttttatttccttaaaagtgcctttcattaatgcctctcttctgaatttttggtttcataataacggtgaaattgggaacaatgaatagggggttttttgggggggggggtaatgggttttcgcccattcttcacccaccaaatcttttggtaataagttcttttaaaagtaaattagaaaacttccggaactggtttactattaccccccctggaagagaacccaaattggaataagaacctattttaggttcctttgtaaaacaacaccctttaggaagtctacaagctagtacttactacatgacagggaattgttgttccttggtgatcaaccattgccgatttcaggaaaaatcttgaaagttacagaggaatcagtgtagcaatcaagcatcttttcttaggctttttcgccaagtgaggctggcaataagaattgctttgtgatgcagggattccaagaacaaggaagaggcaaggacgtggtgaagcttgaggagattgggacagccatgataagcctggaggaatgctgctgggagatgcaactgcagcagcagcagaaaaggggggcaactcagcagcagctggtggttgtccccatcagggtgaggaaagatggatgggcaagtgatgccatgctttatgtaagcaaatatcttctccattttatttgcctcccaattactatatttctagtgaaaatgtttggtgtgcatttttttaatgagttgtatgggtgatgattgatttcaggtgaatgtggagcttgtggacgcgaacacgccttctgagaacatcggaaggactgtttcattcagggagagcagggcgaggacgacgactccggcaccgacaatgcgggacaataggaagagcttggaggcagggacgtaccatgaggtccttgacctgaagcagctgcttgatctggctgacagggagcacaaggtggctgtgtacagcaggagcaagaggaattcggacagcagcagcgtcagcagcatgagcagtgtcagcagcagcagcaccatcagcatcagcagcgccagctcgagcggcggcgccagcccggagcccggcctgtcgtcgaaacgccggcttctaccgtggaggaggaagagccgggacttcgacaagaggagcagcgagtcgctctcccaagaattgcccatgaaatacatggtgagaattggattagcattttttttctgatcatggaatcatgtttgcattggcaatggtgaattggtgattgatcgagatggtgatctgtgtct

SEQ ID NO: 32039 - DNA, 1501 bp, Oryza sativa
aaccctaatgtttccatcgccgtcgccggccgccgtgggcctccaccgtcaccccctagcccctataaaggacccccgagctctcctctacccgccgccaccctcgcctcgccttccatggccggtagagctctagcaccgtgagctcttgcaccgctgtcgctgccgcaagtccagccgtgcgacgccgtcgctccggtcgtcatcgtcgcttgggaaggacaacgccgggttcaccaagccgtcgccgtcctcgtccacccctccgtcgtcgccgaggatcgccggaagaccgccgtcgtcgtcaagccgaccgtcgccgccgcttcttcctcgtcgccgtccgccgccgttcgtgcctcggtaaggatcgctgcatcgtccactacgcatagaggccctccgtttgcgccaccgcgccgttgttcgccggcgagcatgcgcgcccgagccgccgccggtggtgacgtcatcgccgacgtcatcgtcgtcgtttcccgtgagccgcggtagaccgattagatctcggccgtctgttttggatagggttgatcccggccgttcgtttccgtagaccgccgctgtgcacccggtccaccgtgaacccgagccactgacgcaataatccccttttccttttaaaaaattattcattattgcatcataattcaattaaaatctatataaatgatttaatccgatttaatctttaaaaattcataacttattcatcttagctcggatttagttggttcaagtctctaaatttttctaaaattgagatctacatgttaaaaatatccacatgtactttttatgcttgtttatgtgctgttttagtgtttttgctcttttctctttagattccgatgttcccggagagtccgattttgcaggagaagactttgaggaattccaaggcgagcaaggcaagtcacacagattccaaacaatcctttgagcatgttgatcccgtttaaagttattgtttctattcaactattgcatttatttttgaatgtcattgggtggaaataacctattgccttgttatagcccttttgttcttgattactctattccttaatactttgggttattataatttgactagttgagctttatatattggttcagctagatattagacataattgcttagccatgcttagaaacattagcacactattaggataacttatgattcactattatttaatgatggcttaatgatagctcacgatggttaatcgtgattggttaattaattaatttgccaactaaaacctgataatggtgggttgtgagcacatggttttgatggtcgtgctcatgaaaattaaggaccggttcacgattttcggttgtgaaacattaaccatgccaaccacaagccagcgtgagcaacggctttactttctgtatagtatggttcattgtagagcaccaggctgtgaagtggtggagataagcccacgggggtcgctggggagtccatgcc

SEQ ID NO: 32040 - DNA, 1501 bp, Oryza sativa
ctatccatgggcaggttacgagttatggccatgcagcaaatgctgcctgttccttgactgctccatgaaatgcaaccggccaactgctcacgtttgtgaaatgttctaatgctgattaatatatttactatcacaggttgaaattgctgtggatattgaaagactatccaacaagagtacatctggtaattgtggaccattacagccgctccagtctgttgatgacaatgtacggagtagaggtttgtcagagcacaggaatggtcacaatgatgagctagattcttatattacttcctttgtccaaatgtcattggcacaagccaagcagatggttgacgaagccatgaaggtaggttaaagtttagctgatcaattccctcaaggtatctaattttgcatttctcactcaatatgttatttgatgttttgccaggaaatctctgagaatggtaaaagttctctagaagaaacaggcatatcaaatgaagcgacggattgtacaggcccagaaccggaatctgctgctaattctgaacttccgcgcaacctgatattcaactgcattgccacgcttcttgcaatcaaggtaaaacattcacctgcttcactagcactaatcctccatggttactagaattattccaattcagtacatcttccttttcaattatgcagcattttagcgagggccgacatccacctcctaacatagcaggcgtcctggagcgtgcttgcttaatgctgcgaccaagctgtgcagagaacctgcccatctataacgaaatagagaattttatcgctgtcataaagaaccagatactagctcttgtgccatcggcatcaagcaatgccaggctacccatgtacatgtaaatacttccaggcttccagcagacgaagaggcggtgcctggttgcttgatgtcgagaagaattgatgaatccatagcgtctgggggaggtttgaaaatgtatgagcttggatctacagcatcagaagacggcgggtcatcgttgactgtccagctctcttctaaactgtgtataaactctttagaggaataagctcttacagtttttagtttcatagatttctcaatatggttttaggaatggaggaatcgacattccagttgtagttaataataacgattcctacagtcatgaatacattgtccagttgattcacagagaacaccatcttgatagttaatagattttacttaaatgaaaaaaccatgtgtcacagaaggaaaccatgtgtcacagagaagaacaccatcttgataaacggggtcaaataagcccctagattttactatatgtaaataatgtgcagtgagtcctgggcatgcttacaaaatggctttgacaggtgagatgaaatggaccctattcctgcctccaaacaaaaaaaggtaagacaaaccatgaactctgttttttttttctgtaaaaatttcctgtgtctgcctacaataatatttactatccaaaaa

SEQ ID NO: 32041 - DNA, 1501 bp, Oryza sativa
ccatcttcgttgtcggagatttaggtccggttgggtgaagatgtatttcagactcttgtggtccgtatatacttcgcagcggttgccaatcaaatagtgcctccagatcttcaaagcatgaaccactgctgccaattccaggtcatgagttggataattcccttcatgtggacgcaactgccgcgaggcatatgcgaccactctgccctcttacattagaacacatccaagcccgtggcgggatgcgtcgcaatagacttggaagtctttcatctggtcgggcagaatcagaactggggcggatactaatttcttcttgaactcctcaaaactcttgtcacactcagctgtccatttaaacttctcatctttcttaagcaactgagtcatgggtcgggcgatcctcgagaagttttcaatgaatcgacggtaataacccgcaagtccaagaaaactccgaatttgcgacacggtcttcggtggggtccatttggtaactgactccacattcgacggatcgactgccacgccctgagctgtgatgacgtgacccagaaatttgacttccgacaacaagaagtcacacttgctgaacttggcatataactggtgctccttcaacttctcgagtaccagacggagatgttgcttatgttcttcttcagattttgaatagataagtatgtcgtcgatgaacaccacaacaaacttgttgagaaattccatgaacactttgttcatcagattcatgaagaatgcgggtgcgttggtaagtctgaaagacataaccgtgcactcatatagcccgtaccgagtggtgaaggccgtctttggaatatcctcttcccgaattctcaactggtggtagcctgatcacaagtctatcttagaaaacactttagctcctttcagcttatcaaagaaatcatcgatccgcggtaaaggatatttgttcttgattgtgacctcattgagtgcgcgatagtcgacgcacatcctcttcgtcttatcctttttctccacaaaaatgaccggtgcaccccaaggtgaagtacttggtcgaatgtaccctttctgcagctgctcatcgacctgcttcttgacctctgctagctcgttggccgccattctgtacggtctcttgtaaataggggcagttcctggtgccaaatcaatccggaattcaatctctctcttgggtgcatggtagtgaggtcttcagggaacacttctggatactcgcagactatggggatatcctccaatttccgcgaacccttctcctcggtggtcacagggttttccaccttaatctgattcaaggaaaccccttgctttggtgagactagtgacttgtacaccacggtttctcccttctcattggtcaaggtgactgtgcgattcgcacaatcaatgacacccttaaacctggtcagccaatccataccaagaatgacatctaggtctttggattcgagaaggatgaggttggccagaaaga

SEQ ID NO: 32042 - DNA, 1501 bp, Oryza sativa
ctacacattgttgctgagttggatgatattttaagagactacaattactgggtgtcatctaaaaagtatcaattcatcttacttttagtttaaccttgcttgaactatttggatcctcgtcatgctgtcgatcgtcatacccctttattgtgatcttggtaattgtgcgagaaccttttgctggacccatggaaattttccttggcttgttttagagagaaaaagacttccttgacttgaggcccaacaaatattgctgcaagtgagagagaaagctcactaacactatgtttcccaaaaaaaacaaaaaaacaaagaaagctcactaacacaataattagtgtagcatatatacattggactatagactacaacgaaaactaaaacatgaactatattactcctagtaagttatattaatctagcttctaagtttcacatcctaactctaataatgcaaaataagactttgcaaactaaactaatgccaggctgcaaagagaatgtcaattgtccaagtacgaaatttaaacaagggtcagattaaaacaaaactcatgatgcggcccatttagtaatcagattaagcaagtcatcaactgtgacaaggacttcataaagaaaaagattccgggcagccagtagaaaagcaagaaactttggtaaaatcttcacataaactctgagtagaacattataaatatagccaaaaatcatcgaaatttacacataagctatatttgacatgccaacaaatccaaacatcaagaaatataaaattgccgctcagtccacatccaagtaaatagacctttccaggggacaagtcatagcgaaagcctggactttgcagaaccaacaataaccaaacaaacactcgtgttggttcaaagcattgcatggaacaagttagacaagccagtgagtagataacggaattacggatccccaaccacgagatgagaaatatggtgggaaatgaaaattctctgcagcagatacctaattagagacccgattagcgaggtaaaggtggtgtatgacgccaaccggagaagctacagtgaagaacccccaaaagtcccacgccgccgcagcacaagtcaaggaggaggaggggaaggccaagcaaaatcgaagccacgatcttaagggatactaccagagatgaaatccggtaagcgtcgcatcggggatcacggcgcaccaaaaaaaaaacagacagattcgcagcagaagaacgccttgcgcgatgaacttggggagggaaaccaaatcgtcttccagaaatcctgaaatccaagcagacgaagcaagcatctgctcggggggagaaggagaaaacaaaccacccacccaaagccgcacctcgcagttctcaattccccccatccacatccactactcttctctcgaggactaacactagaggaaaaattttcgaaaccccccaacgcgagcaaaccatggagagagagagagagaggggaaagccgcacga

SEQ ID NO: 32043 - DNA, 1501 bp, Oryza sativa
ggaacgtaccgggtgtacggttttccgctcttgcacttaaggaccgtttccttggaatttcatccaaacataagacaagtacgaccacatgggtggaataggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggttgggtgatccgggttagtaatgtcgtgtgggtaaagtgtaccccctctgcagaggttaacaaactgttcgaacagccgtgcccacggtcatgggcggatgtgaggtgattcctagcgtagttttgcttgactactgcttgtgaaattgctgttgtggaaaggggttcgatgattgaaaaatctgtagctgatggaatcagctaggcccgggtggccgtttgaaagttgttggcccgggtggccgtttgaaaagctgttggccgggtgccaaccttgattcaaatctaaagactgatacattgcacatactccgaccggacgagacgcactgtctcatccgtgtcatttgagaagcgctcacttagttgatttcagaaaagagttcaaatgaaatcaattgcaaaaacaacagcctttccttgaagcctgcaataaacacctatttcccatggcatgctgagtactcctgtactcacccttgctctatataaataattccccccccagttgctgaagaagatgaagcggatcccgctgacgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgataatctgtcttcctatgataccagcactgtttcctgggtctggtatcaatttacaggttaatttggagcgtcacgggctagttccggtcggtactagttcggggcgtgacaagagatggtattagagcacaggcttggccctagggcgaaacccgacgtttaggacgaccctaaggatactaagttcaaaactacttgcgaaaagctaaggtttcttttgttttctttatttccaatagtttgtttctaaaatggttactaatattttctccctctttcaaaattgtagatggcagtgaacgcaagcgtcagctcccacggttttggtgagggtcaccacgtcgctcagcttcgtgacctcgcccgtttccttggcttctcgtgtcccgagtacacggggtactccgtggaccgtgttccccctcgctg

SEQ ID NO: 32044 - DNA, 1123 bp, Oryza sativa
cgcgcaggaggaaaacttatgccgagcagggcaattgtgatatttaccgaggcgcaagtaaatatttgtttgagataaattatgatgtcatatgacttgtttgtaaaccctaattgcgatgacatggtgtcatacaatcagtcctctctaaataccccgggaacgccagaactcctatcgctgctgataacgttacgttcagagcatatggggactagagttcatggaacaggtgccactattgttagtaacctaatgctgggctatgactaaagctgatgattatcgacaagtcgtgggccgtgggtaaagcgtacatttactacagtaaagtataaatgaatctattcgaatagccgtgctcacggatttgagcattggcactcatatggtatttggttagaaacataagtccaaactttattaaatattgttgcatttaaaacattacaggctttcttcctctatattctttgctttctgcaagtaaacctagctctacacagatattaccattccatgcattcattgttgattaatataatagcttgctgagtacgttgtactcacccttgctttaccccacctttttcagagtcattttggagttcttatcgaagccgggagttcaatcacataagttagttccctttaaacctagttttcaagtatagattagatagatggtttaagtctatagcaaaacattagagttggctcatcctatagcttctactgtaatagttagccacaatcttgtaaataccctattactttatgtaaagaaatcttctttggagcattgatcaaatatatgcaatgaagatccagattgttgaacctgtatcaatctactgatccagggcttgatacagttttaatatgtcggttaccgaatcattagttttgggaccagacataaattaagcagaattaaaaggaaaaatcatgaaaaaaataatgagggagtagtgaggaatcaatttttacaatcaattggaggagggaacgcatcgggagacagatacatggtgggttcggcccggcgaccaaaaaagtaaaaaacaaattcttatcgcgtgtgaaaaaagaaacacaacattaaaaataattgtcgacgagt

SEQ ID NO: 32045 - DNA, 1501 bp, Oryza sativa
tcgtcggggtgggggtttggtgcaatctgtgggggtgagatgcggtgcggggggatgaagaaggcttttcggggtttgggatgtcgcggggatttgggggcggtgggtggtttttcggctgggaattcgcggatttcgcggctgctcgtggtgttcccgtggtttttacgagcagatgtatgcttgatctcgtgcggctttcccctctctctctctctctccatggtttgctcgcgttggggggtttcgaaaatttttcctctagtgttagtcctcgagagaagagtagtggatgtggatggggggaattgagaactgcgaggtgcggctttgggtgggtggtttgttttctccttctccccccgagcagatgcttgcttcgtctgcttggatttcaggatttctggaagacgatttggtttccctccccaagttcatcgcgcaaggcgttcttctgctgcgaatctgtctgttttttttttggtgcgccgtgatccccgatgcgacgcttaccggatttcatctctggtagtatcccttaagatcgtggcttcgattttgcttggccttcccctcctcctccttgacttgtgctgcggcggcgtgggacttttgggggttcttcactgtagcttctccggttggcgtcatacaccacctttacctcgctaatcgggtctctaattaggtatctgctgcagagaattttcatttcccaccatatttctcatctcgtggttggggatccgtaattccgttatctactcactggcttgtctaacttgttccatgcaatgctttgaaccaacacgagtgtttgtttggttattgttggttctgcaaagtccaggctttcgctatgacttgtcccctggaaaggtctatttacttggatgtggactgagcggcaattttatatttcttgatgtttggatttgttggcatgtcaaatatagcttatgtgtaaatttcgatgatttttggctatatttataatgttctactcagagtttatgtgaagattttaccaaagtttcttgcttttctactggctgcccggaatctttttctttatgaagtccttgtcacagttgatgacttgcttaatctgattactaaatgggccgcatcatgagttttgttttaatctgacccttgtttaaatttcgtacttggacaattgacattctctttgcagcctggcattagtttagtttgcaaagtcttattttgcattattagagttaggatgtgaaacttagaagctagattaatataacttactaggagtaatatagttcatgttttagttttcgttgtagtctatagtccaatgtatatatgctacactaattattgtgttagtgagctttctttgtttttttgttttttttgggaaacatagtgttagtgagctttctctctcacttgcagcaatatttgttgggcctcaagtcaaggaagtctttttctctctaaaacaagccaaggaaaatttcca

SEQ ID NO: 32046 - DNA, 1501 bp, Oryza sativa
taaacttgaaccaaactacatcatctgtctttcaaaaaaaccaacttctgatctagacatatactccctccttccctaaatgtttgacgccgttgacttttttaaacatgtttgacaattcgtctcattcaaaaacttttgtgaaatatgtaaaattatatgtatacatacaagtatatttaacaatgaatcaaatgatagaaaaagaattgataattacttaaattttttaaataagacgaacgatcaaacatgttttaaaaagtcaatggcgtcgagcatttaggaatggagggagtaatatgcctatattggtaattagaatttaactttactttttttaaggacatgaggagtatcaattagacaataatcttataaatcatgaaattaaatccgaactcatggttacaaatgttgttttggttgctccggaacattgatatggctctcaacgtaggccgaaactttacttccagacttctctataagcccctgcaatcgaaaattgaaatttgtagatatccattcttcgacccgagctcccccaccttgattccctcgtgcagtcgataaggaggatgatgataccgtggtgctttggacggtgcaattagttctaccatagattctacacccatgaccaatagcacatcgcaccaaaagcatctcgacatgctgatattctttgatcatcgcgtagacaacatgagggcttcgatgccctaggcaattacgattacatattgacatatgcaatttacaagattgagggtataaaactaacacatatacaaattcaaatactgttgaggtttatctgacagagtttcggctcctaaatttgaccaggagtgaagttcgaaggaatctgaatgctgttttgcttccctagttaatttgtgggaatatttcatctcacttcatttccttttgatagagataaaaccgtttgatcgagttccaatttgagaaaaagataggttacactttttcccattactgagatatttaactactctctgtcccaaaataaatatatctatgctatctactattaatcttaaaataaatttattttagaaaaaacgcttgtatcggagtttgtaaaaatatattaaaaaagttgtattggaagtagataaatgataaataattgtattatgatttggtaaagtaaggtttttctagttttaaatttttcatatttatatttttatatggatgtggagcatgggatgaatgaaaaatgagtttatcttaaaatgaagacaaatgagtttattttcaagtaaatgcatgagcagtagtcgaaagatacggccccatcgtttcgtttattcgtgtaataagccaaataccatatttttaaccgaagagtaactgtgaataaaatttttatatacgtgctcttagcgatctaaaagcaaatattaaaaaatgaatttcgataaaaaaaccctaaaatcagctctaaatttaaagttaaaaatttaaaatt

SEQ ID NO: 32047 - DNA, 1072 bp, Oryza sativa
cactagcgtcgactatgtcttgatgatctgcatacaaaacaaatgatcggaccctaggtacaagagcgaccatactattagtgtctgcatcacacttaaccctcctcaacccatcatttaattgtttgccaggaagcaaccagtaaattttggtgttatcagatttctcatatcctagttcttcaatgaaatcatcaacccacaacagtgaccaagaatctgactcacaatggtcaaaccagcttactctaccatcaacataagcccggtttacactatctcctgatttatctccttttgttgctaactcaattggcagtaggctatcgtgaaactgatctctagcatgggcatcatcgtgggctacaacacaaaagaagattcggaggaatcggaagatgtatgaggggttatttacaaatatgtgtagccaactcacgcccccataacgtgtgtatgcgccaatgtggcatcctaatcacgagccaactcaataagattggtgatgaagtcatgtcttggccttggttcgcacgcactacgcaagtttgtgtaccgaaacgagagtttttcaagtttttacactaaattgcacccaccttacaagtttgtgtaccgcgggcgcaatttactcaaatattaactaaagtccctttttctaatcatggctttcatgagccttaaacccaagtttttacagacaagtgacaggtcgatgaatcaggtcactgtaagagcctgtcaatacattgtgcagagcgtgcagcatcagtgcaccttcagccgtggcttatttctatgggacactatgtcaaaattttgtcgaaatgctgtcgtaattttattcaaattttggtcaaattttgtatctgcctagtatttgtgatttttatttgttaaaatataaaaacatcacaagagatgctcacatttgaattatttataacactcacaaagctgaaaaaatgggggcaaaatcacacaaagctgaaaaaatgagggcaaaactacaataaccaacaagggtatatatgtcattttctctataactaacaccgttagttgtggctgt

SEQ ID NO: 32048 - DNA, 1501 bp, Oryza sativa
ttcacattatttttcagaatatttttaacatgtatatatccaacatttttataatccttaacatatattcatgcatataatcaaagtgcgggatatcatgtatatttcatttacaatctcatacagagtctattaaatgtatttatcttagaacatagtttgacaaactatttttatttgttgttagtaactaatataatttttatttttatctcgattattaaaaaaatttaaaagtcacttaggaatttccgtagaaaagcgcggggaatcacctagttatctcatagctgttccaaagattgaaagtatattgtaagatacacgacgctagcaaaaatagcggcccagaacatggaccggcttgtaaacatactggaccaatatgcaaaggaaaaagttcacctgccatcccttacaccgagtttgttagacatcccttatcctcaatatcagaaaccggcgatggtcggcgctgctccaggtattatccgggacacgatggagcgacatggacggtggcggcggccggagatggcgccgctgcaaacccacgccgccgacacgagccacagcgacagcgacaggagaagaagaacggcgtgccggcgctggggcaggaggagcaggaggcgtgcacaccgcgtgtgccaactccctcttcgctgcaggagctcaccaacgacgccttcagcggcgacgaaagaaaaaggaataagaggatgagaaaaataacaagagagtatgggagattgacaagtggacccatgggcaaacttgtctttaaccaatatttctctctccgttttatagaaaataataaattaatcccgcgggtgtccagcaactaattaccacatttttacagtgtccacgagtagatttactttatttaggtgtctcacaacaaaggtcacaaattttgagttttctatagcaaattttgcctaaactttatagtatttgctctaagtacggtccaaatcctgtagttctacagtatttgtaaagaaattcaaatgcaaggaagaaaacagttaaacagttgaaggttgtatttgcaatttttgtagatgaaaggggaaacgctagtctgtgtgacacgtcactctcgttccggctcggccagtcgccgacggccaacctcgcctcccagtcgctcaccgccgctcgcttcccggcggctcaggcgggcgcggcgatttcgctttactccatataacgccgctgcgggccggcggccgcgggcgtcggccatgtccccgcatggggctatgggcgtagcggcggctgggacgccgctgaaggcggaggagatggccggcgggtgtactggatggatctccgtcggcccgtcggcgacaggatggaacggcgaggtgaggtccaaccgcccaaattttctcttctttttttactttgtcttcaaatctatattgagagcacttactgtttctgcgatttgcattcagtgtccatcttggagctacccttagaaatt

SEQ ID NO: 32049 - DNA, 1501 bp, Oryza sativa
ttgtccctatagctttcttcggattgtgaaaaatagttactctctctattaaggctttcctagaattggaaaaaagtttggggaaagtcaagagcttattcggttcacaggattttcaaatcacaggaataggaaaaacgtaggaataatgtaggaatgcacatgcaaaacaaaagattggaacacatgaatttttcctccaccgagctaaacaaaagtggatagattggatattttcattcctatggaattagtacattttgaaggattggcatagtgttcctatgaaaaatttttctttgaattttacaaaccgaatgcatgaatagtgcttattccaaaggaattgagatttcctttaggaatccttcaaaacgaataaggtcttagtagtttgaaattttttttgaaagtttatgtgtgtaggaaagttttggatgtgatctgatgcgatggaaagttgagagttggggagaagtttggtgtgaactaaacagggcctaaattggtaatttggactactgattgcttcatcagtttattagtcactaatctctttgggccacagtaatcacccacaaaccaggaagtatacagaacgagaccacggaacggaatgaaacctgaaaaaaagttggccatgccacagacgtacatacgttacggtcacacgctatcccagtatcccttcctcttatccatgccgttggagcggcacaccgcttcggccgcgcgcgatatctatcgccactcgccacgccgcgatcgcgagcgcactcacgccgccgcggcgccgctggtatgtacaccccctcccatctctccccgttgtattcgccacccgataaaatttctactctttttttctttctatcaccaccacctggtcattcatgtgtacataaaccgtactataatacgtaatacagattttacgggtatatacctacgggtacagcagcagaagctagcgtagatttgatcgatgtacgcaaaaaaggaaaaggtatctgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactctttcccatatataaggggggtccgggtgcctctaggggcatgtgttgattatccccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacagttggcgcgccaggtaggggtccgtcaagcttttcgccgatcagtgcaa

SEQ ID NO: 32050 - DNA, 268 bp, Oryza sativa
tgattcctagcgtagttttgcttgactactgcttgtgaaattgctgttgtggaaaggggttcgatgattgaaaaatctgtagctgatggaatcagctaggcccgggtggccgtttgaaagttgttggcccgggtggccgtttgaaaagctgttggccgggtgccaaccttgattcaaatctaaagactgatacattgcacatactccgaccggacgagacgcactgtctcatccgtgtcgtttgagaagcactcacttagttgatttc

SEQ ID NO: 32051 - DNA, 1501 bp, Oryza sativa
tccgaagtatctgaaccaaacaggcagatcactgggtctatgctttaagattacaagataccttggaccattttctgcagtgcttcaatagcaagtgtgtcagacatgacataaacaggagttcgtgtcatgatcttggaggtgattgtttgctcaacccgcaacccctctgcaatcacccttttagctatgtcctgtatccaaattaagcaaataagaaacgaaacgataaagaatctccttatctcctttaagctagaagtaccagccatgtcctatatcccaattatgcaaataagggcgaaaagataaagcatctactttaagctttaagtaccataagcataagatactttggcatgtacttatagtattaaatcattgctgtgatttgtacaaacttacagtcgaacacataacataggcacccgcaaagaaaaaagaaaaaaagaaaacacaacatggttgggccgcagtcgaatacataagaagcaaaatacataaataacaattgattcatggagcattagtcaaagtatttaaactctcaacgattcattattgaacaagtcagatgtggcaaagaggagttgtgcagtcctaagaaaaagttgcaataacataaagcgtccatctttaagaaatctaggcacttgatgtagacacaagcaaaactctatatggagtttcgtagagtacaattataccaaaacccacttattagccaatcgcaaccacctccagcttagaaaacacatcacagattgatttgaaaaataaaataagaagaggaaaattactttatcggtgacgatgccggagagtaatccgttggcgtccgtgagcagcacggcgtccaccctcctcgccgccatccgctggcaagcctccgccaccgtcgtcccctccgggatcgtcaccgccttcgtcagccgcagcttcttcaccgtcctctcccctctgaagaaaaagaagaaaaaaaaatccaatctctgtaaggatcaaaggcggcgaggagagagagagagagaggcaatcttggtacgcggcgtggctgggggagggcgtggcttcggcggtggagatagcggcgaccgcggcggcgggatcatcggacttctgggaggaggccaccgacggcgggcggctgcgggtgcggcggttcagcgccacgccggcggcactcatggcttcgtccgccgccgcctccgctgctccggaatcagcgatgtagttggcagtgggcggagagagggatcgtcggcggcggtggcggccgccggaaaaattggagggggggagaggtggccggttcgactgggctcccacacgccacgattgatgaataccccacgtgggagttttttcacatcgatctcttgatgacgtgtcaatgtcaggtgggtcccacacatgcacttgatgggaactaataaccagatggaaaaagtccactttgaccgaatctaatagccgaatctaattcgtacccctcaactaa

SEQ ID NO: 32052 - DNA, 1501 bp, Oryza sativa
ctgatttttttatttcatgaaactcaaaaaaaatagcacatagtttctaatgctatgcaggttcataaggtccaaagtaccggaatctctcccttttgtggttgttatagcgagaccttttcctaatttcgtccaatcctggatcttggcacctaaccttgataagtatgcttgcttgcattaataagggcttctctgctctgtgtttattttcttgttatttggccaatgccctttattcttgacatgggacaaattgaagaacaacacaagaaatcttcaccttaaccaactacttcatattctccctctttttttgtcacatccagtcacattaaaatctcatcctcaattttatactgtttcaatctgaatattcttagtcaaagcagagcaaactagtatctcaaatgaatcttgaattttctttttttaatcttgggaggttagctgaggttgcagtgtgtttcttatcgatttattatttgatctagacgagctgacaaaatagactttccacttcaaatcgctctcattacgtttctagaatttttttttgtgtggcaacaaacaaaataacataatattattccggacgttatgaaaggacatgtatggaccaaagtatgcttttcttaacgatgacgtcagcatacacctcggacactgaggtcttagtttcacatcacaaaatgaaagtttctctataaattgttctggtccaaactaagaaagcaattaatagctactcaatccaatctaatctcgaaacaatttcgataatatcgatgccatcattttgcttctagatcaaacaaaaaacattttttttacccaatttcttttgtggcatggcatacacgttcagcacaacattaaaaaaaaactcactctctgtctatttttaaaaacaatttcaggccatgaagaaaacaaattctcttttccaatcagttgaccttgccaggataaaaaggcaggtgcagtggcaaaaatgcacaagcaaaggtataagattcctgatatgaaccatacaaacatgattttcatatgcaacatgatgttgacatagataatattaaatatcactaatagcatccaaagaggagagactctctttcagattcctgtggattccaggtgcagttaaatagggcagcagcagcagcatctatagtagaatcaatgtatcatggtgccccagcatttggattgaattgtcaataccataaaaggagatgatgccaatgtgtgtgtccccttccattggcaccaggtgttagctcctcagctagttgcttgtcccacaccacatctttctttctcctcccttattaagctactagatgctgctattgctacatctccacatgcaccatcttatctcaactccttagaattcccactcctcttcttcttgttcttcttgcttccctccaacttcttcttcttgttgttcttgctgttcttgtggttcttggcctgccatcggcggcgagca

SEQ ID NO: 32053 - DNA, 1501 bp, Oryza sativa
taccactgacaggtggcccccaccggacgcggccaatcaggagaaacccatgacgcgctcgagtgtaccacgtccgcaccttttgttagactgatgtgtgggcccccatccagctcagcatctgatgggccgccaccagcctgagctggcgcacacaaaaggcacaccctgttttactacacgaactcatagtgtctgccttcccgtgtccaatttcaaataaaaatgatttttctaaatttcattatatatatatatatatatccattccttaggtccctcaaacaattcacacagtcacactttacaaaactataatcccttcattcgaaaataaatacaactttcaaaccaaaccacatatgccaatacattaaaaaagagactatactaccctattttatcaaacctcaatataattatttttctcttttatctatactcatttaaaaaacattagtggtgctggcagtgaatctgtcaccgctatcccaccatttcttttgtagttcaaattagccattgatattttttgatattatggaatagagtccaatatttgtttcaaacaagtgaatatcatatattttaataagcaaacaagtgatactaacatttgtgataaaaaatgtattttgtctataacatattataatatactagtatattcttttacccatataaagcatgagtagtttgctagtctactcaaatgcatttgtagtctacttgcacaaactctgatatgattaataaaataaacttatttcgagataaataggaggaacaaaaaatgaacttattcttatatggaaggtgcacgtaggctcctcacagaataaatatatataatgtctaccaaaatgattccaaataaaaccccaaaaatgatggtatgaaaaacagtttcgaaaaacgactttttattcataatggccacaaatatctcgtgtgctagatttagcttgaacgattatctaaataaaagatttagcttgaacgacaaatacgtcaaaattggcatgaaaaagaaggggaaaaaatgtttaatgccttccacggggggtcaacccgtttggtgcccgtagcaagcgacgatcggcccaagctgtcacaagcgcgaaaacgctaaccccacacaccaccggtcaaacgcgtgaggaggaaggtcattgacaggtggggcccaccttcaacgggtggatcccatgaaacaggcaatccaccctccctctcctctcctctctctcccgccatattctggtcacctccggtgagctcaccgccgtcggtggtttgcgctcattctgggcaagccaagccaagccaccctctcctctctctctctctctcctctcgcggttgtatatatacgcgagcaaatatatgcgaggaatttaggcagcgaggagagagagagagagagaagaggagaggttggtggcagaggaggaggaggaggaggaggaggagaagcttctagaaggggagcggggcggca

SEQ ID NO: 32054 - DNA, 1501 bp, Oryza sativa
gtgtccatcaaacttgttaaaatgtagtccaagatataccagttgagatagatttgataaggacgatggaataaatcctatgaaatagttttcatataaacctaacatttgcaactgtttaagatttccaagccattctggaagggtaccagtaaagtcattagttcctaatgataaatcaatcaagtttgagaggtgttcaatgccagaggggagaaacccagatatttcatttccgtataaatgaagtcgttggagatgagtcgaaaagttgcttaacgaacttggtagatggccttctagtcgattataagccatcgaaaaaatttgtagcctagtgcagttggctaagctgttcataaactcccaatcttcctttttgtgtgtttggagctgattgccttcaagacttagccaatacagtttgcttagtttgccaatggaacttggtacaaccccagtgaaattattacttgatatgtccagttcacgtaggttggaggcgttcaccaatgagctggggatatgcccttgaagaaaattgaagtccaatgcaagtacttgtagattgggaagagagtaaaggatattggatggtacctctccacttagatgattaaaattaagaaaaagatcgatgagagtagaaatatttaagatggcttgtggaaacctacccgtcaacatattgccacccaaaataagaatctccatcatgaggaagtttgaaaactcatttgggatgtttcccttgatattgttagacgcgaaattaagatttctaagttctgtgatattggcaaaggaagaagggatagttccagtaaaattattagatgcaagagtcagcacttgaagcttaggggggaaattattaatcaattgtccaactaggtgattgccgttgagccatagggccttgaggctagaacaatttgtaaaatcaggtatcgctccttctaatgtgttattgctcaagtaaatggttcgaaggtgatgcagatgaccaagggacagagggatctctccggtgaatgaatttgtgtctaggaacagaaattttaggaatgttaggtttccaagtgaaggggatatttgcccaactaaaccttggtttgtaaggtttagagaaatgggacgatgtggagttttaaccctgcacaggacaccttcccaactgcaaaagtaagtgctgtcattccaggacatcagcgcttgctgcggatcgagactgattgccttcttgaactcaagcaatgagagtcgatctgtctcatttccatataatgaggtgcacatgatttggactacattgctagccataagcaaaatcatatactgtctgattgtagcgatcttcatgaccagccttctctgccaaattattctaagtcttagttaaatgcaaagataataaaagcaagagattatggatagtcaataataaaacaagcatcgcgggttaggtggctgaaagaaggagatgcaaacacacgtttct

SEQ ID NO: 32055 - DNA, 1501 bp, Oryza sativa
tggacacatagcatttttcaattgcataatggttacctgtaacagcatgtttataaaattccagatatgcacgtatgtatagtaaaccgtttcgtgtaaggcggttaacctaatataccatggtttgagcaccaaagattataaacaggccttcatccgcatgaacttttaatatggtaccaaaaatgaccactacaatcacatctggaacacttgggaccaaaccatggcaagatgttaccatcacccccgtcttcgtctgaggaactgatccctctagttaatgcaggttttagatgcagagtcttttatttttgaaacctaattagatgcagagtcttacactagcttggaagtactatgctccataatggcacatgcgatgaaaagcaagctaacactctgttagctccttcgggttgggaacccacgtctcctccacgcgaaaaacggagcgatccattagcacgtaattaattaattattagcaattttttttaaaaatggattaatttaatttttgaaagcaactttcatatataattttttttaaaaaaacgcaccgtttagcagtttgaaaagcgtgcgcgcggaaaacgagatatgtgagttgggaaagtggggtaaagaactcagccaagtagtgatacatttcctctgttccgtaataggtttggttttagctccttctatttgtcctaaataagtttagggcacatttgaatcaaaggaatttcatatgattgaaatctataggaaattttactatgtagccctttaattcaaagtattgaagttttccaaatcctacaaaatttatgttttggagaaaacttagcaagaggtctaacctcttggtaagaatcctttgagtctatctctctcatccaattcctgtgtttttcctgaaatccaatcaaacgatcattcctatattttttctgtgttttgcaatcctctgttttacatttacattcctgtcagaatcctatattttcctattcctccgttttttcattcctacgatttaaggggcccttgtttttagagtaattattgcatcaaagtttgataaagtaaggctattgtattgggatttgataaagtaaagttattatagtcttttttttaattttatattgatatgtacgtgtaagataggtgaaaaataaacttaacgagacacaaatattatgtcagggttaggctgtaaaaaataacaaaatttccatacttaattgttaccccttttattaatgtattatggaaatgaaatagccggaacaaacaagcagagatgcttacagctaggtcggctgcaggctgccggcactcgaatcaagctgtccaattgtttaaaggcgactgaagacctgattgattgaatccaaaataacaaattattttgcggaacaccgatggatcgatcgagcaacaaaactagcttagtaaagcaaccgagggcagaatgatacatacttgcacgcatggtatgtgcctt

SEQ ID NO: 32056 - DNA, 1501 bp, Oryza sativa
gcataatatagggctcatttgcaaaagcagcatttagcaaacatttgagaattataaaacagtagagtaattaatcatcaattttaatcaacactaaacagcacacccgtgctgctcaggcccaaccatcctgaacaaccatacccggctgtacagatctatctccaaaccaggaatataccattccaaaccaggagctaaacaaattattaccagttatagcatcttttattatggtgagaagtgtgaaactaatcacgaaagacattgttagacccgcccataaccgcgggcacagctattcgaatagttttactctggctagaggtgtaccactgtacccacaagacacagccccacaacatgtcaccatgcgcctcaataccaccacggtacctcagaaaggagctgtgacagtacccctcgcacaacacaatccaccacagcgcaccattcctggatcataatcacccccttataaaacaaggcatggactccccagcgacccccgtgggcttatctccgccacttctcagtctggtgctccgcaatgaaccatactatacaaaaggtaaagccgttgcccacgctggcttgtggttggcacagttaatgtttcacaaccgaaactcgtgaaccggtccttaattgtcatgagcacgaccatcaaaaccatgtgctcacaactcaccattatcaggttttagttggcaatttaattaattaaccaatcacgattgaccatcgtgagctatcattaagccatcattaaataatagtgagccataagttatcccaatagtgctaatgtttctaagcatggctaagcaatcatatctaatatctagctgaaccaatatataaagcccaactagtcaagttataataacccaaggtatcaaggaataaagtaatcaagaacaaaagggctataacaaacaataagttaattccacccaatgacattcgaaaataaatgcaatagttgaatagaaacaatagctttaaacaggatcaacatgctcaaagggttgtttgggatctgtgtgacttgccttgctggccttggaactcttcaaattcttctcctgtaaaaacggactctccggaaacgtcggaatctaaagagaaaagagcaaaatcaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaagggaattattgcgtcagcggctagggttcgcggtgaatcgggtgcacggcggcggttcacgagattgggcggccgagatcgatcctatccaaaacggacggccaagatcgatcggatccaccgcggctcacggatggacgacgacga

SEQ ID NO: 32057 - DNA, 1501 bp, Oryza sativa
tccggataacctgcggatcgccggatcatctgcagcatatacaaggtaaagtaaaactactatctcccatttaattgctaggttacctaaataattgttagtacatatctgaatgcactactctacgattacaagacgagaaggacttattatctcataatttaattgcaggattattattatggaaaattacgggtctgagtggctgagattttcgtttctgatgaatctcactgatgttgaacaatgatcacagagcaagtcgcctgctgtcgtgtcgtcgtctcaggttaatcgtatcccagaatggagttaacatgggaccgatcaatccaccaattgttagaatcatataagaattcctttcaaaaaaaaaaacaaaagagagaaaagaatcatataagaattacttgtggaactggaagtataataaaaccgttggcgtcatgttgtcaagggtagtatactgtatactggagacggaggctacattattggccacttggtcatcaggtgagatgaacaaacaggttagctctacatagatcaataatataattgcctaatcaagacaaaactatggacaaaaagttaggtaatcctccattttcactgaagattagcctcctctctgaagaaaaactggtgttgagttgaattccatgggctggtagctggttgagttgaaggccttagcttgccatgatagtgcagacgccatggctcttactgctacaaaaatgaagcagccgacgatggccacgaggctggctgcaggctgcaccctctcgctggtaacccctcacgaatgcatatattgattgatcttttaatttgtttctatgttcatcattttgttagttccatggaatagtatataaatgttggatcaatcgtctgcttttggggattgtatggaatgagcctaactatacctacaggcttgtttctgtctgtaaacttattgcgtactagatacagatgattagaaacactatatttcccttttttggtgagattgtcagaaattattacttctgtgttacctagaacttatttgttcagaatatcagatagctttgctagctttctggctttcgtcctcctttcaggtctctgacactagagacttttattttccaccgattggtgatcatttatcttgctataagcctttatgtttcatccctgactcttctgtctcaatggcagttggattgatcagcccgtatcagcaaaggatttttcatgttgctgaatcttgccagaggaaaggatatcaattctgtctgtggagacgaagtaaataagaacaaaagctttcttggtactttacatttgtctatttgccaacattctctaaccatctaaaacagcttctgaaattttaggctcttgcatgttctttaaaaaggattactaaccgatatgtattaatccctttctcttttgtctatgcatataagcaagacctaaatttattcgtccaaggagctggtca

SEQ ID NO: 32058 - DNA, 1501 bp, Oryza sativa
tctgcccctatcatgcaataaattttttgggggtttcagtgctattaggaagtatgttggtattgaggttagtactgaagagacaagggtcttccttcccacctgttgcaacaatttccctttccaacctgcaagtcgagagtggagcttgtccatgactggttggagatgcgctctcttgattcttcctattgtcaaaggtagtcctagatatgtgatggggaaaccagttcgatttccattgaaattattcagcacgtcctgaagatctatgttttcacatcttataggcaccactgagctcttgcttaggttcacctgtagccctgtggcacgtccaaagttttccagcaaggtgattagactgtccacatcagctcgacttgggttcagaaagattgctgcatcatccgcatatagcgatgttcggaactttgccaccctgtttgatattggcgacaagatcccttggtctttggccatatccagtatcgtttgcaatgggtcgattgctaatatgaagaggtagggtgaaagggggtccccctggcgcagtcctctcttgtgcataattacttctcatgttgttccattcagcattaccttagatgtggtggttgatagaattaaggcaatccaatctctccaccgtgtactaaatcctctccacggtagcatttccaacaaatattcctaggatatagagtcaaaagcctttgcgatgtccaacgtgaaaaggaggcttggtttccttttgttgtgcatcgatctgaccaagttgcgcacatataagaatttaccttgtatgcatcgtcttttgatgaaagcactttgggcatgcaagaccaggtcatccaatctcatcgcgaggaccttcgatatgagctttgccactgagtgaattaagcttattggtctgaaatcatgcaccagttgtggtgaatctttttttgggatcaatgccaaaatggctttgttgatgcatccaaaatttccgcctgcgagtctaaagaaactatcgaacatctgagaaatatcatgttttatgatgtcccagcaccccttgaagaatgccccagtgaaatcgtcaggtccgggtgccctctctgtcggcgaccctttcaccacattccatatttcatcctcagtaaaaggaccatccattgttccttgttgtattctctgcactcataacgcatcccaattaagtgtgcattctcttagtttcttttcgcctagtatggaggtgaaatgatcatgtagcagcttggccttgtcctcatgtgtgtatacagctgcatttctgtgttgtaagcagtgtatgaagttcttccttttcctagcattagcttttatgtgaaagaaacgtgtgtttgcatctccttctttcagccacctaacccgcgatgcttgttttattattgactatccataatctcttgcttttattatctttgcatttaactaagacttagaataatttggcagagaaggctggtca

SEQ ID NO: 32059 - DNA, 1501 bp, Oryza sativa
ataatttaaattgaaaaaggtttttaaaatcctcttttggctttgggccgaaagtcggcccaaaaccttctctctctctccctcggcccagtcggcccagtccgaccgcagcccagtccgcccgctcgcgcgcgcgcgtcagcccgctgacaggtggggcccacctgtcagggccgtcgtcttcctcgcaccgtcgcccggccgaaccttagccaagccgcgccgccgtctccttccaaatccggctgcccctttccgtttccgatgaaattagtagaggggaaatgatcttcgggatcttctctacctttttccttttggaatcgatcgccaattcggtttggaaatccgtggattcgagttcgattcggatcgatctctctcctccgaaccctagttgttccttcacgtcgccggtcgccgtgggccttcgtcgccgcctccttgcccctttaaaaggacccccaagcccgccgctacccgtcgccaccctcgccttcgcctctcgtcgccggtagagccctagcgccgtgtagcctagcgccgccgtcgccgccgttcgtccagccgtgcgccgccgccactccagtcgtcgtcgtcgctcgggaaggccgccgtcgtgatcgccaagtcatcgccgacctcgttcgcccctccgtcgtcgccgtaggccgccggaacaccgtcgccgtcgtcaagccgaaggtcgccaccgcttcttcctcgacgccgtcgccgtccgttgatctaccgccgccgttttggtcaccggtgagttcgccgcgtcgctctctacgtgctggtgccctccgttcgtgccgtcgcgccgtcgttcgccgacgagcatgcacgcccgagccgccgccggtggtgacgtcgtcgctgacgtcatcgtcgtcgtccatccgtgagccgcggtggatccgatcgatcttggccgtccgttttggataggatcgatctcggccgcccaatctcgtgaaccgccgccgtgcacccgattcaccgcgaaccctagccgctgacgcaataattcccttttccttttcaaaaataattcattattgcgtcataattcaattaaaatccatataagtgttttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgattttgctcttttctctttagattccgacgtttccggagagtccgtttttacaggagaagaatttgaagagttccaaggccagcaaggcaagtcacacagatcccaaacaaccctttgagcatgttgatcctgtttaaagctattgtttctattcaactattgcatttattttcgaatgtcattgggtggaattaacttattgtttgttatagcccttttgttcttgattactttattccttgataccttg

SEQ ID NO: 32060 - DNA, 1501 bp, Oryza sativa
catcttagctcggatttagttggttcaagtctctaaatttttctaaaattgagatctacatgttaaaaatatccacatgtactgttcatgcttgtttatgtgctgttttggtgattttgctcttttctctttagattccgacgtttccggagagtccgtttttacaggagaagaatttgaagagttccaaggccagcaaggcaagtcacacagatcccaaacaaccctttgagcatgttgatcctgtttaaagctattgtttctattcaactattgcatttattttcgaatgtcattgggtggaattaacttattgtttgttatagcccttttgttcttgattactttattccttgataccttgggttattataacttgactagttgggctttatatattggttcagctagatattagatatgattgcttagccatgcttagaaacattagcactattgggataacttatggctcactattatttaatgatggcttaatgatagctcacgatggtcaatcgtgattggttaattaattaaattgccaactaaaacctgataatggtgagttgtgagcacatggttttgatggtcgtgctcatgacaattaaggaccggttcacgagtttcggttgtgaaacattaactgtgccaaccacaagccagcgtgggcaacggctttaccttttgtatagtatggttcattgcggagcaccagactgagaagtggcggagataagcccacgggggtcgctggggagtccatgccttgttttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctagccagagtaaaactattcgaatagctgtgcccgcggttatgggcgggtctaacaatgtctttcgtgattagtttcacacttctcaccataataaaagatgctataactggtaataatttgtttagctcctggtttggaatggtatattcctggtttggagatagatctgtacagccgggtatggttgttcaggatggttgggcctgagcagcacgggtgtgctgtttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaggagttctacagtgatgctgctggtgtggaggattaggtgtagccctggtcaagctgcctgtggagtggagtcgtctgcgccgtttatcttttttttttccgctgcttagatctttatgattgagaggaactatctacctctgtaatgacattttat

SEQ ID NO: 32061 - DNA, 558 bp, Oryza sativa
aaacaccccctcagtactctcttgttgaaatgaagtggctactaatgatagcttgcaagaaaggaggagatgatgaaatcatggtgcccacaaatggtgatagagattgtgtgagacagtggatgaggacactgagcatggcattggattggaccccatttccatcactgtcaactttgtgatcatctaccaaacctgcaaggataaactcatgttttaatcagggatgatatatgttctttgtttatgggagatgatatgtatgcctgttaataacttgagatgttgcaagaggtgtgatcatcagatcatggactcattggtggggtggttactgttaaccacccttggttttcactgaaactgactgatgagttttctgagaatgagaccttgagttgcctctgcaactgttggcaatttcaatttataatggcacaactgaagaaagtgtgatgttgagagattcagtgtaggaacaagctttaaactttacttcgcaccatctgaccacctttattattccctaaatttaaaatttaaactgaaattcaacta

SEQ ID NO: 32062 - DNA, 1501 bp, Oryza sativa
cctggtaagtatggaattcatctaattatatcattttcctccatactagctccataaaaactgatcagaaacatgaatcttgtcttctagaatagatttgatcatcagttgacacgtgctatatactccctcgatgtctctgtcccaaaataaatgcgcacttctagttcaaatttgaatagaggagcctattttttgtttgggttagttggaaaatccatatcattataaatttcacggtttagaaatatactattattattcacctatttgtaattatatcatttcaattttaaagtattagagatatgccactatatatctttttactgtactccctccatccctaaatgtttgacgccgttgacttttttaaacatgtttgaccattcattttattcaaaaacttttgtgaaatatgtaaaactatatatatacataaaagtatatttaacaatgaatcaaatgataggaaaaaaataataattacttaaattcttttgaataagacgaatagtcaaacatattttaaaaagtcaacgtagtcacacaataagagacggagggagtattttctaaccttttaggacaaatctacccctgtcttctccattcaatcgttcatcctttctttcctctgatcctctctactgtcccctttcaacctgtcatcgccgcgtccaccgcagcgtcgcaccccgccgttgcgctacggctcctcggcctcctcgccggacatcgctctccggatgtgaggactgaggcgccgccggatccaacagcagcaagcaagccctgtctacagccttccaatgttgaaatactttattttgctgcaaccctctagcatcctgctccaaccttgtagcgcacaaattacaaatactttgttcttgttgcagccttactgcgtcctggcatcctgcttgtctagggattgttcttgctgtatgccagagctgagaggagagagaaagggaggggaagaaagaagaggatgaggaggaacaagagaaggtaatttggtttggaaatcgaagtgaaagggtaagtagtggtatatcccaaatacttgttaaattataatggtacggatccaattagccctatttttaaacagagggagtatctaatatgtcttgacgcccattctgcaaaattaatatagctatcatgcaagggcaaaagatttcacatgcttgttttgacttgtatttttggtgtaggagcaattaagaaaggcaagtcctcagaaaaaggaaatacctgattattaatttttcatgcaggtaattcttaacaaaattagaatgaatatttgctaggacatttttgaacacctttactattaaagtagtaggtgacacttccatttttgtccagaaaagaatgcttggttcacacttagtatttataactattcagagtttcttgcttttattatctatatgaatataactaagacataaattcggcagagttggttaattggtcatgaagt

SEQ ID NO: 32063 - DNA, 1501 bp, Oryza sativa
cagggtagaaatgttgttgctgtcaaagtcttcagtctagagacaaagggagcacaaaagagcttcattgcagaatgtaatgctttgagaaatgtgcggcatcgcaatctagttcctatccttactgcgtgctcaactattgattccaggggaaatgatttcaaagccttagtgtataagttcatgacacgtggtgacttgtatgagttactatactcaactggtgatgatgagaacacttcaacttcaaatcatattacactggctcagaggttaagcattatagtggatgtagcagatgcattggagtacctccatcacaataaccaaggaactattgtccattgtgatcttaagcctagcaatattctcttggatgataatatgacagctcatgttggggattttgggcttgcaagattgaaaattgattcaacagcatcaacttctgctgattcaacttcttcaattgcaataaagggcacaattggatacattgctccaggtgccgcccattttcatacagcactatactttttttttccattttcaattgagaattgttcatgcaagtttcattaacatttttttaattgaagtttcattaacatttggaataattcaataaactctccttttctaaatggtctatagagtgtgcatcaggtggtggtcaagtttcaactgttgcagatgtttatagctttgggattattcttcttgaaatatttctacggaagagaccaacagataatatgttcaaggatggtctggacatcgcaaaatatgttgagatgaactctccagatagaacactaaatattgttgatccagaattactagacgacaaacaattgcaagaaattcctgtaaccatgaaggaaaaatgcattgagtgtttagtttcagtgctaaacacaggactttgctgcgttaagatatcccctaatgagcgcatggcaatgcaagaagtggctgcaaggttacatgtcattaaggaggcatatgccaaagcaatctctggtaataatggcattatttgtatcatacggagtactatataaataagtatgcaaacagctgatgcttgaggcttgcattgcagattcgcaggcagttatcagcgacaaaacttagtcgctgacgaagtagaacatccggcacatgaggttgcatgctgtttttttctctcgtatttattgtaaggattctgacgtaatctgatggagaaagcaggcatgcatgcttgcagtagcaaatatgttatgctttttccactgaaagttataaataaatttggctttgtgacattattgaattataattatgagaaactggatatattttgtattgttgccaaaaatgatgacattttcctcccacaatttattctaaaggttgccagtaacttctccagaatgaccacaatataacataatcttccagatcaaacgcatgcaagaaagggtagagatatgatattcttgtaatttctaatgca

SEQ ID NO: 32064 - DNA, 1501 bp, Oryza sativa
gtaggttttgtgtatgaaatttttagcatttgctatgtaagttatttttgtctatatcaaattttataatcctataaagtttcgttggaatgccttaaggaagccgattataaaccgtaatgcgtatttacgataaaaaacagtatgggtaaacttttatatatgtgttattagcaatttaaaagacaatattaaaaaataaagtacggtaaaaataaaattaactctaaaatttaaattttggttacgacggataagctgaatagcaaataatggagctgaccttgtgaaatatttttctctgagtctctatttctccataaattcatgtattttttctataatctatctataaagttattcatatgctttccctatgctctatgctcttttattttgtaattgcatttccaataaactgcttctcttggtcctgtatattatcaatattatgtcctctcgaaaagagtcttttatgcggagaacaaatttcttttagtcactgctagttttcttcatatttcagctatactttactggaatctcggatttggaatatttcttcagacaatgggtacaaacgatttttttttcttttctctgaacatgagttcacgggaaattgttgctgtataaggttaggacgacacagacaacagtaggaatccaaaggtttttttttttagataatgtccaaaggtttcattggatccattagctctttctttgtttcgtacacttcccttcttcttgtttattctttccattccattgcatcttgactcattcctttgggcaggtgcatcttccttgccaaatgttaattttcttcaactttttgtacaccagataagagcttcaacattttgtacacggttttcagtaaatcaggtatccatcctgtcatcattctgcattttgtgtgattaaaaaatagctaaaaaaaagcctacttgacagtacttcttccagttttgaaaacattattttgaacatccatatggccttcaaaatgcaaccttgactgctaattttacagtatgtttatatactagcatgttgaaattataataatcaaaatacgtctgtacttataattttcatactttcagtataagatgtactagatgtttagagtttttttaagtttaacctgaaacatgctcaaaacgatgtattttcaaaaccgaagttagtagcaccatcctatgattcctttgaagtctgctttcgaatttgttttagaattttgaagcagtgctatcagacagacatgtcatggttgaatggccgaccaactggtccaagtgtgttttcttctagcactggcccctctaaataactgttagttcgtactattgtactaatcaagaccgattaagaccctgtttagatgggactaaaactttccctatcacatcggatgtttagacaatccatccataatcttagactaattcgcgagacgaatctattaagcctaattaatccatgattagtc

SEQ ID NO: 32065 - DNA, 1501 bp, Oryza sativa
cttgcagatcatctgtggtagcacttgatatgataatcacaattaggatagatatgcctttccctagctccactaatatgtctgaagctactgaatgtaatacaaggatgggagaaatcatgcacataatcagagtgaaagatgattgagaaaattgaaggccaaaaaacaaacataaatgacatattattctactacccaccaaaaacattgatatcagagatccaagttggtagatggcacctattggtctcaatgaaaaggaaagagacaaagtaccatgaaagagattttactattgaataacaaaagctgggatagttacaaaatatttacaagtgcataattgtggcctacttaaatcggatgaactcctataactcaggagaaattcatccacacatacacctgtggctatgtttctgaagaaaatatatcacgcccacacaaaaacgttcagcatcacaaggatgcagtgcatgttgtctctgcagcacatttgaacataagatctgtatatttttgtcttaggcttgtagcatccaaaagctcatattgaggtttcttcaatcagttcaggcagattgtaaatttgtatgaagacctagttttctgctgtacatgaatttgttatatttaaaacaaaggtaaatacatggcatgaagcacatattgtgtccagttaaatgtattccatttccatccttcaggtgagaaaccaatgccaaggccagttcattatctccataaccatgaatatgagtatgctaacaaggttgtgtagttcactggatgggttagactgtaactctgtaaacaaatgtgtctgtgatgcgatgtaacatgtcagcagagatttagtatgcgtagctctgctcatatgaccagctgttggtaagccacattctacaatccgtattcttccaccttcaaagcatgcgttcacctctacacgtgatgccatacaatcttcaagtcctctttccaggtcttcctgaagatcccaaaaggagaaattgcgggcaagtggtgttgagttcattcctaacatgctactctgttgaacagtaaaagggtctagtttgagcaaactctgttgttcaaatccattgctttagaagcctcatcaatgggttgcccacaagttttttcggtttcttcaggactagcagaagataaaaatgccacaagtttctgcctcagcatcggtgaaagcttctcacagcatgtcaatatatccaaggaagggaccactcctttcttcaccagtaccgcaaatgcgttccttacacactcagcaatcgcctccttcctccgcacgtcatagttctcgacaagaagaaacaagaactcaagtagcatgtttgtgatatcagtatactgagacactgagtttaccatcaggagcattgcaggctcaatattcatgagattgcccttaccctcgtcgaaaaacaaccagtcatagaacagcgcaacctttgcattcgcctgcacatag

SEQ ID NO: 32066 - DNA, 1501 bp, Oryza sativa
ttagtcccatctaaacagggtcttaatcggtcttgattagtacaatagtacgaactaacagttatttagaggggccagtgctagaagaaaacacacttggaccagttggtcggccattcaaccatgacatgtctgtctgatagcactgcttcaaaattctaaaacaaattcgaaagcagacttcaaaggaatcataggatggtgctactaacttcggttttgaaaatacatcgttttgagcatgtttcaggttaaacttaaaaaaactctaaacatctagtacatcttatactgaaagtatgaaaattataagtacagacgtattttgattattataatttcaacatgctagtatataaacatactgtaaaattagcagtcaaggttgcattttgaaggccatatggatgttcaaaataatgttttcaaaactggaagaagtactgtcaagtaggcttttttttagctattttttaatcacacaaaatgcagaatgatgacaggatggatacctgatttactgaaaaccgtgtacaaaatgttgaagctcttatctggtgtacaaaaagttgaagaaaattaacatttggcaaggaagatgcacctgcccaaaggaatgagtcaagatgcaatggaatggaaagaataaacaagaagaagggaagtgtacgaaacaaagaaagagctaatggatccaatgaaacctttggacattatctaaaaaaaaaaacctttggattcctactgttgtctgtgtcgtcctaaccttatacagcaacaatttcccgtgaactcatgttcagagaaaagaaaaaaaaatcgtttgtacccattgtctgaagaaatattccaaatccgagattccagtaaagtatagctgaaatatgaagaaaactagcagtgactaaaagaaatttgttctccgcataaaagactcttttcgagaggacataatattgataatatacaggaccaagagaagcagtttattggaaatgcaattacaaaataaaagagcatagagcatagggaaagcatatgaataactttatagatagattatagaaaaaatacatgaatttatggagaaatagagactcagagaaaaatatttcacaaggtcagctccattatttgctattcagcttatccgtcgtaaccaaaatttaaattttagagttaattttatttttaccgtactttattttttaatattgtcttttaaattgctaataacacatatataaaagtttacccatactgttttttatcgtaaatacgcattacggtttataatcggcttccttaaggcattccaacgaaactttataggattataaaatttgatatagacaaaaataacttacatagcaaatgctaaaaatttcatacacaaaacctactcgatttgaatctttttaggacaacgcttttcacttcatattataaaagctttgacttttttttgtcaaattttttaagtttgattaaatctataaaa

SEQ ID NO: 32067 - DNA, 1501 bp, Oryza sativa
acagacacatttgtttacagagttacagtctaacccatccagtgaactacacaaccttgttagcatactcatattcatggttatggagataatgaactggccttggcattggtttctcacctgaaggatggaaatggaatacatttaactggacacaatatgtgcttcatgccatgtatttacctttgttttaaatataacaaattcatgtacagcagaaaactaggtcttcatacaaatttacaatctgcctgaactgattgaagaaacctcaatatgagcttttggatgctacaagcctaagacaaaaatatacagatcttatgttcaaatgtgctgcagagacaacatgcactgcatccttgtgatgctgaacgtttttgtgtgggcgtgatatattttcttcagaaacatagccacaggtgtatgtgtggatgaatttctcctgagttataggagttcatccgatttaagtaggccacaattatgcacttgtaaatattttgtaactatcccagcttttgttattcaatagtaaaatctctttcatggtactttgtctctttccttttcattgagaccaataggtgccatctaccaacttggatctctgatatcaatgtttttggtgggtagtagaataatatgtcatttatgtttgttttttggccttcaattttctcaatcatctttcactctgattatgtgcatgatttctcccatccttgtattacattcagtagcttcagacatattagtggagctagggaaaggcatatctatcctaattgtgattatcatatcaagtgctaccacagatgatctgcaagactactacatggctggaattgtttgaaggcactcttggcatagacttgtcaaattagtggtgaatatgtcttctgcagccatctgtctcctgatctactagaacaatgtgtgccacagaagggacccagcatacaacaaacaactcactgctggagttgttatcacccaaacaccaacaggaaattcttgtgaatttcaatggtcaggacaggttcatggatgtcatatatcaggacatctccaccgtcgaaactcgaaagacgcctatgggcaacagttcctggtgaaatgcacccacagaaagccagaattcttcatcatccagccagggatgatccttatttatggaccgcgtatcgcgaagaagaaaaaactctgtttttacatggtacacaaaaaaaagggaaaggaaaatcatggggaggaaatcatgttgccagggtcaggacaaaggaggtggtggcaagaggattggagcaaccaaagcagagccattcatatccaggaggccaacctccacctcacaactcatatcccttttgcccttaaatctgagaagttgctgcacttctcaccccccctctaaggaaagactgcaaagaaaaggcctgtgtcaaggagagggtagtagcaccttgctctcctttgccttcagagaaaccggaagcaa

SEQ ID NO: 32068 - DNA, 1501 bp, Oryza sativa
tacttagtgcaaaaggtagttgtggaatataattagtagaagaccactgaccatgactctgtgaagcaagttgactgctgcctgcagctaatgcatctttccagccggcgcaactacctgaagggtgcaatgataaaaggaaaaaggaaataagaaaagagacaataaaggaaatgacctcctttggtcaaggaaaaatactttattagtcctcattaatctttccgattgggatatatgagtaccgatttactaaagcttaagctttccttctgccagtgataccttggtagtgagcgggcagcagcggcagcttctgaatccagttaccctcaggtacgcatgcacctgcagctagcacagtcagtaatgtctgggaatacactcatgccctgcagcatgtagacatggaaagttcttacatatgtatggctgctcattgcatttttctttgattcttgattcactgtgcgtacgaaaattaatcccatttctcaaaaaaaaaaccatgggcttccttagttctttataaagctagctgggttcattcatcgaaagatctattgtctaaaaaaacaaacctagaaagcccaactcttacaacctaaaacaaaactagcacaaaaacaagtctctacagatcccttgacaaatgcagtagtagttagatagatgttatttctgcacttcaaattattatgtatcttgttgcaaaagaataagagcagcatatatcatgtacacactatgtgctaccagcgagatgaaaattgtccaaaatgtaaactcatatactgtttgcttgatgcattctccgtatcatgagttgttgcttgccaaaatgaaaaaaaaaagttaataataaaatggtccctagtgtaggagtaataactgtaaatttcctgtttatcttttacttgctcatcatcaataaattaacaaacagggccatcgaacaagcttaaaaattgaaaatggtggacgtccgtgctgtgattgaatcattttttgtcatgctgaaagagaacatctatgtcttgatccgcattgagtccttggtggcactggtgacattgatattccttgcaatgttcatcatagacttctaccgctgccgaactcgtagctcaatcttgaccaccattcttgaaagcatcgacgaattatctgatcagatagtagtgtacctcattggagccatgcaatccgcgaggtttgagaatgagctgttcccggtctgggccatcgtgctggtgagtctccgtaccagcctcggctatctctctgggtatggcatctcagaccgtgatcgacaattcatggagctggcaaatgtgatcaagttcataggggcaggggtcttggctggcactcgtggcttgaagtatgcaaggccactctggtcattttgggccatcctgcaactgaagagcatgtaccggttcttcgcacatggcatggcaaacgaatccttgtggcatggccggagctcagagtttat

SEQ ID NO: 32069 - DNA, 510 bp, Oryza sativa
cggatgaattcccagaaattcggacaataacacaccattgtcccctgcaaacttctaagcaaagctctatgacttgacagttcgtgaaactcgtcctaaaatccaaaaccggccggaaattccaaagggggatttgacaggagtgataggcctacatgagcccaaatgcaaaaaggccccacaaataaattcagcctaagcccactaaaattctgtggataaaatcgcatctccgccgtgtgacactgacaccctgacccaccagtggggcccactagccagcggcaacgacctcctcccccctcttcggcttcaccgaccaaaccaacacaatcgcgcggatcaacagactcgagtaggggagagagagagagagagagagagagagagagagagagagagagagaaggcgacgcggcaatcgatctgcccgcctcacctccggccaccgaccaccgccgcctccgcgtccctttgcctcacctcgacgccggctagcatcgccggcga

SEQ ID NO: 32070 - DNA, 1301 bp, Oryza sativa
atcatttcaatggtgattcatcctcgattgaacaaaagtatcaaatcattttaaaacagaaaacacccatgtagccactaagatatgcaaacatcaacagaaaaaaaaaatccaaatcatctgcatctatgactcagctgcatctgccaactttgtcaccacgcactgccctttatgacaaagaggataacaattgacaagcaaagcgtgcccggaactagaagctagcaaccgagtgatgcggatttctctgattttgtttacacttcagttcacccaaaaaaaatcctactagttgaatggagatttctctgttttaagacagtgtgtacttgttaacggcaaaattgcttgctccaagcaatacttgttacagctagaagcatttcaagcgatctattccaattcgaacattttgctgcaaatatcatatcaagtatcatatgattcagcacatacacacatccctcacctctgctacaaacacccccagtgaatgaacaaaaacacacagaaaaaagagagagagtattagcttactttgatttcaatttggatgtgatatgatgagccccatccaaagattagtgattcaacaaaccctagaaaatgcaaaaatgaagagatgttaaatcaaaatcaggaaatcgatgaaaaaagaggaatgagagaaaggggtatcgtgcgcaccggctctgccgcagatgccaccggctccgccgcagacaccgccgccacagccgccaccaccacgctcacgccactctccctctctggcacaactgaccttgtgcgcatcggcgccgctgaagaggaggagccgcaagaaggctccgccgccggcgactccgccgccgcagccatgctcgtgacgatttgggagctgcaggtgtctgtttgggagtgactcaatgtttctcgagtgtgtgtatctgatccgtgagggtgtgtgtttgatccgtgggaaattgtcctgtccgggaccgactcgaaacagtataccggtgactagcatttctgttataaaaataaggaaaaaagaacgagaaaaagaccatttaacgagcggtgtaaatatggcccctgcaccgaaggcccattcgatatgtgggcctaattcccacccgtccgttaatgggccgggaaatctcggcccatttaacctagccctaaagctagggtttcctctcgccgccgcactataaacgcgctctcctcctcactcctcctcccctcgagaaaccaaagctccagcaatcggcggcggcggcggcggcccgtgataggcggtccggcgacga

SEQ ID NO: 32071 - DNA, 480 bp, Oryza sativa
caaaatgttcgaattggaatagatcgcttgaaatgcttctagctgtaacaagtattgcttggagcaagcaattttgccgttaacaagtacacactgtcttaaaacagagaaatctccattcaactagtaggattttttttgggtgaactgaagtgtaaacaaaatcagagaaatccgcatcactcggttgctagcttctagttccgggcacgctttgcttgtcaattgctatcctctttgtcatagagggcagtgcgtggtgacaaagttggcagatgcagctgagtcatagatgcagatgatttggattttttttttctgttgatgtttgcatatcttagtggctacatgggtgttttctgttttaaaatgatttgatacttttgttcaatcgaggatgaatcaccattgaaatgatattttctttgtcctttcacacatgtgcacagagttgaaatggcattgccacctgctccaagc

SEQ ID NO: 32072 - DNA, 609 bp, Oryza sativa
ccccctagccacctcagcatcgccccgccacgtcggcagggggacggcgccaggctggcgccgtcctgttgaacgacggcgccagccactctggcgccccaaaaaggactatttctgggataagttttttcaggggtctatttatgaaataagtttttcaaaaggaccaaaatgtgaaaaatccaggtcagttgagggagtcaaagtgatcttattccattaaaaaaaaaggaaggaaatatggtccacatccaaacacactagccaacagtttgggccgtacaaaattcccatttccgtcacgactctgactgccctcgctaatccaatttccgcatgttcgtgtacaaggtcgaatccaccaacctgacttctttttcgtcgcatctgcttcagtaagtccagtgccgatcactcccagtctcccaggtcccaaacacttgctagcctatctatatatgcggccacgagcagcactagatttcagtgagcaaagaagctttactcagttagtgtttggtcttaattaaacactggcctcccaattgattaagagtactcagggggagtactgactactgagaatctagcatcgatcaagcatgcaac

SEQ ID NO: 32073 - DNA, 1501 bp, Oryza sativa
cccaacgaaatgctctgcgtcaggcgggactggctactgcgagcactggaggaagagctaccagaaggcaccatccgctactcctccaagatcgttgaaatcgaagaggacggcgacgccaagatcctacacctagccgacggcgcaattctccgagcaaaggtagaagaagaaaaaacacagtgaatcccaaagattgcgaactgagaattcttgaattgttaatggcgcggatgcaggtagtgatcggttgcgacggggtcaattccgtggtggcaaaatggctggggctcgcaaagccgtcctactcggggcgcttggctacgagaggcctcgcgtgttaccctggcggccacggcttcgatcccaagttcaagatgttcttcggccatggctttcgtctcggcgtgatcccctgcaacgatactgatgtctactggttcttcacctggtctccttctgagcacggttagtctctgtcattgacacactgtcacgaatggtgaatcgattggtgaccaggaattaaccggtgcacgcatgtttggttgctgctccagatgatgatgctctcgccaagaataagaagttcgttctgaccaagctgaatagcgcggagatcccagccgaggtgctcgagatcatcgagaggagcgaggcgaaggacgtgctcaccgcgccgctgcgtttccggccgccgctctcgctgctgctggcgagcatcagcaaggggaacgtgtgcgtcgccggcgacgcgctgcacccgatgacgcccgacctggggcagggcggctgcgcggcgctggaggacggcgtcgtgctggcgagatgcctcggcgacgccatcctcggcggcggcggcggcggtgcggagagcgagaggatcgaggcgggtctgcgtgagtacgcgaggatccggcggtggaggagcgccgagctcatcgggacagcctacgcggtcggcttcatgcaggagagcagcaatgcggtcatcagctttctgcgtgacaattggttggccggagcgctggtgagaaagcttctgaaaatggcggactatgactgtggcaagctctaaaatgtgaatggttattggccttctgtaccgggatccttttacagtggtctctactctctagactctctactcgtaatacactattattgtattatcattagtacaagtgaccaactattgatttatgaattctgcttctaataaaaaaatattttgctatcagtggttgagggcagggttcaaaattccataacaaaatttcagaaattttggttctcatttggtactatttattcaaatttgataaaattttgttcaaaaattcaaataatttcggccatatcggtgacccctgatacaaatgaatgaatgcacttagcgtaggtttcactgatttgtgataagtttgacttagatttgtcagattttcatcaaatttggcatatttttgtcaaaaattgtttttgttaaatttgactttag

SEQ ID NO: 32074 - DNA, 251 bp, Oryza sativa
gatccggccgtcgtcatacgcgggaaggggtggcaatttgcagacagtaaatgcaggggcgcatgcggggataagagttgacccacgaggacccgaagttatgagttagagcatcgccaacagtctttttaaccagatggcgccatctgactgtccaaaacactttctcccctggcctaaacttggcaagccaaagtcactagctaacggtgggccccacatgcattcctcctcccaaaacaatggaccca

SEQ ID NO: 32075 - DNA, 396 bp, Oryza sativa
tggagcgtttctaggatgattaatggacttttagtatgtaatagattaattaagtattaactttcttttaacagtttaactatttgaaaacgagaaacgcccagaggtcttccagctagctccataaggtggtgagctagacgatctgggtttgaattctcaccccttctaattatttgatattagatccttccctaatattcgtattttactatttgaaaaacatgcatgtaaaaaaaaagatgagttgggaaacttagctgccaaacagagaattgaattggagagatatttttgtcgagatggaagagagaacttgaggagagagatgtgtgggtgactaagagcaagaataataacgagctataagctaacaataaatttatacgaaactat

SEQ ID NO: 32076 - DNA, 815 bp, Oryza sativa
gtgtgggtaaagtgtaccccctctgcagaggttaacaaactgttcgaacagccgtgcccacggtcatgggcagatgtgaggtgattcctagcgtagttttgtttgactattgtcttgtgaaattgctgttgtggaaaagggatcgatgtttagaaaatctgcagctgatgagatcagctaggcccgggtggccgtttaaaagttgttggcccgggtggccgtttgaaagttgttggccgggtaccaaccttgaatcaattcaaaagactgatacattgcacatactccgaccggacgagacgcactgtctcatccgtgtcgtttgagaagcactcacttagtggtttttcataaaagagttcaaataaaatcaattgcaaaaataacagtctttccttgaagcctgcattaaacacttatttcccatggcttgctgagtactcccgtactcacccttgctttatataaataatcccccccagttgctgaagaagatgaagcggatcccgctgatgaggagttcttccaggagcaagccggctacgatgagttttagggtttcggcctagttcccaagtcgcgcctgtgaagtttggtccaagtcttggcttccgcttcccttttgtaatgcagttgagagctcgggatctgtccgcagcccacatgactgtactcctactctataataaagagacctctgttgctgtgatattctgtcttcctgtggtaccagcactgtttcctgggactggtatcgattaacaggttaatttggagcgtcacgggctagtctcgctcggggctagttcggggca

SEQ ID NO: 32077 - DNA, 242 bp, Oryza sativa
accattgatttttctttaaattggtgggtccaatattttttaccattagatttaattaaaaaaaatccaccctctctacaccttggtgcgtacgtaatacgtacccccactcttctgtggtgcgtacgtcctcccctcatctcctcttttctttcataatctcttagggaaaaagcttcctatttttttaaccattagatatatttaggattaaatttatctgtagaaagaccaagttatga

SEQ ID NO: 32078 - DNA, 362 bp, Oryza sativa
tacgaactgatatctcaaagttttacctacaaatttaattttattccctaataagcctgtcttggctcattagggcagtcccaacccatagtgtctataagcagtgtttatggtgccatgtcaataaaacatcacaatagaaactacactccacaacccatgatttcttaaagtgggccattaataaatacatcatctctcttctctaccaatcatatttatttttcatctattatgaagacactattatctcccaatgtaaaacttgacagtgtctagtgtataggttctcgtgttgaagctgtctcttgcatgagatctagtttcttcctctcttcactctctctcttaattaatatagt

SEQ ID NO: 32079 - DNA, 294 bp, Oryza sativa
aattcacaatagggttaatggcctattgggttgggagccaaattttggcatgcctaaaaaaataggccatttcaacagttaatttaggctattttggcttcaatccaaacacaattttacctttgccaaaattagccatgctaaaagttgccaaaatttgacattgataaaatttggtaaggccaatttaggccacaaaccaaaccaaccctaaaatttactgggagttaaattttaactcatgttgacgtggacaaatctcaggtgtctatttctcgatccaacggtgtaaga

SEQ ID NO: 32080 - DNA, 487 bp, Oryza sativa
cctaaagtttatagacccaaagtttataagttaaaagtttacatacccgattcaggtttaaatttgaatttgaattcaaattttttatatatagtatttctatacataaatttttctaactttttgtttttgtaaaaaaatttgtggagatgtataaacttgaggtgtataaattttaagtgtataaatttactaaaataggaaagtaatgcggtgccaaaaaaggaaatcagaaatctaatcgcccctagcgatcgatcgctctcggatatagacgacggggacgttaaatctttgagtatgggtatctgtatcgctccacaatatttgaaaagaacaaaaatgaaaaaagagttaatagaagagttgttgagctggttgggatgctttggccttgggccagcgtaaggcagcagtagtgcaagcagtgacactagtgcagcggcaggcccgggccttgggccatccagccgatcagcagcaatca

SEQ ID NO: 32081 - DNA, 159 bp, Oryza sativa
gtcattttcgccgccctctgagagggcgatttttggtaggcgactacttccgtcaattttcaaaatggaaaattatttttgtcaaacttttaataaaaaaaattataaataaaaaaaattcgtcgcgctcgcggtacgggccgactcctgcgctcctca

SEQ ID NO: 32082 - DNA, 1501 bp, Oryza sativa
accattgaagacaaagaaggacatcaaatcggtaggaataaacttgccggagttggtctgaaaggccggtgctatcttgccgttgtggaggaagaagaccttccaccaaaggacatatcggctgcacctgtggaccataacttctcagccatgcaagacagcaagcaggatgaagacatcgtcatctcccttgagctgtgcatgaaagggaaagaagaaatcttaacatgagataaactcgatctataatgggatagacctaactgcaggatgaacccgaccacccactggactcccctccccttgtcgatgaccagtggccaccgaagacagagggggaagggaggcgaacagaggaaagctaaagacacactttttttttttgccgtcgcatagactctcagcctccaccgacatagagagaaaaagtgacctctcctatggttgggcacttgggttggacatattgtccaaaagaaggacaagcatgccctcattctacacctatatgtatactagcattgtggtcccttttcgggtttctttgcatcgcataaattttacagcatatttttgtttgaattaatattgtgctcttatcctcatttcacgtaaaatgtttgcactcggtgttacaatccattggcatccatctttatcactagtgcttctctatatggctagacaggtgggatcgactaaatcatgtgttactacaatgagaattatcttgatgtagtagtagatactgacacgtggatctggacccacgagctgggacttgggccgtgccgggctagcacggcctggcccatcgtgcttcgtgctagaacaggccgtgccggcccagcacggcctactaatcgtgccgggccgtgctaggccgaggtggagaagaaaggacccaagcacggcccaaagcacggcgggcgctgttcgggccgtgccggcccaagcacgacccacttgttaccttgccgccgccgccgcctagttgcttcgcagcgcgccggtgcccgccgccgcctgttgctccgcactgcgccgacgtcgatcggccacgcatgcacgcacactgaacggcaacggcacgcacgcacactgaagtctgaccacgcggccacgcgcccacgcccatctgcatggtacaacaatagtcaacatgcgaccatgcaggcatgcacatctgcatggcactgttcccttgatagttgagaaggagtaattccattcagataacgcgttcagatatcgtcacaggagttacgttccattcaaaacaaaacagaaatcaccatctgggctccccggcatgcacgcacgcactcgacgctcgaggcacctgcctcctgatcatctcgcacagtcgcgctcgaattttttttatttttaattttttttattaaaagttttacaaaaataattttccattttgaaaattgacggaagtagtcgcctaccgccctctcagagggcggcgaaaatgacgtggcagacggcc

SEQ ID NO: 32083 - DNA, 1501 bp, Oryza sativa
aggttaaaaataacggttcttaaaacaaacagttacccaaaaatggttaaacagttgttagtgccgtttaccgaatgaatgttcaaatttaaaattatgaatgaaaggattggttggattccataggaaacctggttttaattcaaatggagtggggtggcgacagtcgtggaggtgaggagaatcgaggtccacggtgacgggtggtcaaggtggcgagctcccaatggcgcggatcgagccagggcgtgaccgacgagctcctggcggggcacaaatcgggatgtgtgagctctaggtcctcttcgccattattatcttcctcttccctctcttgtttgtttagctgctccccccccccaccccgccagatgcgatgccaccggtggcctcatcctgtaccaacctctctactctcaagctcggggcacacgggggtttaagtggagcaatgttcaaaatagccggctatagccaccgctatagcgggatatagcgaggatagttagcttttgacgctaaacgatgttttccgctaatagcagcaattagccggctaaatccgctaaattacacttcatttagcgccattcagtttgcaatttgtgcttgggccaaaatccagagcaggccctgggccttctccaagtctcgctggtggcccaaaggggaggtataagagcaagctagcaagtagcaaggcagcaaccctagccattcctcaatcctcttgacctctcctctcccccaaaagagcggcgacggcggcggcggcggcagcggccatgagcctgtgatatacgtcgacctgcgacacgattctttggtggctgggctgcggagttagagtctcggaggcagcgacggcctcgacctgtagactcgcgacttggggctgctgaggaagaagtttctttcgagttttgagttttgacgccatgccctagccggagcaacaagcaagtcagacaggcaagtttaattttcttcttttcttcttctaaacttagtattgttccttttgctcctttcaaatgtcaggcaatgaggatagacagaggattagatagatggaagattagaacttggaccatgttagttcatgattttttcctgattccatgtttatatgcataattcttgactgatttctgtcaggcaattacaaaaccgctaaatgggattagcggcgctatagcccgctatagcctttcttagcctctacagataccagccgctaaaagccatagccagctattttgaacattgaagtggagttggccaatggagctcgaagcggtgcggatttgggtggcataggccgacagagctcggggcttccaaccgccgcctcttgttcacaccgcctccctactcttcagtgtgccgccatccaccgtccccctcctcgtcgccaaggtgctggggcagatcaggatgccgtctccgccgctcatcctctaaagagttgccgcctacctccctcaggcacgacacgaag

SEQ ID NO: 32084 - DNA, 1501 bp, Oryza sativa
gtacatgtcctatagtttttaaggatccaactgcaaaacatcgtttccaggaggggctaactgcaagtgttcgctagcagcaaacctgcaaatcgcagttgcatgctgagaagaaaaacagtactgctgtttagtgttatcttgttgcaggacagttaaggatattatggtcgtgggaccaggaagacttaatttgagctcaggaaacagtcgccatacctctgtattatgggcatcaattgatgcaccgaattgggcaggcacacttgcctgtactgactaagattccactgataattgtgtgcgtttgctagagaatcttttcttcgagtaactgtttttgtttggtgggagtaacattagatagatttagtgcactactattttttttttacggttctctactaaagtttattaattaatactgtttttataaaagatgtataacttagagcatctacactataagaatgcatactaatatttactgatatactccctctatcttaaaaatactaaaagaaaagtttaaacataaatacaaaatatttgcagcgggtatttttaaacatatagcaaaaaattttgagtttatagggtagtaaatcgacttggcaacaaattacgcagcttaaatcatgtgcaccatttaggtctactattagacaaggttaaaaataacggttcttaaaacaaacagttacccaaaaatggttaaacagttgttagtgccgtttaccgaatgaatgttcaaatttaaaattatgaatgaaaggattggttggattccataggaaacctggttttaattcaaatggagtggggtggcgacagtcgtggaggtgaggagaatcgaggtccacggtgacgggtggtcaaggtggcgagctcccaatggcgcggatcgagccagggcgtgaccgacgagctcctggcggggcacaaatcgggatgtgtgagctctaggtcctcttcgccattattatcttcctcttccctctcttgtttgtttagctgctccccccccccaccccgccagatgcgatgccaccggtggcctcatcctgtaccaacctctctactctcaagctcggggcacacgggggtttaagtggagcaatgttcaaaatagccggctatagccaccgctatagcgggatatagcgaggatagttagcttttgacgctaaacgatgttttccgctaatagcagcaattagccggctaaatccgctaaattacacttcatttagcgccattcagtttgcaatttgtgcttgggccaaaatccagagcaggccctgggccttctccaagtctcgctggtggcccaaaggggaggtataagagcaagctagcaagtagcaaggcagcaaccctagccattcctcaatcctcttgacctctcctctcccccaaaagagcggcgacggcggcggcggcggcagcggccatgagcctgtgatatacgtcgacctgcgacacgattctttggtggctg

SEQ ID NO: 32085 - DNA, 189 bp, Oryza sativa
tgcgctcgtttatccggtctgtgactggtcacagaccgatcagatcgtgggttaggtggcgacaggcggtctgacgcacgcctcgccccatcccgtcaggatgagagcctccaagcactcgtccctagccggaaccggcgtgttagctcctggagatggcacgttggtcccggtcagatatatgccagg

SEQ ID NO: 32086 - DNA, 1501 bp, Oryza sativa
gtgctgacgagggagtggcagccgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcaaggacaacgggcgggtgacgtaggagcgcgcccgcagcttggagcgcgccctggggcgtgctgccgtcgccgtagacgaggaggcgacgctccccatctcggcgcccttctccatcacctgtggatgtcgaagtctcggatccttcgaccctctcgagcgcctcctcccgcctaggactttggcgtggagggggcggtggagtacgagctcgacggtgtgggttcggctccccgtcgtcaccgctaacgctcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggcttctcaccgggagaccgcgcaggcccccctttgccggttcggccgggggccctgggtgaggttctaagctcctggtctgtggaaagttcgcgagaatggaaaaaacacaagacacgggcgatgtatacaggttcgggccgctgagaagcgtaataccctactcctgtgttttggtggatctgtgtatgaagaagctacaaagagctggagagcaagagagctcttactctagaaaccctcttctcccttttttcctctcgtgggatctactctccagttcctctctcctttcttcttttcgtccatcgttcttttttccgtccccccttgctaagtgggcgaggtcctccttttatatctcaaggggataccacatgcaccatctctcttttttgtgtggggacttatcctctcttttctcaaacttgacttgccttctcttcataaatggacggagatttgtaatggttgccgtccgaatgaccttctgatgggacggcccatacctacctccacttccgccgaaagcaggtgcgacgtgggaacatggctgtctgccgacgacatgaccagtgtcagaccggtcacaaatcggtcattcttgtccaccacgtgtcagtttagcaatctgcatgttcgcccttcttcatacaatatcttgcttgtaatggttgggatgaagcctggcatatatctgaccgggtccaacgtgccacctccaggagctaacacgccggctccggctagggacgagtgcttggaggctcttatcctgacgggatggggcgaggcgtgcgtcagaccgcctgtcgccacctaacccacgatctgatcggtctgtgactggtcacaaccggataaacgagcgcgctgcactgcgttacatgcggcgtgacgcgctcgtctaa

SEQ ID NO: 32087 - DNA, 1501 bp, Oryza sativa
tgaaaaagctccgcggtagtctggggctctttggaggcgatcttttcgagcatgcggttgtgccgcacacccccttgaacgcgtagatcaccgcgtgtgcagggatgcatggtatggtgttgcgaacttgacaaaaccgctgaatgtatgagcgaagtgactcatcatcccttcgctgtactgcgtgcaagtccgcttcttcacctgggcgcggatatgtgccttgaaagttcatggtgaactgttggcacaaatcctcccaggagtggaccgacgcgggtggcaagttcattagccaaccccgtgcctgccccttcagggccatgggaaagaaattcgccatgaccctgtcatcgcccccggcggcctcgatcctggtcgcgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgagttgaggtgacactccggacgaggaggcgccctccgttgcgtgggcagtacgtcgaccattacgccggcgttcgatatcgatgcgggcatctggccccccacgctgatcttcccgggttggaggtgctgacgagggagtggcagccgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcaaggacaacgggcgggtgacgtaggagcgcgcccgcagcttggagcgcgccctggggcgtgctgccgtcgccgtagacgaggaggcgacgctccccatctcggcgcccttctccatcacctgtggatgtcgaagtctcggatccttcgaccctctcgagcgcctcctcccgcctaggactttggcgtggagggggcggtggagtacgagctcgacggtgtgggttcggctccccgtcgtcaccgctaacgctcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggcttctcaccgggagaccgcgcaggcccccctttgccggttcggccgggggccctgggtgaggttctaagctcctggtctgtggaaagttcgcgagaatggaaaaaacacaagacacgggcgatgtatacaggttcgggccgctgagaagcgtaataccctactcctgtgttttggtggatctgtgtatgaagaagctacaaagagctggagagcaagagagctcttactctagaaaccctctt

SEQ ID NO: 32088 - DNA, 421 bp, Oryza sativa
taaaccgcaataaatgcggttaggtgagccccgttatgctcacctaacccatacacgcggcgccaaacccacaaggggttggggcgcctcagccctcggggccgaaacgggagcggtccgacccctcggggagacaaagaggggggcggccacatcaccctcgggcccgacccccccgagggggtcaggccacgtgggtgattgctcctgcccaaacctctagtcatgatactcccggtcccatgtcaccgacagtagcccccggcgttatgccagggcgatcgccctccttgagggaagcggtcgggcgtgacgccacttacttaggcctggtgacaagtggggctggtctctacagttgggcagaaacccaacggtcgcaaatcacacacatcggcaatggtaactcggctgtcaataa

SEQ ID NO: 32089 - DNA, 580 bp, Oryza sativa
tcggggccgacccccccgagggggtcaggccacgtgggtgattgctcctgcccaaacctctagtcatgatactcccggtcccatgtcaccgacattagtgataaaacaaatcacaataaaatatactataattatgtaaattttttaataaaatgaatgatcaaatgtgtgttcaaaatcaatggcgttatctattaaaacagagataaatctatttttaaacattttttcataataattaattaatcatgcactaatacatatttcgatttttcgcgagggtctgtaaataagatgtgctgagtgcatggtaaaacaaaaggtgaaatctagcacaagtgatattgtatgacactcctcgtgggggaggtctcatgtgcacacaatgtggccctcatcctttggtcaaatgcagataatacgtcatacggtatattagaaagaaagtaatttgcagctaaaaaatttatatatgtgttattagtgactttaaatgacaatgctgaaaaataaaatttgataaaaactttacaatcatctttttaaaatttaaatttaacagcgattgatgttctataga

SEQ ID NO: 32090 - DNA, 243 bp, Oryza sativa
agcggctagttattttggttaaaacattgttgtttctatgtgtcaataatgtgttttacctgtttttgcattcattataaagctaaaaatatttgaaagtaaaagcaaaaagaatgttttaacttctctattttatgaagcattatctcatctttaatcagaatacttacctagagtgcttgaccccgagggaaataggctcactcctcatttctctacctcgttgccctctcgcccaccaga

SEQ ID NO: 32091 - DNA, 499 bp, Oryza sativa
gagttttttcattcaactttgtagggttgtttattcatgtgttaccaacatatatgcgattatttttgagattttcttagtacttctgtaaaaaagttttcaattttacaattaagatgtggttttcaccgtatactagctaaatgtttatgcatcgctacatatagataaaaggagaatttcataatattgcctaaaataagcaataatatattttccatgaaatgtataagctaccaacctttttctgtagggaatacccaatttaatttaattttatattgcctattcacttagatttagttgttatgtaatattaaggagttcaaggggctaatatgtaaaatctataatgaaagtaggtgagatgtagaatccctgccattatcattagtcatatatactttcccacgtatatgcatgtgtcaaaaaataaaagatgtattctatgtttgccctgcacatgtagatgtattttatttatctatattttatcttt

SEQ ID NO: 32092 - DNA, 1501 bp, Oryza sativa
gaatatgagaaactgtaccttgcagctacaaaacaaactgctacaaaattgcagctagagttcagacaaaattaactattgacaactatctctgtctccaatgacagaactgcttataactatttctaaagaaaatgacaaaacctatttctctatacattatgtttcaagttgggagcaaaaaactgaagtaagcatgttattcctctaaatccagctcggatggtctgactgatgagtactccataatgagaatgacccaatagtaagcatgtttattcgcaaatttatgggctatatatatccagttattcttcacagatggggaaatgatttacatcaaaagaaaataattagtgagaaaatgaagttagggagaaaataattagtggcaaggtttagaaccaggcagaggtgcagcccacctcctgccgactatatcatacgcgatgtgcagtaaaaaccctaaaaaaattttccccaactacaccgaacaaaacttcaaagcacacacatcatgtggtttcagatccaggatgctttactcgacattgggcaaaatcaagtcaaaaacatatacccagtaaactccaaagcatcaaggaatgaaaaaaaaactacgcgggaacccccccccccctcccttgaaatggtagccaatccagccctaaacaactcacaaaatccacatgatagaaaatctggagctgaggggatcaggccgtcgcggcgtgagatttgaacaaaaaagagagatgaaaaaacctgaagtgcctcaactcaagcgcgctcgccttcgacggcacactcgcggtgccttccccggcgccgtccgcggccgctcgcggtgcacagcccacctcccccgctcgcctccccttccacctcctgccttggaagaatctccggcaccttccgctcgcaggactccgtctccccctgctcgagaaaaacacaaacgctatctactcgagaggggaagtcgagaagcagaagcgctttctagatgagtcacgggtgcggacggatttctccagagctatttgtgggctgtgggctgtaggctgtgggctgtgggctgcggactttgggcttattagcaagggaaagatgatggcgcgcacaaaatcaagacacataatcgacggtcgatgcgatcgactgatggattaaaattttgcaggcgactgcaaaatagcaaaagcgatttagtattataggttgggagaaaaaaaaaagaaaatgagaaacccataagcgtgaaacgtaatggacagactgtgggcctcgaatactaaaatcggcccggcccaaattcacgtagtcacggcccacataagcacagcacagcactcgctgccgccgcttgccatttgctagaggtggccaaatgggccgggccaaacgggcggcccggggcacggccgaacctgtagcaggcacggcccggcacggcctgctacagtaacgggccgtgccggcacggcacgagtagccgtgc

SEQ ID NO: 32093 - DNA, 822 bp, Oryza sativa
caaatcttttttagggcagataagcaagcaaattctgacattccttttttccgtatttttatcttactgatctttactgaaattatctttgctcaactaaatactgtgttctaattcatatattaatgtctcaagaagtaatgaagataaagtttgcagtatgtggggtagcactgtagcaggacaatgtaaatgcattatgcattatcaacatttgatttttaatttcctgtgttactagaaaacttaaaagataacagctattggaaatctgccactttattatctgttatctagctataatgtctttaccgttctgtttgtgaaaacagtacaaatctattttcaccaagcaatctgtggcataagtaatttgttgttgtttcaggtttatcatggcaccattttgcccaagccacaagtgccagaagatttatgatgagttctctcgtgtctaaaaatgacaagatatctttccttatgttgctactacattagtctcataaacctaacaaggttgtgagatgtattactcctgaagaaatttattgatgcagcgtcagaaacagcatacagttgaaagtgacattttgttttcttatagtctgatcttcaataactgcagaataatatgagatcgcagatgaatctgatctttgatgtcttatcttaaccacagtagccaaaagatattctcttcttcaggaacctgttattttggcattctgaggtgataaggggtgataagagtttccctactagcaatgctgctggtttggtggtaatatctacacgagaagactgattatgaagtgagacagg

SEQ ID NO: 32094 - DNA, 1501 bp, Oryza sativa
gcaaatcagagtgtcatttccttacttgcttgttctatcaatgtcgccgacgtggagcagccgctggttgttgctattggccctggtgaacacctccttgctggttaaggtgttgcccagcgtctgacggcgagggtcgaagcagtgccttctcctcatctgccgccggccactgccatcaatcgccacggtgtcgtcgtcctcctcctccatggtgtgtcgccgatctgtgggcttttgtcggtgacatgggaccgggagtatcatgactagaggtttgggcaggagcaatcacccacgtggcctgaccccctcgggggggtcgggcccgagggtgatgtggccgcccccctctttgtctccccgaggggtcggaccgctcccgtttcggccccgagggctgaggcgccccgaccccttgtgggtttggcgccgcgtgtatgggttaggtgagcataacggggctcacctaaccgcatttattgcggtttagacgagcgcgtcacgccgcatgtaacgcagtgcagcgcgctcgtttatccggttgtgaccagtcacagaccgatcagatcgtgggttaggtggcgacaggcggtctgacgcacgcctcgccccatcccgtcaggataagagcctccaagcactcgtccctagccggagccggcgtgttagctcctggaggtggcacgttggacccggtcagatatatgccaggcttcatcccaaccattacaagcaagatattgtatgaagaagggcgaacatgcagattgctaaactgacacgtggtggacaagaatgaccgatttgtgaccggtctgacactggtcatgtcgtcggcagacagccatgttcccacgtcgcacctgctttcggcggaagtggaggtaggtatgggccgtcccatcagaaggtcattcggacggcaaccattacaaatctccgtccatttatgaagagaaggcaagtcaagtttgagaaaagagaggataagtccccacacaaaaaagagagatggtgcatgtggtatccccttgagatataaaaggaggacctcgcccacttagcaaggggggacggaaaaaagaacgatggacgaaaagaagaaaggagagaggaactggagagtagatcccacgagaggaaaaaagggagaagagggtttctagagtaagagctctcttgctctccagctctttgtagcttcttcatacacagatccaccaaaacacaggagtagggtattacgcttctcagcggcccgaacctgtatacatcgcccgtgtcttgtgttttttccattctcgcgaactttccacagaccaggagcttagaacctcacccagggcccccggccgaaccggcaaaggggggcctgcgcggtctcccggtgagaagccccacgctccgtcatctggcgcgccaggtagggggctctgcgtgtgtttttctaagctctcgcattctttcgtgtgcgccaagcttttcctgttcagcccaa

SEQ ID NO: 32095 - DNA, 1501 bp, Oryza sativa
aatccaaatcagtttcaagactcgtttggataagagtaagctccaagctgctttgtagttggttcgttcacccttgaacaagactgcttctctctcttggttttgagattgtcaaacagaacctttgcatccattagcatttcatatgaagaactgcatcatttggaagagttcacaggaatgttgtactagtaattcattccaaactcagcaccatttggaatagtttacaggaatgtagcagtagcaattcatccaactatcatatgctatgaattatgatgacgcagcatgatctgtaataaaacagatgtgcctgcattcctggatttgttggttttgtttctagtacagtctaacaactcatgacattccaatcctatataccttttattcgtttgttcttggtactactaattcacatgagtcatgacaaaactcaggggctcagtggtggagatgagctgttgaattagagtttagtgttggtggctagtgagcctggttctgaatcaagcagccttagcacactgtctgttggtcacaaggtctgcataaatcttgccccttttcgtggaaggacaacaaaacagagtgcaagcacatcaacctcttgtaaaatctgcatttccggcgatccattcgaagtgttcattttttttttggcaaaatacttaacataaaaaaaaaatagtcgaatcatgctgaactgtattgtacagtgttggatcatgtggacactgtttatactccatgccttcatggcactgatctgcaatgtgagtatggattcctctattcatactctcttcgtctcgaaataaatcaaactttaactagaattaaatcaaactttaactagaataggatacatcctaatacaacgaatttgacagatttattgtactaaaatgtgttatatcaagattcgttgtactaggatgtcctagtacgagattaatttattttgggcaaaagggggccttaatcaggctggccgacatactccaattattcatctctgtttgtcaagctgatgtgcgcgccttctgaactccattcattaattgaaagcgtcttcttggcttgttgtcacctattaatcgatctgatatgaattcaatacccaaagatacaactcagttgtaatggataattaatgtgtctatgtcaattctttctctgaaggaacccaaatatctcgccttgataaatcctatagctaggggtacgcctaatggacgatcgatcgccctggggatagggtagcgatcagattcgctccccacctctcccctccaccctcccttcctccacctggtttcctttttggctccgtattactttcctattttagtaaatttatgcacctaaagtttatacacctcaagtttacacatctctaaagtttagagaccaaaagtttataagtcaaaagtttatatatccgattcaaatttgaatttgaattcaaatattttttatatatagtatttctata

SEQ ID NO: 32096 - DNA, 395 bp, Oryza sativa
tagtgcaaatggaacatggggcatgggcaatggtggcattggcataagctgcggttgctgcacagaggaaacaaacgctagggaaagcggaaacggaagtgtgctttggataaaggattgcaacggcacaaggttgtttttctgttgagtcctccactctctccaggagtcttctttgtcaaaggattcatcttcatcacctcctgactcctgaagcgggaaatgcatgcccaactgccagcatgaattgcattttactagtaggatttaagaacatccctaccaaaagactctctaccctccggtaacttgcggtacactatgctatgagcaaagaatgcatagcttgcaagtcgttttctcagagtgtcagataaaagttacagaatgggtca

SEQ ID NO: 32097 - DNA, 388 bp, Oryza sativa
ctaactcatgctccaggttctaatgattgaatatcactgcagatcttgatataaacttcttctatttaactgggatgctctattttatttaactaagatagttgttgaacagacgccgtgctaactttagtatttagatgattgcttgaagattgtgttcattatttcgtgagaaatgtacttatgttgcaactatttataagtgccataaatctttaaaatctgttgccccttctgagtaaaacttctgttgcatatttttgttttatttgtaccgaacaagtggggaaatggcgtataattcactgtgaccattcacttcctacttttaccctttttttccatgttagaacagatgcgttgttttacttctgactggtatttactc

SEQ ID NO: 32098 - DNA, 485 bp, Oryza sativa
cacaagcaagattgttttcatgtattttctagaaattgaggtgtgaacttgagtggtatgcgctgatgtgtttattgcctctcttccactttgtttttcttttctcaaacgtttgagatactttaaatgctaatatgattgacctgaccagatgactgattgtattctgagatcatttatcttctttaccaactgtatacctgttatttgcaagataatgattaagcatgtccttccgcctatctgaagctaatctgttgacgttcttaaatctttggtatcaacaaatctcctccataactcaagtgaagccaataattttgtgttgcaatttagatgatgcatagtgaacaaaagttctgtaatttcttatgttagaccacaaagtaccttttaacttgtttccttcttttaaccgtcatgctacttgtttcctaacttgtatttgaattctttttggcatgcagctccgttctctatctagt

SEQ ID NO: 32099 - DNA, 598 bp, Oryza sativa
atttaatagtcaagggagtaataataagtttttttttaaaaaaaaacaccattttctatcccaaaatataccgcttcgactacgtaccatttacttaattttgtagttaatttcagaggtattttttattgctttctgttaatttcaggggtatttttattgctttatgtttcttttaacctttgctttcggaccgctcagatagcttttgaaccgcttagatagtcagaatatagtctagttccagcttcattgcttcgcttattcgtagaataagccaaacatcatatttacacacgggatataatttgtgaataaaacttttatatacgtgttcttagcgatctaaaagtaaagactgaaaaataaactttaatgaaaaaacccaaaaccaactccaaatttaaaattgaaaattcaaattctagctgataagcataagcgaaaagatgatacccttcatttattcacctatttcctccgtcctaagaaatagaaaaaagggacaaagcaacgagggcattttggtcaatttctaagtgctagcgacgcaaagcagacgataatgaatattgagcgaggcaaggcaggtgataaa

SEQ ID NO: 32100 - DNA, 1245 bp, Oryza sativa
atgagtagcctatgtgatgctacagtaaacattctctaattatagattaattaggcttaaaaaatttgtctagcgaattaggtttcatttttgtaattagttttgtaagtagtctatatttaatactctaaattagtgtctaaatacatggactaaagttaagtccctggatccaaacaccacctaagtcagagaacagtagcacatcgatctgctgtccaccaagtatttctgaaatagctcagagattgtaacaaatacttttggcctctcatctatctcaaataaaaataaaaacttttaactaaaacttgtaggtctcatcaagagctgtaacatgcatataaaatttgtcttcatgcactactgcaagaacaaccataggtgtcaattgagaactggcaataggtgttggtttcccagtcagcaccaatttatcggcacctatgcaagagattatagatgccggttttagaactgacacatgtaaagattataggtgcatgttcttaactataataagcggcacctatgaggtacacgcgggacaaaaaagaaggctcgatttgagccgatgcatcgaggttctcctgttgccccaaatccaaatctcacatctcacaatcctcaaatcaccaaatcaaacaagaaggattcctgtacgaacaacaattaagataaaataaagaattgacgccgaaaaggacaccagagtcgttcctagccgctcagccgaccgccgccttgccttgctcttccctcccctgtcccttggctgcatgcactactgcactcgtactctatagatttctcgtttggcgacgagtggtaatgggcacggcggcggcaacagcaacagcagcaggtgaagacaatgacgaggccaaggagacgtactgcagaagtaggtaggaggaggcggatgcggtgggtgggagtggggcggcagggagcagttgaagaagatccatcggcccccaacctccacgtcggctagatctagtggcccacacctccacaccggcggccatagaggagaagtggaggggttttgtagtagcgatgtaacttcgtatgaaggagtgatgattttttttatgaaatagtattgctcccatttctatatgaaggttctcttaagaaactgcaattaaaaaacaaattttgtactccttttcttaagagaacaaccagcaagaatcgtttttcattggcacttttcttaaaaaacaatgattttcacaa

SEQ ID NO: 32101 - DNA, 197 bp, Oryza sativa
tgagtataagatcgctaagatatatttcatctgtacgttcttgtgctgttgacaatttttagagaaaaaagatcactgttgtatttgtgcgaaatttccaaacaaatttgacaaacatattctctaattgagtataaatatggtaaacagcaaaataaccaagagtacaattgcccattttcatccactcctccctt

SEQ ID NO: 32102 - DNA, 203 bp, Oryza sativa
tctatactctatagcagtgatgaattaagtggaaaaatcatgaagtggtattagccatcaaagcacaattgaaatgcacccgcagctaactggagggactaagctttcccaatcaaattcaaacaaaactagtatgagatgagatgatggatttggcatggggaacaatacctggttggcgagggagagggagtggtactgca

SEQ ID NO: 32103 - DNA, 936 bp, Oryza sativa
ctggggtttcagtgactgtaatatggctggagatgcaagcgacagtaagagcacggcaggtgttttgttcatgttggagaacagaaacagaaggtggtggcattattttcatgtgaggctaatacattgctgccatcactgcagcttatcaaggaatttggctcagtaggttgctgtgggagagctgatgcctgaagatcctagttgtgatgttctgaaaatttataactactctgtaagatctttgtaagaattcagtgcttcatgatagatgtagaacacaaaaatactcgctaccatttcatcggggagtgtgttgagcacatctgttcagaggacgagcttactgacattctgacaaagccattgggcaaagttcgttttctgagcaagtttaatagtatagccaactactagctccaattcataaatctaatagcttattcatacaatagttacataatacattattaatacctggtcccacctgtcatacatatactgcgtcttggagtccgtgctacagctgactataaatctgtagccgctgctcttctctctccttatttatctccttaaaatatgtttgtagctgacttataacatgctattgtacctgctctcaggagatgaggaagaagggctgatataggttcaggcgcaccaagatcaaggggtgaatttgatagcttatcttcagtaatcttgtgcgcaaattttatttttgatgttttggttaggccctgtttctttcagcttgggattattataatctagattattgagtcagattactataagctagattgttataatctgtactagaataagcgggtagctgtttctttcctatattattagagcctagattattgggtttgcatgtctaaagagagagtggggtggcatggtgggtaatttttcacccaataatct

SEQ ID NO: 32104 - DNA, 1501 bp, Oryza sativa
gttggatttggatgtttttggattatatgcaaagcttattaaaagggctatcgaacccatgaacaatccgtccaataatctacaaattttctcgaggatatagggcccaaactctaaagaacactccagttgaatgtgcgaggatatatgcacttctctttttcttaggactcgagaaaactaaccacaagatcctcgtacattcagctggtttgttttttcaatagatagattaaaatttgacgccaatgcaaatcgcttgaacgggtgcttcacttttcatcattggcatgtagagcctaaaacactgataatctggtaccaatggaaatggtgatttaataacacagagaagttggacaaaagtgtcaaagtcgtgcgtagccaggaggacaaaccattggtgtcaccataattactccatgggaatatggggtcacttcacaaatatgccgtacaagcatcaatccataatggaatttacaaatgtttactgctgttcttgacaccacaaaacacatggtattcgtttctaatttagatacagatttgacctctgtttcattaacactgctaaacggtgtgtttcatataaaagctttctatctagaatttacataaaatatcaaataagtttagctttttacttttataataattaaaacttaagggatactccctccatcaacttttgatagtcatatttcatcttgacacacagaccaaggataagtaattctacttatcatccatttaaacatgctactggtcattcctcgtaaacaagcgattcattaatatttacatttctcgatgcccatgcaaccaatcttgtgtggaagaatgaagagtcatgcattaaatccgagaaagtcattaagatgataggttgttggattgaaatatgcctatcaaaaataaatttttcagatttgaaaatataactatcaaaagtagatgaagggagtattaatcaaacgttaatggctttcttattttatgtgtcgtaactttatcttcatcttcattagaaaacaacaccatctaacttcacctaaataacacactgtacatcgacatggaccttggctctcccctctcactataatagtggagtcgtattataattcaaaccctattataaattggaaatttcttccagacattaaacccactaattattgacctttagcacactaatagtactctatttgtttttatgcttttttttctaatcttcttactatttaaccacaccctatctacagactgctgtctgctgagatctctcgactcctggaagcgaagcagaaattatcatgatgcttaacgcagcagccaaaaaacttgtcaggttcgcatcttctccagtaaaaatcgcagcatcttctccagtaagaaacgttcgtggaaaccgtgaaattttgatgattttaagcatgtttcacgtacactttttgcagggggaagagcatagctgctcacgtattcttctcctcgt

SEQ ID NO: 32105 - DNA, 224 bp, Oryza sativa
agccgtgaaaaatactatcaacacaaagccttcctaacccaaatatgaaatgaagaagcatagtccttcccataaggtcgctatagcatatgtagtagaggagattataccacaatgacttcaaaatacagcaaataaaatgccaataagactttacaaggtataacaccaaaaagaactgaatgaaaaaattgttgaaatggcaagaacatgacaaaagaaaa

SEQ ID NO: 32106 - DNA, 1501 bp, Oryza sativa
agaccttcatggactctgcccactacacactacactatctcttcttatgtgcctgtcggaaagagtttctatcagttacagtttctcgtggaatctctggctcttccaaacaatatagtttgtcacctaaattctaagaatttgtagttatagaatttagaaaatgaattaaaaaacagaaacttaaaaactcagctttccggccatattttcataagctggctatcaactagcggattcttaaaattttaagctctccaaataacgcctatagctcttcctttatcatgtcgagttaacatatattgcgattaatcatgagatgtatcgctcaccaaatatcgcaatactattttttaagtgcctttgtagtgtagaaaagtctacgtactccatttgttttacaataattcgactattttgggatggtgatggtatataagtcagtggcaggcggtaaggatcattaagaaaaaatactccctccttccctagatgtttgacgccgttgactttttaaaacatgtttaaccattcgtcttattcaaaaacttttgtgaaatatgtaaaactatatgtatacataaaagtatatttaacaataaatcaaataataggaaaagaattaataattacttaaatttttgaataagatgaacggtcaaacattttaaaaaaaagtcaacggcgtttttggggtggaggaaggaatgaagacgagatttttatggatgacgtggtatttgtgctttgtggcaggggcaagaacagagcagggttgacgatgttgactggattcgtcaacagtttctcctctgtgtcaagacccgaaaggtttacacgtctactccatatatgcacatccataacaatgttccctatgtttttaggcctttcaaatggggtttatttcttatgaaaattcaaaggaaacaaactatttttatttaaaaaatattatgtttcaaatacgccattgagattatcaattagtactcgtttcaatcataaataattaatggcttaactcaaataattaacggcttcactcttacgacaatatctttctcgtagagaattagaaaagtttgactgaattatattatatgtcaaatatttttcattgatgggaggatctagtatataaagtactccctccattttatattatatgtcatttgactttcctttaattaaacctctttatatttgatcaaatttacaaaacaacttagcaacatctacattctacaacaccaaattaaattcattaaatttaaaattgaatatatattttgataataggtttattttatattacaaatgttagtattttttaaaaaataaaacaaaagtcaaacatctggtaatatgaaacggatggagtagtagtactactctgcctctgactatctcaccaatggatttgctccaagaatccaagatttatcctaggaatgctttgaaataactcaaatgccacatcaaacaattctttcct

SEQ ID NO: 32107 - DNA, 437 bp, Oryza sativa
ttatagccaacattgcaagcaattcaatgtgttcactactagtcggcacaagtaacatcatatctgactgtttcaagaaatttggcccacatagccgcattgaagaaagaaaaatgaaaggcacgtcctcgacgacagaatttttacatgtttggatagactacaagtaatcctagaagaagtaaacctttagcagatagttgtgaagcaatgtgctaaggaattacaacacaaaagaaaaacgcatgactaaggtgacccatgtgacaaaacttaactaatgcggcttcaacaattaatttgtcgctttcagaaccatttagttattctagatatgcttgtgttccatggtatgttatgtactaaccaataaagtatggtgatagtaccatgatgaagttctcaccttgatatattttggcttctccatctccaca

SEQ ID NO: 32108 - DNA, 1501 bp, Oryza sativa
ttctctagagaatatgaagaagacgatggcaacctgagaagaagttgcccagctgcgttgatcatcctcaacgagtgccaccggcgtcgtgctctcgtgttcactggttcttcgattccaagctcgagtccaaaggtcacagtagagaggggctagttaaatagtttgaaaaaactgggggaaaatggtactctctccatcccataatataagggattttgagttttttcttacactgtttgaccactcgtcttacataaaaaattttgaaattattatttatttttttgacttactttattatccaaaatactttaagcacaacttttcattttttatatttgcacaaattttttgaataagacgagtggtcaaaaaatgcaaacaaaaactcaaaatcctttatattacgggttcttaaaaaaaacccactcctaaatttgaacatggacacaaggttttttttttttacggagagagcatatatgaagggccaaatgaaggacaataattagtgggttttgtgttgcgtaaatttttgaagtacaggagggttggtcttatcgttttagataaggatacggtcttaaaaaaataactttaaccaatatttttaattataatatgtatagaaacgtcaacaaatatatgaatttattgaaatattttttaagattaatttatacatttgacatatttctaagacaaaaagatattagagattagtcaaatatttttaagtttagcatcaagtttatctaaaacgacaaatattatcaatctagaagtaccattggagcatgcacaatgcgatgaagtggtcttagaaagatcagcttggacattaggctccacattggacatgcacgggcccttacgagagcgcttgtggccctacctgcgatgagagcactcggcgcctttcatgtgcgttggtggagccacattttaaacatgaggggaccaactgttggacaataatgtccagaaaaataaaaaccacaatagtagtccaaggttctcagaacttccttttggatatcatattgcccttcgcagaagatgacaaaacatctcaaaatgcttcacaaattataacttactagtaatgtgcccgtgcgtttcaacgagaaatacaattcgtttataatatgtcacttgcatgtatagttgtcggagaacgatttcatctacctttgaggaagaatcgatggacccctttagtacccaaagaccaaagttgtcattttaaaagctgaagagtgtggatcgaggatagaactctctgtcatgaagtacaaccggggattaaagcgataggcataactgatcaaacttgcatttgaagactgcatcgacgatagaactcttcgtcatattcattgatatagccatgctcattgatagtatcagattatcagtgttctgttctaggctctgcgtctgatgagaagaaaagcatccgaaatgatttgtatttatgccaagttttaatgttacg

SEQ ID NO: 32109 - DNA, 520 bp, Oryza sativa
aggttgaatactacaacatgctgtatactccacagagtaaatttcacaaaactacaaatactttggttaaattatcacaaaaccatagatttaaagtgatgtaacacagaactacatatttaacaataaatttatcacacaactataagtttaaggctaagtatcgcaaaactacagatttaataataaaattattatcacaaaactacaaattttggggtttaaatccttagcactaatgttatgttggacttataattgttttaaattttgtgattaaattatcattaaacctgtagttttgtgataactttgttactaaatctgtagttttgtgatattctaccttaaatttgtagttttgtgataaatttagtgttaaatctgtagttttgtgatgtatcaagttaaatctgtagttttctgataatttgatcaaagtatctgtagtttcgtgaaaattactctacacaattgacaagtttggaaatcatccaagtaaatgagtaactaatttaac

SEQ ID NO: 32110 - DNA, 241 bp, Oryza sativa
tgtgatacatatgcaagtctgaatgaagtatggtcagtcattcagcatttcagctgactggaagatcgagtaggtgcgagctgagccagccaacaagcaaacaatgccttctagaacagggcccatacataccaccattgataagggccacgaatcctgtttccttcatgagaaacgtggggagatatctctccctttttaaggacctcagccaccactgatcggtcaaggagaagcacac

SEQ ID NO: 32111 - DNA, 1501 bp, Oryza sativa
aaagccataaacaaacatgatataattcgttgaattcaaaactttcctccaacgtcaggttcgttgttatcacaaagtcgcaagttatcactagtaagaaactcgcgacacataatctctccttatgcatatattcttcagagatcatttaacatggggattttgttaatcctccaagtgggataagaggaaacagagagagaagatggttgccggttgggcttttcaaaggaaaagtaaaacgaggtttgaactcattgcttagtttcctatatggaatttaagggcactaagggtaatgtgtatggatattgtccttatgggtaggccccataataatggtcttcagttatttttgttgctataatggtgagctctagatgcactttagacatgagacctattaagacataaaaaagtaacagtaagtaaagacacaagaaagcgaggggggtggcaaaggggagagagagataaccttaatgtattccttatggttagttatagtggacaaaaagctcaaatctcgtggcttgaatcggctgtagcgagctcggctcagatcgactcgaactcgtagtcttaataagtcaagccaagctaagcatttagctcaggagcttaacgagtcaactcacagctactcgtttagctcgttagttcaaaagatcaacattatgttcacatacttagtgtttcttaattaactagtgatctgtcctttaattccatccaaactatttatgtttaatgaatcgattagttggtaaagtagtatattaaaaattataaagatgatataaatacttaaacaagcctgatgattaacaagctagcttccgagcagggctaggcttttagctcgttaaccttaacgaaccgaaccaagacaagctaactcgttaaagataacgaactcaaatgaaccgagacttaacgagccaagctagctcgttatccacccctggtggttagtccttaggcatacggtagctcatccaaaggactactataattaagaaccactctcataatatataagtatgccataagggcttaagaccctttcctattgctatattgtcgatgcagtcaatctatagaagcttggtgagatcaaatcctctgttccaacttcctgtagttctttgtgtatgtacatactgagcaattaagcttagtgctataaataaacatgatccactggaaaagaacgatgaaagatttagattgatcccacttttagcagagagtagagaccaatgtaaaaagttatgttacctaaaaaaaatgtaaaaagtgacatgttgttcaagaggcatgaataagaaattgcttagggatataatgtaatcctacagcttctttgtaacgcaagatcctaaaaatatagaaatggaaaaaaaaaggcagaataggatgtcacactcccttgtgacggttggggagtggagagtgacggttgttttactccctttgtgattattttgtggttgctagg

SEQ ID NO: 32112 - DNA, 549 bp, Oryza sativa
aacaagaccattggttactcagctgtgcggccattgcaacagaatactgaaaaagaatgtagttgttttactgctgatctggaaagtgtatctgattgttctgtgcagcatacagtaatttgaagggcattttggctctgcttgcctgcacaatttgtcaaaagccacagcaacaaggaagctaacgtttgagctaaccgcaaacagtgaattttgccgaaatgagatagatgcgaattttcagttatcacagccactaatccctctatcctacaagtattcatatcaacttagaaatgaaaataaatagagatgaaactcacagcgcgatccagcaatcggaccctcgcgccctacaaattcactgccatggattcaaatttactgtagctatgtttggataatgggtttagggggggggattgggatagggatatgagtggagggttgagatgaaacgagatatgaagaatgaacggctaggattaaaagttacccttctagaaggtgggaaggtgggataagatttcccctcctattatccaaaca

SEQ ID NO: 32113 - DNA, 1501 bp, Oryza sativa
aagaaaaataattcctaccattatttatttgtattcccttatttaccttactactagtagtacatgtagtttttcttttatgtgttgtcctaattaaaaattgtgtaaatataaaaaatataagtcatgaaaatttattgtaaatatcagaaatataagtcatggttcaaatacctttaatggtataagtcataacaaaataaataataattacactgttttaaaataataagatgaatggtcaaacaaccatcaataaatgaatcacggtacacatattgttggtagtaatagggtaaggctaatgggcgggtgatcgtccgcccctccctatacgctcccttctctcccccttcctcctcccattcttctcttcctactatagtacaccataaaaatttaaaaaaataaaaaaacaaagttggaaaaaattatgtatagaaatactatatataaaaaatatttgaattcaaattcaaatttgaaacggatatgtaaacttttgacttataaactttgggtctataaactaatatttgaattcaaattcaaatttgaacgggtatgtaaacttttgacttataaacttttggtctataaactaatatttgaattcaaattcaaatttgaacgggtatgtaaacttttgacttataaactttgtgtctataaactttaggtgtataaactttagatgtatagaaaatactatatataaaaaatatttgaattcaaatttaaatttgaatcggatatataaatttgacttataaactttgggtccctaaactttagatatgtaaacttgaggtgtacaaactgtgcataaatttactaaattagaaaagtaatacggtgccaaaaaaaaaaaccaggtggatggaggggagagggcacgagctgatcactaggggcgatcaatcacccattagcaatctcggtagtaatatgtgtattttgctatagtcctccctccctaactaaccatttcatagagtcaaagtaatatgttatttctattttgaccggagaactattagttacttgcaaaacaagtttattaataacgcgtcactttcgcgctagtaattaagcgcttctcgtccgtgataagtactccctgtattccaaattagatgttgttttgtttttttaatgtttaaccgttcgtttttatttaaaaagttagtgtaaatatagaaaatgataagtcatacttaaaagtattttgacaaacaaaataaataataattctattaccttttaaataagatgaatagtcaaacgttaaaaaaaactcaaaatgacaagtgttttggggcgaagataatataccactctgattctctgaatctgatcagcattcaggagaggtactccctccgtcctaaaaaagacaaacactgggtttccgtatccaacgtttaaccgtccgtcttatttgaaaaaattatgaaaaaaattaaaaagataagtcacgcataaaatattaattatgttt

SEQ ID NO: 32114 - DNA, 1501 bp, Oryza sativa
aaactggcgttattatcttttttcttaatttgatagctgatcttgtttggtggttgtgtgtggaatcaatgaagcctgctatgattaatgaaacagtaatagatcaataagaagcatcctctaattgtcagggactgaaataattaaaacagaccaagcgtgaatcaccgtgatataggttctgctgaatggattgacttgcatgctttctaagctcacaaacgatattttcttttaaaaaattatgtacataaatttcgttaatataattttaaatcggtttttcaaatttattgtagtttgttgattcatttatacagtcgaataattatcttaaatcatttacctgttcagatatgcacttcaatataaaataaaagaacacaaagggtcccaaataaaaccatgccctcgaataaaaccattttattttacctaggcattactattggccaattttgaaatatatttttggccccatgaggaggaggaattttaaaggcaaagaagacacattgccaaaaaaaaagagctacttgacattcaaataaaaggtgctgaattgtctcttgcgcactaaaactattaatattgcttatcacccttccttaaaaaactttttgcaaggttatcttgtgtgttacgattactttctgatgaaaaaacacataaattgatttttagttgcaccttttaactcccattatatcctcttatggatccacacattagagttcatgatcacattatacatcaaatgaaccgaaaatttgttatttttatacatcgatcaaataaagcaatcattttcattctacggtgttatatctttgaaagcaatgtttctttcgagccataaaggtattgatctttgagaggacacttccttaatcttatatatgtccctttgccatatctacaccagaaacaaaaaggttgatctttcattcacaataaagttaaactagcccaaaactaggatatcctgagttgatgagcccaaaaccagtcggaataatcatttgcctagcaaacacacctattcttgatagtaaggttctgatcaacacctagttcacctttgtcttttgatcgatatattgtttgtaatttgattaatctatttgttgttgtcattattttaaaaaaagtgatatgtgattaaaagtctagtcttgaagtacccctggaatttcaaagaatgagaacataacatgggaagaattaaactaacatagtttacaaggactaatcttccaccatatgagattgtttttttcccttccaagtgctaagctttcccttaaacttatactgcattattaactatttccgagttaatattgcaaagcttccgataataaatgagtataccgaagtagctagaatggaaaatacatcgatctagacatttgtctatacttatcctctttctctcgaagaagaaaatttcacttctgaaaagttgattgtcagaccggagagttgttcaaggactcaa

SEQ ID NO: 32115 - DNA, 1358 bp, Oryza sativa
accaataatctgcatattgtccatcggtccatttaaatattagctgaaagaaagcatcctcaattatagtactaattgagccattgatactacagtaaaatgtagtaagatagtactattttagaaaaagaaaaagaaatacatggaggaagatttgctatatggtacagcatatacgtttggtatttctctttcttccccaaaactctgtagtatacgcattcatcaaatcattctctgccgatgtgagagtttaggatgttcttgctgctacgtttctccgaacatgacactgaattgcctttgaatccgacagctggagcattcaatcctttttgtttttcctcgtattccagttccctgaggttgctgatacgaaagaaatttataggattgttaaattgtttggtcccagctagcaaccctggctacctctctgcccaacctggcatttcctagctccctccctggatggctggaagatctctgaatgttttctttctttctcttttttgaagaaaaatactgtaggaaaggatcctacaatgtatacttttaatttggtcaaatttgtttttgcaggatttaattttgtcaagttactacaatccaattggtaatgcattgggttgttctagtaagattcatggctttatactcttggggaaaacacactgcttaattacttggtaatccaattggtaatatatttttttcatatttattttctttagagatgtgtattttctgagttcagtgggggagatactgcttaattacttctcactgtttttatgagacctcaacaacgatactgaatttgtttgtacaacttgtgattacaatttttttacaggaattcaggtttttcatgttattatcacgaagtttacttgtttttttcttttggactgtacttcaatcctgatgagaacagatcgagatcatttgatgactcttctgtggtgtcagcttgattagctggcttttgcaccggtagcagccggcaaaagtaatctaagtacatccttaaatttataactacatggacatcagggcattcaagaattttggcagcctgcctgctggctggaaattaaaactcaagttttcagcttgcaagagtaacaaactggtccaaacaccgtgcatcttttaagtcattgtcgtttgccttttgctctggctatttgatgctgtcttgaaggcatacactacaacactcgtttctaacatcatgtcaacaaaacttatttaaaattgtactgaagtagttttaatggctgatatgttgattcattttcatgtgaagaatacaaacaatttcatccatattgtaattactgcatgaaaacata

SEQ ID NO: 32116 - DNA, 880 bp, Oryza sativa
taatcatgttttatcatccaacaacaatgaaaatacgaattataaaaaaatttcatataagacggacaggcaaagttggacacgggaaacccatggtttgcctttttttaggacggagggagtacgcatgaatcttaacgtactcttaactattaaaaaaagtgactaaggctgtgtttagatcctggggtgaaaagatttggcgtgtcacatcggatatacggacacacatttgaagtattaaacatagactaataacaaaacaaattacagattgaatttattaagcctaattaatccgtcattagcaatatttactgtagcactacattgtcaaatcatggagcaattaggcttgaaagatttgtctcgcaatttacaagcaatttgtgtaattagttatttttttcgtttatatttaatactccatacatgtgtccaaacattcaatgtgatagggtgaaaaatttcaccaggggatctaaacagaccctaaaatttaagggtttttagttgcttgaaaactagacagcccaggtaacaacatgatgtttggtttgtcgaaccaggttgtgatgggccatcggtccagcctcgttccggatgaggtgaggtgatccactagttttgctcaaacgatgcaatcactatagctaggaaggatgactcgaagacggttaatacgagatgtcaggatgcaaacacaagtcagcaccagagacgaggcatcccatacaaatcatgagattgtatgatcaagcaatttactcttaacgagtggtttctaaatacaaaccaactcgataggattaaaataagagtgtaagtgggtcaacccacgaacccatttatagattaaatacgacaggttttagagaaa

SEQ ID NO: 32117 - DNA, 1501 bp, Oryza sativa
gcctcgtttgtaagggaagaattccacgggaaattttaatgaaatagccatagtagtgtactattagggcctgttcggtagtgagttagaattttgcaacttcatcgtcttatgtgaacatgctttccgagctgttcaacattgtgtcttcttgaaaataaaatattttctacatgattttttttaaaaaaaatcaaataaatcaagcgtgcccttgagtgccactgcagttgctactgccgaatccgtacgcgccctcgagcgtcgcagccacctttggatctgccggctagaaccgccacagtcgcccgctagtgctactagagccatttgcgagcaccaccacaagcatcattgtggatccattcacgcgagctaccgccgtcgtcgaatctgcaagatggcatcgtctccatattcaccagccagtgtcaccgcttcccggtgtccacccgttagagccccaccaatgccaccgtcgtcactagatagtcgccattgtgctactatgagagaagaagaagagatagtgaagggggttgaaagaaaaagtgcacagaagggaaggggtaattaaggagagatattttttatttagtgggatccaacatactcctttaccatctgtacactacagcaagtgctattatataaaaactaggcccactttgtggtacaagacgaccatatggcatgaacaatgcaccgacatgacgaatggatctaactcaccacgtcggtgtcgcaacgtcacatctgcctctgtgatgcctctactagagggaaccttgtgatacaagacgaccttatggcatgaacaatgcaccgacatgacgagtggaaccaactcaccatgacggtgtcgtagcgtcacatctgcctctgtcacgcctctactagggggagcataccctccagaggatgcacacacttcatcaagccatgttatacgaagcctctcacgtgcggaggatatggttcgcaagtgcattggcgcgttgtgcccccacgccctcgcgtggtctccaacccttccccccggccccccacccgtccggcccgaagctttaatcggcaagtggcggtaatggaagaaagcgcagatggagttggggatagactacaagcatggcaagggaagaagaggggactaccatgccgcacggagctcgctagggtctcagcaattgcctccattgctcggagtgaggtggacaaccacgggcaatgagaaggaggggccggagaagggaacggccatctatcgcctggtccatgccattgccggctgcagcttcctccatgtcgccttcagatctgaagtgcccagcaaggacaagaactccccaaccccctcattgttgagcctcggcctcctagctcccctcatacctcccgctgcatcctcctcactctcgcaatagcctcatcgaagccctccgttgacggcgttgatctacatcaaggtcgcccgatttagccacgggccgccgtcgaggtc

SEQ ID NO: 32118 - DNA, 288 bp, Oryza sativa
aaccgaggttaagcatgcttggcctggagcattttgggatgggtgaccgactgggaaatacttcccgggtgacgttacaaaccaaggttaagcgtgcttggtctggagcattttgggatgggtgaccgaccgggaaatacttcccgggtgctggcctatgagggcagtctctgacctattaaagctgccagatgtaagtgggccccggcctggtagaggtgggacgttacaatggatctggagacctcgacggcggcccgtggctaaatcgggcgaccttgatgtaga

SEQ ID NO: 32119 - DNA, 1501 bp, Oryza sativa
gcgcacgatggcgatcacggtggccttggacacggagtacaccgggacagccgggacggggatgacgcccgcgccgctcgacgtgcagagcacgcagccgctgcatcgcggcgccatggcgcgcgcggcgtgcttgacggcggcgagcgtcgaccgggcgttcaccgccatcacccggtcgaagtcgccgaggtccacggccgccatgtcgtcctgcggcagcgccccggcgatgccggcgttgttgtggaacacgtcgaggcggccgtgccgcttcacggcgaggcccacggccgcggcgacctgcgcctcgtcggcgacgtcgcagcgcgtgtacgcggcgtccgggccgagctccgccgccaccgagtggccgaggtcgtcctggatgtcggcgatgatgaccttggcgccgttcttgatgaactccgtggccgtcgccttgccgatgccgctggcgccgccggtgatgacggccaccttgccggccaacctctggtgcgagctggacgccgtggagaagccattgacgactaaaccagctgtccaagtactcgttgttccaaaaactctcttcgtctccctattatgacaccagatcatccatacccattattcagtactcagctacacatatatgattagctatgatagtataaaaaatatatagtgaattcttggtatatagtaatatatatcttgatcaaactcatatagactagtagtaccttagaagagctgctgatctgaacatcctgctaaaaaaatgcagagcagaatcgacctgatcgaactagtcgtcgtagttggctaatgcccttgatgcaagcctccttaagaaggccaggaaatgcctgctggctgctcgtttcggtcttggtctccgtaagtgagtttgtcaaagtctatgagcaactgtgttccgttgttagcctagcagcggccagtgcgatgctagcctttttatgggtctgctgtgtgttggtgctattggtgtgtgggtggtagtatactttttccgttttcctggttacgaccttacaagattgtaatcttctaatttttttcctgctctatcaatagagcttcgcactgtctattacgagtcgttcaaaactaagcacgcacaccactagacacgtatcaccatactcacacatccgtgaatatacaccccttaatagcaagtttaatagtatagcccactattagctccaatttatttataaccaatctgatagccaattcatacgatagttgcttattatactattaatatatggtcccacctgtcatacgcacattgcgtcttggagtctgtgctacagctggctatagatctgtagcccgctgctcttctctcttatctttttctcattaaaatatatttatagctggctaatagtctgctattgtgcggcctgctctaagaatctaacgcatgtttaaaagggtggaaaccaacgctacatctgtaatgtctaaacctgttaaaagatca

SEQ ID NO: 32120 - DNA, 884 bp, Oryza sativa
cagcgtgacacgcttgaccagactgcaataaatgctgttaggtgagcacagctgtgctcacttatcccatgtatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagtggtcaggcgtgacgccacccctaaagcctagtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagatttgtctcgcccggagatacggtaacgccgcttcggtcggcgagcgtaattaacgcgcgcacgatacaatccatttcgattgccacaaccgcatacccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgcca

SEQ ID NO: 32121 - DNA, 1501 bp, Oryza sativa
aaatgttccgtgatttgttatgtcatcaaaatgtaatttctgagcacctgagatatcttgataaagtttaggtaaatgacttatatattacactagaaaaatctccacgcatatacatataccgaccaccttttaaggaggcttaattgcagtggactcttcaccactccatcagctcagttcgattcagctctgcatttgctacattctgagcaggatgttcagagcattccaactcctcaggtatcatgagcttaatcaaaattggagtatattatataacgggcctaggcttttacaaattatatatatatatatatatatatgacactcatatggggctgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagaaatggcacgttagccctggtcagatttataccaggcttcatcctaaccattacaggcaaggtgttacacgaagaagggcaaacatgcacgttgataagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagaggggggactttttcccttttggaaggcggaggggaaaggaagttaatcctttgtaacttgtccatacacaaatccacaaaaacacaggagtagggtattacgcttcgcagcggcccgaacctgtatccatcgccgtgtctcgtgtgtcttgcgggcgggtgatctttccacatacagagagagagagagagcttgggattgcaccctaagcccctggtcgaaccggcaaaggggggcttgcgcagtctcccggtgaggggccacgagctccgtcatctggcgcgccaggtagggggctcggcgtgtgttctctgagctctcatactcttccgtgtgcgccaagtttcccttgttcagcctaa

SEQ ID NO: 32122 - DNA, 1501 bp, Oryza sativa
ggcgccgcgatgcagcggctgcgtgctctgcacgtcgagcggcgcgggcgtcatccccgtcccggctgtcccggtgtactccgtgtccaaggccaccgtgatcgccatcgtgcgcgcggcggcggagccgatggcgcgccacggcctgcgtgtgaacgccatctcgccgggcgccacgaggacgccgctgctgctgcggcagatcccgctgctctccgagatgtcccctagcctgagcgacggcctgaagacgacggtggagaaggaggtcggcgagggtggcgccgtcgtgctgctcgcgccggaggacatcgcgagggcggcggtgtacctggcctccgacgaggccaggtacgtgaacgggcacaacctcgtcgtcgacgccgggtacaccgtgcacaaaggagcgtgacaggtagacgacgccgatcgagcaggtggcgtgcatgcatcgctgcttggttttcaaagtcgtcgttgttgtaattggaataataaggacgtccgtgacaaaatttaagtatttgaagatgatgatgccgtttgaaactcatatagatgttgataaaaattaagtgttttacgcataattatatagtactaacgtatgattaattaagtttaattattacaaactttgaaaaatatatttatatgatattctagagcaacatccatatacaaagttttcgcacgaaatacaccgtttagtagttcggaaatcgtgccacgaatatctaaatttttatccaacttttattggagaaaagaacgaggtctacatctgaacatctgtgtgttgagatttctggctaaaaattactatattttaggacgaatgtagtattaatttatatgcaaattaaggatcaggatggagtcattattaaaaagaaggatcagcgtggagtggactgcctacttttcctctgtatagtaggtggattaattagtctaagcatgtgagggtgtatagccacgtgcgtatcatttgtttccgagaattaatccatatgtcaacaattcttcatccctggaatgaggcctttggttgttttgttagtctgcatgtatgctgtaagaacttagtaatacatgatcatttacggtaatactccctttgttctataatataagggattttgagtttttacttacaatgtttgaccactcgtcttattcaaaaagtttgtacaaatataaaagacgaaaagttgtgcttaaaatactttggataataaagtaagtcacaaagaaaataaataataattctaaaactttttgaattagacgaagggtcaaacaatataaaagtaaaaactcaaaatttcttatattataaggatggagggagtagaaatgagggtttatgccctttaataaaaaaattgtcaacaattatattatgtcgtatgctattcacatggagtacttcacatgtatgagacctggttttctaggattatttagttctgcggagtgcaacgcaacggtgttttta

SEQ ID NO: 32123 - DNA, 1501 bp, Oryza sativa
aggagcgtgacaggtagacgacgccgatcgagcaggtggcgtgcatgcatcgctgcttggttttcaaagtcgtcgttgttgtaattggaataataaggacgtccgtgacaaaatttaagtatttgaagatgatgatgccgtttgaaactcatatagatgttgataaaaattaagtgttttacgcataattatatagtactaacgtatgattaattaagtttaattattacaaactttgaaaaatatatttatatgatattctagagcaacatccatatacaaagttttcgcacgaaatacaccgtttagtagttcggaaatcgtgccacgaatatctaaatttttatccaacttttattggagaaaagaacgaggtctacatctgaacatctgtgtgttgagatttctggctaaaaattactatattttaggacgaatgtagtattaatttatatgcaaattaaggatcaggatggagtcattattaaaaagaaggatcagcgtggagtggactgcctacttttcctctgtatagtaggtggattaattagtctaagcatgtgagggtgtatagccacgtgcgtatcatttgtttccgagaattaatccatatgtcaacaattcttcatccctggaatgaggcctttggttgttttgttagtctgcatgtatgctgtaagaacttagtaatacatgatcatttacggtaatactccctttgttctataatataagggattttgagtttttacttacaatgtttgaccactcgtcttattcaaaaagtttgtacaaatataaaagacgaaaagttgtgcttaaaatactttggataataaagtaagtcacaaagaaaataaataataattctaaaactttttgaattagacgaagggtcaaacaatataaaagtaaaaactcaaaatttcttatattataaggatggagggagtagaaatgagggtttatgccctttaataaaaaaattgtcaacaattatattatgtcgtatgctattcacatggagtacttcacatgtatgagacctggttttctaggattatttagttctgcggagtgcaacgcaacggtgtttttatttttctcatttctagaagtattctttccaatgagcagtcagacatctgatttgcaaaaaggaggaaattggtacagtacacttagttggtaccaggcattttcagaccacacaggcgttgcctgtctatacagtatcaattgcgcctatggtccagacatgacccaataagactcgggtcgtgccgtgtcgatgcgaaggcatggcttgcctagcatgctcatccttagaacaagtctaatttatccccctcatctctttggccttgtcttatatcgatgtaataagtttattttgcatttgtcatatatttgggccagttagggttatgaactcataatcatggaatcgactcgatcatcagattataagttcattccataccagaccagaccgtacaca

SEQ ID NO: 32124 - DNA, 1501 bp, Oryza sativa
acgccatctcgccgggcgccacgaggacgccgctgctgctgcggcagatcccgctgctctccgagatgtcccctagcctgagcgacggcctgaagacgacggtggagaaggaggtcggcgagggtggcgccgtcgtgctgctcgcgccggaggacatcgcgagggcggcggtgtacctggcctccgacgaggccaggtacgtgaacgggcacaacctcgtcgtcgacgccgggtacaccgtgcacaaaggagcgtgacaggtagacgacgccgatcgagcaggtggcgtgcatgcatcgctgcttggttttcaaagtcgtcgttgttgtaattggaataataaggacgtccgtgacaaaatttaagtatttgaagatgatgatgccgtttgaaactcatatagatgttgataaaaattaagtgttttacgcataattatatagtactaacgtatgattaattaagtttaattattacaaactttgaaaaatatatttatatgatattctagagcaacatccatatacaaagttttcgcacgaaatacaccgtttagtagttcggaaatcgtgccacgaatatctaaatttttatccaacttttattggagaaaagaacgaggtctacatctgaacatctgtgtgttgagatttctggctaaaaattactatattttaggacgaatgtagtattaatttatatgcaaattaaggatcaggatggagtcattattaaaaagaaggatcagcgtggagtggactgcctacttttcctctgtatagtaggtggattaattagtctaagcatgtgagggtgtatagccacgtgcgtatcatttgtttccgagaattaatccatatgtcaacaattcttcatccctggaatgaggcctttggttgttttgttagtctgcatgtatgctgtaagaacttagtaatacatgatcatttacggtaatactccctttgttctataatataagggattttgagtttttacttacaatgtttgaccactcgtcttattcaaaaagtttgtacaaatataaaagacgaaaagttgtgcttaaaatactttggataataaagtaagtcacaaagaaaataaataataattctaaaactttttgaattagacgaagggtcaaacaatataaaagtaaaaactcaaaatttcttatattataaggatggagggagtagaaatgagggtttatgccctttaataaaaaaattgtcaacaattatattatgtcgtatgctattcacatggagtacttcacatgtatgagacctggttttctaggattatttagttctgcggagtgcaacgcaacggtgtttttatttttctcatttctagaagtattctttccaatgagcagtcagacatctgatttgcaaaaaggaggaaattggtacagtacacttagttggtaccaggcattttcagaccacacaggcgttgcctgtctatacagtatcaattgcgcctatggtcc

SEQ ID NO: 32125 - DNA, 333 bp, Oryza sativa
catctcccctagctagccctggctacatgtacaccagtttcttttctgagagagaatttattgcatgagactgagtttactttagatcaacgatttaccatctatcttgtttccctttataatatgccactgagtttatcaattattttataatatgctattgagatggatacctttgaaaatagaaatactacataatgatataccgttgcaatggaatagctgatgtgatatctgatctaatacctacaaggcatcatatctggtcttagaaataccatgacgatgttagcatagaacctagataccagatctgatacctacagggtatca

SEQ ID NO: 32126 - DNA, 659 bp, Oryza sativa
tgtatgtatgtatgtatgtgtgtgtgtgtgtgtatatatatatatatgtatatacatatactatatatgtgtgtatatatatatatatatatatatatatatatatatatatatatatatatatatatatatatatatgtatatatatatagtaaatttgtttggtgctccatggtgagtgtcctatatatgtgtatatatatatatacatatatatatatacatatatatatatacatatatatatatatatacatacatatatatatatatatatatatatatatataaatttgtttggtgctccatggtgcccgggcactattgttgaaattgagtatatacccaattcaaatgagtatgaaactttttcaattacttaggtattaacattaactactttactaactagtttaaagcaagtttgaactgaatttgaacttgtttttgttagattttgattctaggtatatagtatccatacatataattagttaggtatgtaattatggattgtgaaataaagttaaatttgagttgttttgttgataagtataggtatgaatcaaattattataactaggtatatactcacaatttgaaaattttgaaaaatttgagtgattttgtgcattagataccatggtgcccgggcacca

SEQ ID NO: 32127 - DNA, 193 bp, Oryza sativa
atcggatcctgttaactagcacagttccttttcccctcaactatcaactgctccgcagaaacattttaacttactttttttaaaccaatctttctattggcaatgtagatctataatgaagggtctataatctattgtaagtttttttttcccagcagaaggagaagaagccactaccagtaaaaccatcaga

SEQ ID NO: 32128 - DNA, 296 bp, Oryza sativa
atatctggcgcgaggggcttaccaacgaactgaacctatgtcatcctattgttcgctgatggttatccagaatacgaatcttaaaatttaatttagtagttttcttcactacgccggaccaggttatctctgacgggcccaaaccctcacctttgacgggtttggtcttggtcagtgattagtggtcactgatgacaaaatcacctgtgacggatgaaacacccgtaacagataacccatctctgaccggtatataaatcatctctgacgggttaaaacttgtcacccgtcacaga

SEQ ID NO: 32129 - DNA, 312 bp, Oryza sativa
atggatggatacatgccctttatcaaagtcatacaactcaatcagatctacacacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagtcatttagggcgttaaatatatgttaaatgattcagacaagcatagacaaaataataacattgggttagtagtcaatatgt

SEQ ID NO: 32130 - DNA, 415 bp, Oryza sativa
  unsure (1)..(415): unsure at all n locations
tatgcgtatgtgactctgtatatgcatgcaaaaaatatgactgaattatccttctaattgaaatccttccatgacttgataatggcaacttggcaatctaccctatagttcaacaaatactttcactcattctttcattctttcattcatcgctcaacggtctagattatccctgtgaaatccaatgctccagattcaccctccccacaaacgagtgcccccttcccaccccaaccgcgcccaaaccgtgatcgctcctccccagccctaatctctctcttctccctctcacgccgtcacgcgccgncagctatctttaccatcacaccgcctcgccacgattgacgtcgccgctgaccccagcttcccgtagaacgctaaaccctaacctcttctcttttcccgccgctcgagg

SEQ ID NO: 32131 - DNA, 563 bp, Oryza sativa
gccgctgccgtcttccccgcccacggccacgagcttgaccttgatcctctcaacctcgccggagccggagccggagctcgatcctccatcgctcacgaaagggttcctgtaggcggcgctgcggtcgccgagccgccgccatagctcgggcgggatcgtgtcgcgctcccgcgcgttgaagtcgtcgagggcgacgtagatggcgccgacgagctgctcggttcccagggagcgaacaagctccttccacgcctccgggatcgcctcgccgtcgcccgccatggatggcagcaacccgaacgcgatgcgagaagcgagatcgaaagaaagatcgattccaagcaaaagctctgcttccactcgtgtctctgtttcttggatgagcgcggagaaggaattggcgccaaatttatcgggggaaatacttgtactccttctccgattcgatttcgaactcatggacgcgactgcgtgcgtgtttccagcgtaatccgaatcggagtcggagtccgagtccggtcctcgccatgaattcgaatcggagaagaagagacaattcttcc

SEQ ID NO: 32132 - DNA, 194 bp, Oryza sativa
ggttgcttgtttggggtcagtcgacggtcgatgtcatgtgcctatgatatgactgtcttaataaggatatttgcttgctcttttaagtgtttttaattcagatcagaacaattacagttttaattcctttgtaataaagtttagttcctgagtatctgtttttcttcttttccccgtctgctcttccctccaga

SEQ ID NO: 32133 - DNA, 871 bp, Oryza sativa
gaatatatcgttagcaaaaaatgtactattgttgatagatgcttgcagaatctcatcctcgatcgcactgtcatcatggagggaaaagttacgtgcaatttagtaatttcttacgataagaacctcattttttcagttagcaaacaatttactattgatttaattagtgcacagcgatgatttttgcccttatttacttatggttttttaatatattaattgagtcggtagtaaaatttttactggacgttaaaattactgtttctggaagctttgacagtgcattgtgcgctgtaatttctaaggttattttaaatgttacttttataaaaaaaaatatgggaatgtagggaggtagttatggatcagtggactcccgatccggaaaaaacgcattccatacaatactgaggaggtagtgtgtttattcctcccagtcagcattcaaagtcgagtgaaaaagcttcgctgaagacttgtgtaatgggatctccagtgcatacttccactacctcgccatcgtcccgtttaggtgttgacggtgatcattggggggatcatcatgtgaatgccgggcatccaggcagtccgtcaacaccgtcaggatcccatgaaggtgtggatcgacctccttgtgttcaggcatgtgagatgaatacgcctgagaaggatcgtgtgtacagacatgtaagtttccctgaacgacctttgcaataattagaacttctgtttcttccttaattgctgagtgatgtttgacacggtagttggcgttgttttgcgatttattccatttaattactttagtaaattatggcgtctgtaaatgaatttttttctgtgtcaatatgatatcccatatcgtcatgtt

SEQ ID NO: 32134 - DNA, 1501 bp, Oryza sativa
taaattttacactcgcgctaactttttaagtatgatcaaaataccctaattaagacttaagtgggcttcattagttaaggattcgtcagatgtcaagcatacacgcttattgtttctttttctttttgaaaattaattttaaattaaaggcataaaggaagatgtatggaaagagaaaagaagctgctgactaaggggcgcccggcctctgttaatttgattaattggtgatctcagcgatgtttacaacaaaaaaatatatatacatgatcaaccaaactaaatgcagtgatatgcacaagcttatgtacatgatccaggggcaggtttggtccacaggggtagcaaaccgaaacacggtctgactgcatccatggttagatctccatctgaatgctagtcacatgcggtcagtcaaacagacactctatgagttaattatcccaacaaacttggcgacagataatctaatgtctctgtcatcagggctactaattaactaaacacttcgtcgtatgagtgtttaggttgcataggcgatatatgtagcctagccatctatcttaattgtctttcccaggaatcagctcgatcgttgacaagcatcagctcatgtgtgcacacattgacacactggcatgaccggtagttaagctgcagcgtgcgttcacatgacacacatctgcatgcaaagttggagaagttttaaaaatgcttgcacgcggctgaagctattttttttttatcgaggaaagggggctaatttggaagcaagcagaagtttaatcatctttgtatatacaagtagacagctggccacgttacgtactattcagaaagtgtgaaagtattacaaaattacattgagaaagtgtggaagtattatccaaatgtaatgtgtatatattactgtagtgttcagtgcacatgtcaaatttcagtgtagtagactaactgatcatggccacatcttgctgttgtgagctggagtgaagcgccagaattttacacaaatctaggctcgattccttatgtttataaatatatttccatgctgtccttaagtatatactttcttcataccaaaataaacaaatctagaacaagatgttatatttgtaggatcgaatcacaagaactaagcccaccagaggaggtgaatggttggtatacccaaaaaccgaaaacttttagcggaaataaaagttgccctcgaaatcgatggatcgcggtctgaccgaagtagatgcaccggtctgaccgcctggttgccgtcggtctgaccgagattcaatctccggtctgaccgccgagatcagctgccgcttgctgtcgccgccgccggtctgaccgcccgtatgccgccggtctgaccgccgcttgtcgccggtcggaccgccgttgagtcgccggttagaccgccacacccgatgaaacacaaatcgaagaactctcaaagtagatgacaactttattacttctctctgtgtttataaagtgc

SEQ ID NO: 32135 - DNA, 174 bp, Oryza sativa
gtgttaaggaggtaaatcttttgttttcctacttaagtcaatgcatgttttattcttgtctatttaatgtctatttatttattttggattctcgcattcattttcttttaagttatgtcatgttggtaactaacggtgaatttattactttttcatgtaggatggccgaggaga

SEQ ID NO: 32136 - DNA, 1501 bp, Oryza sativa
ctccaagatggaatttgtttttagtttgagatttggacagtaataattaacaagtttttttttctacgaacacaacacaaatacttttttcacaaacgcgcaaaaatattacacgtcaatatattagaagagaaaatagttttttttgttacgtaacgcaatcagtccgatcggcttttgttttgctaggggaatgaaaaaacaaaactaaaactaaaactaggaaaagactactacaacggctaaacacaacacaaatacatacgcttataatatgcgcacactcatccctataatacgagcacctccgaaagattgtatcgatatactttgagattaatgaaatcactaatgaaatcactaagaatatctcgctatcagttatattgtttattattattgaaaaaataattaaccataaatacaagtattcatatcaaatcttggacacaacattaattagtaatgaggtgctatatagctggactgcgcacactgacacaagttaaattaatgaacacaaccacagaaatatggtgatggtgatgtttcactgaaccaacagttagcaccagtctagtaaaggcttccactgcgagttgaccaaaacaaaataaggatgccaaatcgcatgaacgatcgatttgacaatttaaaattctagttagggcttgttttatttccaaatcaagctagaaattaaggagggtatatgatgactagaatttgtctccatgcaccagttgagaggagccgttcatgtggatctggatgctggggattatatatcaacaactagcaaggttaattccagtgaaatggggccaaaaatagggaatgtcaactctaacctactaacctacctaattatagtttccttagctaaatatcaaatacttcatctgttccaaaataaacttgcctaaactagatatgatattttataatataataaatctagatatgtttattgtactagaaaatattgtaagatccacgtgtgttttgattcttattctgtgatgaataattggcatctgtgattattggttttgatatttggagattactgttgaagtggttttggagatgattgattttcagatgatgaacagggtttgctgttttgtcgggaccgatcagactgggcagtggttgccggtcagaccggcttgtgttgcacggtcagaccggccggcccgcaatctgaccggccgacgctatgtcggtttcagttttgggttgtttctttggatatccgtgattatttcatggttatggcttctagatggatactatacgtatgtaatactgttgtttgctaacaatgagtcaagttggtgatagcttggtctcggaatatggtttctttgtttgtttcatgtgtaggtggctcgatgcctcgggagagtatttgcagtgatggaccaggagtcggcttggtggtaagacgatgtccgtggtggtcagatatcatgcgggatactaaggctagagttga

SEQ ID NO: 32137 - DNA, 675 bp, Oryza sativa
ttcctgcagccctcctacttgatgcatctcaacattatctaggcctaagcctgaaaaaaaaaatcgcaatacaggccctgttcgtttctccaactaggagagattaaattttgtattatcatggctgctaaacgatgcgtttcgtgcgaaaactttctatataaaagttgttctaaaatatcagattaatctattttgaagtttgtaataattaaaacttaattaatcatatgttattactacctcgttttgcgtgaaacacttaatcttcatcttcatcttcaggagattcaaacaccaccgtagccgtgtaagtttttttatttactctatcatccttgctgatccccccctaaaaaaactatattatataaggctcctgtagcctttggctacctagataatgaacataagcacattattaacaagacaccgacactccgacagcttgtctagcgcccatctcatagtttaagaaaatgatataaaaatgatgcactttattcatgaaaacgaaaacgaaaaatattcttcaagattgttctctttttatatatggaagactcatatgcgtataattctttacatggcagtatataatattaaactactttgtttatcttgttaaagagatagacaaagcatccccgcaaaaaaaaagtagtttaatgggaa

SEQ ID NO: 32138 - DNA, 1223 bp, Oryza sativa
ttcctgcagccctcctacttgatgcatctcaacattatctaggcctaagcctgaaaaaaaaaatcgcaatacaggccctgttcgtttctccaactaggagagattaaattttgtattatcatggctgctaaacgatgcgtttcgtgcgaaaactttctatataaaagttgttctaaaatatcagattaatctattttgaagtttgtaataattaaaacttaattaatcatatgttattactacctcgttttgcgtgaaacacttaatcttcatcttcatcttcaggagattcaaacaccaccgtagccgtgtaagtttttttatttactctatcatccttgctgatccccccctaaaaaaactatattatataaggctcctgtagcctttggctacctagataatgaacataagcacattattaacaagacaccgacactccgacagcttgtctagcgcccatctcatagtttaagaaaatgatataaaaatgatgcactttattcatgaaaacgaaaacgaaaaatattcttcaagattgttctctttttatatatggaagactcatatgcgtataattctttacatggcagtatataatattaaactactttgtttatcttgttaaagagatagacaaagcatccccgcaaaaaaaaagtagtttaatgggaaacgattttgctatatatttgtcgacaaattttcttttaaaaatttgacagatgtaattacagtacaatcgtagtgtaattacactgtaacttgcatgtaatcacactgtaactatagtgtaacttgtatgtaactttcaaaaatctctttgtaatatgttatttcggtaaaatggaggttgtgggaacaaatccttacacatgtttgtgctgtgattttttttcttcctcaccaaaacaaatcttgtaatagatttaacgattcaaaattacgtgaaacttatatacaagttacaatgtagttacatgcaagttagaatgtaattacatataagttacagtgtaattatactacgattgtattataattacatctgtcaaatttttaggagaaaatttgtcgacaaatgtataggtggtcccaatgggaaaatacacgcagtgtttcttacatgagttgccaaccattccagcccagaatttaagttagtcgggccgctccaaatacacaatagacgggcctggtcagacaaagcctatcattccagc

SEQ ID NO: 32139 - DNA, 1501 bp, Oryza sativa
cccattgatcgcttgtagcagtaacatgttaccggcaacaactaagcaagcttggtccgttcatcgctagtttcggcccaacaacgtaagccagagccgccgtttcggcctaataacattagctcgggtagaaggagcccgaagaagcccatagagttgggctccttcccgcctattcgcccatcacggcccataaaataggcccaattctcggtggcccaaatagtgttgggctggatagaatgcaaatcgtccgagacaggccgtgctgacgggctgtagggcccacaggcatcacgacggccggcggtaggtaattaccgctgaccttagatcatgttgccatgtcacgtggttatacggacacatatttaaattattaaacgtagtttaataataaaataaattacaagattcgtctataaactgcgagacgaatttattaagcctaattaatatgtcattaacaaatatttactgtagcaccacattatcaaatcgtgtagcaattagcaaaagattcctctcgcaaatttgtcgcaatctatgcaattaatttttttagcctatatttaatacttcatgcatatgttcaactgcggtatatcccataggttcagagcattgataaaaggttgacaaatctagataactttctgtcgaaatactagtagtatagtttgtagtactatctccatcccatattacttgtcgctttgagttttattttaatatttaatcatttgtcctattcaaaaaaaaatttagaattattatttattttgtttgttacttgttttatcataaaagtactttaagtatgactatcattttttatatttggaccaatttttttaaataaaacgaatgattaaatgttacatataaaaagtcaaaattacaggtaacatgggacggagatgtagtatttttttcggagggagtaaagtgaggagcacgactgatcgatgataggtcaatcaattgcgcgtcttctattaatggctggctggaatgaaaagccgccggccacgtatgatacgatgggagctagctagtactactagaaagtcaaggcacgagtcgtctctcgtcccatttggacactgaccaagcaagcaaacgcggttgccggctttgccgcctgcaacactgcgatacaaacacaccccacggtcatggacgacgtacgtacgtgtctcctccataaatcaccagactacctgcactaaactagctctgcaccccgccaccgggtcgcgcgcgtcgttgaaacgtcacacctagctaactgcactgcacttctgcgtgtctgcgtcgtgtactcgtgtgctttggtgttttaatttctctctattttgctctgctgctgccatgccgtggtcgtgcggctggtgcgggaggtggaggaggagcagcggcggaagaggaggaggcgctgatcgtgaggccaacggcggtggcggcggcggcggcggcggggcggcgtcggggagggagg

SEQ ID NO: 32140 - DNA, 438 bp, Oryza sativa
ccgaacgacaggcgacgcaacgcgaagcggggtggagcaggaggcggcggcgcacaacgccggcgacggcgacgacatgcgagcggccgcgcgaatcttctccaccggtggctgcggagagatgggggaagaagaagggtttggtggtttctacgtgagaatgacaggtgggcccccttgattcagtgcataattgggccgagtggtgggcccaatttggcggcccagtgagtcacagccttatccgttcgcgtccccgccctcgcttcgccgcggcaatggcgctccacctcacccgtcccttcctccggccgtcgccgccgccgccgcggccgactcgtcggagctcccgggctcattgcctcgccccttctgccagcgcgcggggcccgagcttcaggaggccctacacgtccgtcctggtggtccccaccggag

SEQ ID NO: 32141 - DNA, 813 bp, Oryza sativa
aaaaagcgctttttcagtcgtactcaactctgtagtctctgcttgttttggactttgcttctggatccaaattcacttattgctttacgtagtaatgcatcgcgattatttaatccaagaataatttatgggtttctggtatgtaaaagaaaatagattaagactcggtcagattaatccagctcaaggacgaggttccagaagaacatacagcctatgcaactttccaggtaaaactaagatatattcagacttcaagtggcacatttgtgcatggcatatcttggagtttatacttgttgtctgatcgtacaagtagatgacgcattgacctatgaggctgttatcaattagtctgtacaattaactctggctaacaacctgacgacggggctaagtgtcgttatctttgaagctatacagtggcttctgaccgatggaacctcacgggacacacttgaaacttgatcagcagctagctactccctccatcgtatcctcgtaatataagagattttgaatgattttgaagggatctagattatttatagttgtggatattatgggtaccccatatccatacggcatggttatccgactagtcataggggataacttatatttatgtaatgtgtaacagatcatgacttgggtgttacgtttccttgtatattacggaacggcctaaagtcctggtttgataatattgtgaagtagatttaggaaaccgataccgtattggttaaggtttctatcttgtaatcctgccccccatcctatataaggtgggcaggaggccctctagggggcaga

SEQ ID NO: 32142 - DNA, 1501 bp, Oryza sativa
ttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcggatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaattcttttataccgcagttacttaactttttaggagttggtacaatgcatcttaaaaggtgtcaaacagtaaagctttatatagctgtcccgctgacttttttatatataagtcaaggtgttgtttgggtttttaagcaattgattggatacaatatcattgcttttcgccacgtaagtgtgcatttttattgaccaatattatggcttaggctgattatatattgtggtcattttctaggcggttggtaaatcctttataagtttatttacttggattttataccacatatgccatatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttgcaaagcagtcggtatatcactcggatcatgttattcagggatttacaccgcatatgctacatattaatatcaagttgcttggttaattacgattatcaaaaccacttggttggttggattatttattccttgactatatgcttggtttgttcaattaaccacattgtcaggggctacacctattaggtgcatctagtcgatgcacctgactatatttttcagccctccacagtcttcagatttggtaaaagtactcgggagaccatggcgaagatgattgaagcactcggctttggagtaatctagttcgagagaaggttatcttttcgactgcgaaggtctcaggagctactgtggatattatgggtaccccatacccatacggcatggttatccgactagtcataggggataacttatatttatgtaatatgtaacagatcatgacttgggtgttacgtttccttgtatattacggaacggcctaaactcctggtttgataatattgtaaagtagatttaggaaaccgataccgtattggttaaggtttctatcttgtaatcctgcccctcatcctatataaggtgggcaggaggccctctagggggcaga

SEQ ID NO: 32143 - DNA, 704 bp, Oryza sativa
ccttgccttagaggagagcctagctaaagaatgtgctaaaaatgaacaactagctaatgagctgtaatttggctaatggttctctagctagccttagggatgtcaatgaaactcttcaagaaaaatttgctagtttagacaaaagtcataaagatcttgaagttcaatttgacactttttggaatagcacttctcaaccaaatgtggtttctaattattccaacccatctactagcaatggttgtgctaggtgttacaatattgatttgaacttttatgctactaatgttaatgctatgcaagctcttaagaaagaaaatgaaaggttgggcacattggtgaaatatggatgcatgaagacataccattcaaaaaaaaccctttacaagatcatcaccgctcatcctaacaaggatggacacgggctcgggttttctggtggaagtcctgtgtctaagcgtgtgatggtaaatgggaaagaatgcttgatgtttgtgagagaaggaaaagctccacaagcaagtgaggtgacttgtcccctcactggtcagacacccagaagttccaggcaaaatgaccggaagttcctgccttgtaagacaggaagttccggacattttgtcaggaagttccgggcttctaataggccaaaggggctgaccggaagttccgggtataatgccaggaagttccggccagagggt

SEQ ID NO: 32144 - DNA, 1501 bp, Oryza sativa
tttcaagtgtgtcccgtgaggttccatcggtcagaagccactgtatagcttcaaagataacgacacttagccccgtcgtcaggttgttagccagagttaattgtacagactaattgataacagcctcataggtcaatgcgtcatctacttgtacgatcagacaacaagtataaactccaagatatgccatgcacaaatgtgccacttgaagtctgaatatatcttagttttacctggaaagttgcataggctgtatgttcttctggaacctcgtccttgagctggattaatctgaccgagtcttaatctattttcttttacataccagaaacccataaattattcttggattaaataatcgcgatgcattactacgtaaagcaataagtgaatttggatccagaagcaaagtccaaaacaagcagagacgacagagttgagtacgactgaaaaagcgctttttcaatatccctttaactaaccctgaagagattctcgtgtgctgtacagaagttattggattactgaatactagtatatacagtaggatgtcaacggctttcacacgcacgcacgcaagacctgatcaagaattgagaaggacggattacagatgcggctttattcagttctagatctccaaaattgaattgcccattctcacgcgaccaaatccattatttcgaaagctggattgaattgttcatcgagctcaattgcaaattaaccataaaacatttttgacagcagtagtttggattgtcagacaatcgatctgttggtatatattggattgttgtgtgcatgcaggctgcatgaatgcgcggcggttgtgcacccgttatgcgtgctggactccttcctgatcgaaagcatgagaatatataatgtgatgtgcaaatcaagacgtcacgagctggagagtacgactttcaattcatttgcttgactgtcattttcaccgacaagttaagcatgcatgagatcgatcagaatgcagttttcttttttttttttaagtgcagcatgcagtgatagctggctactctaaggtgacaagcagtttatcaccgacactagctaattaagggacccttgctaatcgagggaggagaacaagtaccatgcgtggtgtactctctggctaatcagcaactatctcatcatgtgatgtgtttgctactgctgctgccagccaacatcagacacagcgcagccagctgatgatatagactcccatctagtagaagtgtaatttgtaagcgaaagataatttgtttaataaaaacttttatatacgcgtttacagtgatataaaatcaaatgcaagaaaataaactttgataagaaaccctaaaatcaacttaaaaatttaaattttagctgataaatataaatataaacgaaaagatgtggctgtatatctatctttggagttgcatgtattttgggtacatatctactcctcgcagtactggtacgtgcttatccatcttgtttc

SEQ ID NO: 32145 - DNA, 1501 bp, Oryza sativa; identical to SEQ ID NO: 32016

SEQ ID NO: 32146 - DNA, 1501 bp, Oryza sativa; identical to SEQ ID NO: 32017

SEQ ID NO: 32147 - DNA, 1501 bp, Oryza sativa; identical to SEQ ID NO: 32139

SEQ ID NO: 32148 - DNA, 1501 bp, Oryza sativa
gcggtagcggcggcgctggacgctgaggtacggccacgccttgccgttgacggtgatgacgaggccgaagtactccggcttccactcccggtcgatggagatggagccattggtgtagaactcgcggtcggcgatgacgaggtggaggtcgtggtcgccgcaggggaggttcatggggtcctcgagctcgggcttctcgatgacgtaggcggcgaggaggccggcgaggaggctgacgcgggtgaggccgagggcgtggtcgtggtaccagaggttgcccggcgcctgcacgttggggtaggtgtaggtcttccgcgtccatgtgctgccgttctcggcgaagtcgcgggtgaaccaggcgaaggcgtggccgtcgaactccggcgggtgggcgccgccgtggaggtgaacgacggtggggacgccgcccttcttggggatggcggtggggaccttggggtcccacgggaggatgtgggcgtcggggaggtggttctgccactccacggcgagcggcacgccctgccgcgccacgatggtgggccccgggaacgtcgctgtctgcagcgattgcccgtacacgaacaccggcgtcggtggcatgtcgcggtggaattgctgcatgcgcaagcatcccattttgaaattatttttcgattttgctacatgtttattgatattttttttcttgaaagttctttttttttcttgaaagttcgatagacataaatatatttaaccgtataatatagctacattgtaacttctatagatgtactgactttggtcaaaattaaactgtttcaaatttatttaagttcatagacaaatatagtaatattaataatactaaactagtttttatcaaatcaataattgaatatattttcataataaaattgtcttgggttgaaaatgttattgctatttttacaagcttaatcaaacttagagcactttgactcaaagtcaaaatgtcttataactgaaatagagggagtatataactgaaatagagggagtatataatataatttatatgaaactttcacatatataggtagtccttttttattttcttaccggtaaattttagcatatttacattatttattattttttagtaataagacaaatagtcaaacataatttcaaaagtcatatatatcatctaataaaaaatgaaggtagtatattgttggatctaaaaataaatatctaagatttgttcatgacaccaaaattgaaatttttactcccagatttaatcatgaataacagttttacttatgataatatggataaatctcaagcgtatatatttttcttaatttaatggtagtttacatgtcttcactatatacgttggtctggatattagatatatattttcccgtaatcacaacgtacgtacccatgtcttgctgtacatgccgatggtgagcttgatgggcactggacggccatggcggatgccgtagccccggatcttggcaatccg

SEQ ID NO: 32149 - DNA, 197 bp, Oryza sativa
tccagattctgaatgtcgaggccgccgcactactttggtttatccacagtcctacatccatgcgtaccaccaatccaccatacgtccccttccccttacatctagacatctagtgatgccaatcgggtgtttaccctcttgcattttcgtactaattaacgaggcttccatggctaaatattattgggtcaaacagg

SEQ ID NO: 32150 - DNA, 1501 bp, Oryza sativa
atatgcatatgtacgttcctatataagtgagtgtgtatgtatatatataagtacctacacctatctttcgtttaaaataaatagataactatttccccttaacttaatcgtcggcgaagagctattttcgctagcgggttttaacccccatctctccttacaattttgcaaacgaagggcgtatgtcaccgccagcagaaaaaaacaatgtgtattaaaaattatttttctagtagcagtagaaagatctgcatgcttctcactccaacagtccaactcgaaagccaatcactgcagcagtcaaccaattcccgagaacttcactggaattaagacatccatgagacgtacatgtccattcgtgatcgtgtcggttcttcctcccgtcaaacacgacttgacctgcaataatttcaactaagctggatagctagtacacatattgcatccaccgtttgctattcatcagccgcgcgcagtccaattttaaagtttcaaatttatcgtagtttattttttaatattaattttatataaaaaagcatatataaaagtttttgtttataaattattttttaagtcgttaataaatactccctccttccctaaatgtttgacacctttgacttttttaaacatgtttgaccgttcgttttattcaaaaacttttgtgatatgtgtaaaactatatgtatacataaaagtatatttaacaataaatcaaatgatagaaaaagaattaataattacttaaattttttgaataagacgaacggtcaaacatttttaaaaaagtcaacggtgtcaaacattttgggatgaaggtagtattatgtcttataatcaactggtagtcgaaacggtaggttgtttcagtttctaactatgaacctctaaacataaacaatacttgtcaaagtgtatggaaataaaattttagtttggaacgaaggtagtagttacttgtatgcataacaatgcttactcatccgtccccatcacgtgaaaaaaaatcttttcttcacataaaaaagaaaaactcatccatccccaatctatatcatatctatcacatacagtcatacagatatgcagcaatgcaagctcagctagtcagctctcacagacaagtcgaaacttctatcacagatttctggtcgatggatcgagttagcctaacttctccgattgtacaagagatatgcatttgttcgcccaaaattgcggctgaatttgtatgcaatcagtgaatatatatccacgcaatttgtcaacttgaacacacaattggttttccttggatacatgtgtggaaatttcaccgaagttgattttcagaagcaagtgaaagagtcagccatgacttagacgcgtttacctccttctggctctatttaagcttgtggaatcgaagcaacctccatttcactagcatctagcaagtgcacaacacatctataaatcgtagtaaccaccttaggtgagatgatggtcatggcga

SEQ ID NO: 32151 - DNA, 1501 bp, Oryza sativa
actcaattcaggttatccgatcaaagatgtccagcacaacagcgcctcatttttgcgtgtcactggatgaaatcatgaaacagccctggtcgtcatagccgacgcatgcaatgaactgtctgaagaaaccaatttgagttgttggttttggacagcagagaatccatcttagcacgaagaaagaaaatgtcagatatgcacatatctgggggtcgatgcaggtatgtgtttaagatgtgccatatctatggtctttgcatgaaacttttatatgccaaaaatatgttacgtacgtctctggactctggatgggtagcaatggcggctatgaaattgctctctgatctgtcgccgtgactttcagatattcagatatctcctgctggtcgtatgacagacgacctcatgtgcttcctgaccatatggtactcgcccatcatttttgtttatgtttcgaaagctgaaatgattcatcctcactaggatgcgagtgcgtgggggtcctatttcgcatccaaaaatgtacattattgttgctagtttataatgtgatgatatatattttagttaaattagagtcggtcaatttgtatttgtccgtgtgcccactcaacatcactagttcttacgataaatcaccatgaaggcatgaactcgacgcatgtctaattggacataaacgcatatctatttggacacaaacgtgaggattatcttattgatttcctaggtcacaaggtttagttggaacggacctaaaacttgtgatgaaacagattaaatggtggatgatgaattatctctcttatagggtttaattaaatattataggatataaagataatcaatattttgaaaaaaaaacctaaggtatgatgaattgatgattgaaaaagtttagggagaccgcattttttggaagcctaattgaaaaacctaatgtgcatttgctataggtgatgaattatggattatcccgcacaaccttcccaagcttgtaaacgatatgatttttctgaattaacctacttcatctacatttctgataataccttttttaaagcaacatttcaacttttcaagatttaattcattcgtatgtgccattgaataattatcataaacctagagtccatcatctgtttagaacaggacctgatctcctccgtaatccataatccatcatccaattttagctaaaccgaacgagcccttaaacttggggcattaaagtgtgtgtatatgtttgttcgtgggttgcatcaattccacgataaattgaaatttcacatgctggcgcttggccttcgcaatagtgcgaaaatatgaaataacagggcagggggatggaaatttaaggatatgaaacaatctttgttgaactgtaatttcgtttattcattattcagcatgattacagagtgccaacctcttccatcttattgtataacaccatatatttcttattccagtatatgatcatgcaaagaggcatgaccaa

SEQ ID NO: 32152 - DNA, 1501 bp, Oryza sativa
gagctgagcacaactttttattcctgaagtagtagtaccactaccactaccacttgctatacttgctactgcatttgccgtttactatttttttaaaaaaaagaaaaatcagcgaggtaaccttatacgacgatttcagaataacatacaaatgatagttgtgcagaaggtatctcagttgccaagcccaaacgctccagaaggatagatgctccacattgcaggctatttttaataggtcccacaagtatctcccctctctgccttttcccaccgatggaggaagctgaggtgccggggcaccggacggaacggcggcaagacggcccaattgatgaatggatcctcgagcaggaagtgccaagcagagcgcggcgacacattgccacatctccttgttaagggcggaagtcgcgggataagacacaaatgatagcgccaccaagctcgctagatccagcccggggcttgtcggatctaaccttgggcaatggaggtagctcgtcgggcgcgacgcaaggatggcaacagctcgacacaagcgccacctcactcctcccttctcttaccgacacctccctctccccaccgcctcaaactccaaccgccgccgccaccgcctatcggctcttcaagacgatgaagccttcccactccccggctctgtcaccgtcccgctcctcatcgttgatgtggcacgagcacgggtggggtagatcgggccatcccatcgagagccagtgcagatcgaggtggcaacactagagcttagcggcacagacatggagctcggcgacaaacggacctagcactcagtggcgacggacatggagctcgatggcgatggcctcgtcgtccacggcaattcatcaagtcatttttcctcccttcctctctctctctctcccccctgatttctgcttcctctccagctttctttgacaatgcctctcactccttgtagggagacacatttttcgcagggatgcaccagttgcctatatggaggggaatcttctaggtgacaagttgaaactcaataccacataaggtggactgtaaaatggcctaacaagttataaacatgaagagatgaagaggctaagagaaaagtaattgagaccacaattatatctcgagctttgaatctacgagactcgaggtggttccttcgtgaaaatcacgagttatatactacttcctctgtttcacaatgtaagtcattctagcatttcctacattcatattaatgttaatgaatctagatagatatatatgtctagattcattatcatcaatatgaatgtgagaaatgctagaatgacttacattatgaaacggatggagtatatgagaattatgaaaagaaaaatagaaatcaagaaaaacacaagagccgtcttttgtcattctttgctctcttttcactcaatgattcattataatttctcaaaaaaaatgtatatgtctactcatagggctttggggccttgttgccaaa

SEQ ID NO: 32153 - DNA, 573 bp, Oryza sativa
cactacaaaattagcaccttatgaaagtattttcaaataaaacttatgatgataaaatccaacttgtaaaactagttttacgatataatctacttagtatccccctcttacataacttacaccgattttaactacacgtcgtttcttaaaagatatttgctctggtccaacaaaaagtatttcaagataccagtatctcatggtaccaagatccaacgatcggaaacgatttggtaccatgaggtaccggtacctcgaggtacttttcgttggaccgtagcaaatctcttcttaaaaatctataaaaaaaattaaacgatatcgtattatcaaattaatttgcatgcaagtataattatactactcgcattcataaaaatatataatttaaaagttgtattggttaaaagtaaaatcacattggtcaatgaccaatgatgtcaagtaaaagggaaggctgagggtacaatcgaagggagtaattaaatgatgatatataacaaacttatctgtgacaggagagagtaaacaataaaattacacatgatcccccaagatatatgaccatggagt

SEQ ID NO: 32154 - DNA, 409 bp, Oryza sativa
ttactgaatattattacgatagttgattaggattgcagcgtcatgtcatgaggcgggtatgctccatcgtcagctacagtaaaaatttaaaaattttaaacttacttttagaactgattttgcagttttttttttgctgtaattcatgtaacatgttctagtactgttttactttatgtggcgtgaaaaagaacttggaaatgctcggatatttagcctgcatcgactagtcggcatatctgcagacttacataaatcctttttttttcaaagtttctgcatctaggcatgttgttcgtccaaaaatgttggcagaactctttttttttcctcagttttcattctcatatttcgtggtgtaccagactccagacagctcaacaaccttgtgtaccgcttgtcctacagt

SEQ ID NO: 32155 - DNA, 1501 bp, Oryza sativa
gaccgaatttcagcgcaaaaatgttaggatcgacaaattcggtcttggtcttttcggtctcggtcatgaccgaaattcaacgacattttcatatatgcaaagaaataatgaaaattttcaacacaaaaatcacaaaaaaaattcgtaagcacttatgagtaaagactcttattaggttgcatgcctagaataagtaggcatgtgaaaattaaagtttaatcctattaaacataatggactgtaggttgtatttagacattttttgataattcggccttttcggtctattcggttacccgaggagactaatcgaattgatcgaacaaaattcagtctttcactacgtaggaccgaatttttcggtctcggtcttttcggttctgtctttcggttcgatttttttctgcccacccctactgtaacatatacaattaaactatagaaagaggaccacttcacactttaagcacgaagattagtctatttaacccctgaagtatgaaattgggtattctatttccgaagaatagaaaccgagttaaataatcctatactaatgatatagctgtggtttttgccacgtggactatagaggagataatgacatgataataggggaatgaatattctttcaagaagtggaaaggctcgagaatgatgtacagtagtgcgtatgtggtaattagtgagtgaaaagaaactattggattgacttgggtttagtagattaatctttatgcatgtaagcaatactgtcattatccccatgaaaaaactacctacaaaactattcaaaggggttatttgagccactttcatatttttaggagtagaatactcagtttcatatttcaggggttaaatagaccaaaccaacactcaaggggttatatagacttatttctaaaaaatctattaaaaagttgcttttaaagtcgtattaacccatttttcaagtttaatataattagtatttaattaatcatatgctaatgaatctcatcgttttgtgtatcttctcatcctctcccttcctctcaaacaaacattcataccttccccttaagagtacaacgttgagtaacatttctcatcctttggtttttgctaggcaatactataataacaagatgaaaaaaaaagaaactatatgttgttggccagtttcagaagaagctgagatccacaattatccccacaagcaccacaaacagtcataccacttgcttaaaaattcgaacaaacaaacgaacaaaccaatattccgcagtaaggaaatgcctaaaaaaagaagaattcaaaatggccatcttccaaaattcatgctcggtgctctctgctctgggaccgggtggcattaatggcaccccacaaaaccaaacaaagcaaccacctcgcacactacacacacagtgcatctccacgccgccacgcgcgcccacgctagaatccaatggacgaacacctcgccgccgcttgatcccctcctcctcctccccaa

SEQ ID NO: 32156 - DNA, 653 bp, Oryza sativa
gtccgctcgccgcatccgccgccacggccgtgtccgaggcgcagacagagtaatgtgcccgtttcttttttgcaccccctctcacttcctcctcctcctcctgctgttgttgtggttgtaggtttgctcgggtagtacagtgggcactgtagtgttaaaagtagaggtgttttactagaattgtggcctgatgaacatggtgatcgttattattcgaagtggaaacatcgattgagcacattgtgggtgcagtgaagattagcaagcggcgcgagttgctaggtggaattattccaaggttttggtggtgtaatgatcagtggtgtgtgtgaatcttctggtgcctaattgaaatggttgagtcagtgctaaaatttgcgtttagtgcggtaaagatattgcatggaaattagaacagtaaaaagccatgtgttatgtggaaaaatgtaaatcctaggaattgttttgttgtgtcttatagttaataccctaggtaatccatgttgagtgggtgcctaggtatggatatattctgattttcttaccttgggaatttttctgatcgcgctgaaatatttcacctctgttttggaaaaaaaagatttgaattagttcattggcaataactacaattaattcattgtagtaggtag

SEQ ID NO: 32157 - DNA, 754 bp, Oryza sativa
tgttcataggttctatggtaaaattgagacttgggccgttgattaatttgtgagacatgtgctgtaatcctgctttagaatgatcgttgatggcttcgcatcctggcttaactctatctataatgcttcaagttgtgtgaattgtgcattggaaattgctactttaggtgcaattcaagttgtgtgaattgtgcattggaaattgctgctttaggtgcaatctttgtgtaggaaactaccaattttgtgtcttcagtggttaagtcgtttattgccattgattaatgtattaatgagttgtctacagtgaaaaagtggggggttagaggacctcctcactgtagataatgtacatgtaacttatgcccaatagtcataatcaatcgtggacttgtcttggtgttgtttatcttgatctggggactaaagtgttctaccatcatgtggtgctttcctgttattaactgtcttggtgaaaattcattacaattgttatgtgttacagtggagctcaattaaatcgctagcgtcaactttgggctgtgatagtaacaagtagttgtgctctgtgttggatttcttttgaaaattgttaagtagtatgcgtttctcagatttttcatatggagtaaatagttgaaggattgctaaacttttagggtttaagtctgtcatgtaaggttgttgaacaagattcagcttgcaggtttcctgttattatctctttgtatgtatgtgtacatacaaagagaca

SEQ ID NO: 32158 - DNA, 1501 bp, Oryza sativa
ggtgttgttttagagatgttcttaattggaacaggatccctcaatcgacagcgagatgactatattgatgtgggaagcagagaggtccaaaaatatagttatgtggtatctttttgttgaaggtttttgggcgatttggctaattaggaatgattggggtgtttaacaacaaacttctaacaaattaatatccttcatcttccttatagagttgtttcttttatgcaacagtgaaagcgtttggtgccgtcgacgctgataggagagatggagactttaggggactcactacttgccaatatccatggaatgtgatagttgcaaatgctgccgcagtgaagacgctcaaggacatggaagccaaccgctgcatcaagcgtctttaaggggcttcccctcaagggggactaccattctcttgcttttagtgcttgctagacctctttatctttgttccgcctgtgtgtgtgtgcgcgcccttctttgcttttgtttatctggtccttgttggaagctgcaatccctagcgaaacgcttgtaagatactcttatgctttcagtaaagctgggcgaaatgccttttctctaaaaagagagagggtaaagaggtagaaaagtggtattttgatttgtttcttagagttagatcgattatttaggaagggattcgaagggggatagagacagacagagagatgaaacaatcgataattgatttcaagagaccaagggagaagtttagaggtgaaacattggagtgagtttgaattcgaggatttgacgaaaattgcatttacggtttttagaagagaaatctgaatagaagggttcgaacttcgagattattttcgagtggagattttgagaagttggattagagatttgaacttgtcaaattggtgatttgaaataatgggaattcgcaacgagaaatcagaaatggtttgagcgccgactcaaatctttaaaagaattattgaactggaatcaatcaaggaaattggttgatagggatttaggagaggggtttgattttcgacaccgagcaaaggaatcaacgggggatttacattaggatctaccacacaacttagactctacactcaaaaaagaacaaaattatcgcatataggattttagtaaattagctttttacacgaggtttgcaccggtagagcaaaggccatgtatcagtccttgttagtataacccatcggtgcacccacacgctttcaacaactcataaacaagtacaagtagcaccaaatttaacctagatttgaacaacatagtacatgtgacctgatgacatgaacaacattaacacacgatgccatattgccatccatatgcatggcgcgtagtaactaagttagtgactgacgcgagcaactagacacgcttcccgatcgaattaatcattttaatccacttttttttcctttaacttcgtctctgcttcctctcgagctaatcagctaagctatatccgatccagacc

SEQ ID NO: 32159 - DNA, 1501 bp, Oryza sativa
taatctccacaccaatctcatgcacaaccccagtaaatttcgttgaactttaagtccaatactgaatgtttttaggaagctatgcatgtgtacgaattttttttgccaaaacatttacaaactctaatatggaacattgtcattgaataatcttgattctctgtaactcctaattcattaaatcaaatggctaaaaaaattgtctgcaaagagttttgtaagaaaattaattttactatgagcacactgttcaatgtttttattctcttttggaatctcaccaacatgatcatgtgcagcgagctagctacgccaggagagttcacagcagctggaagcttctagatcaagagattcaatattcaggagtacagcttagagaactaattttcagctattcatgtacgtaaaacacgtttttctacacagataatgagattggacagctttccccagggtcatgtgtgtacaaatatatatttgtcatcttggagaacaacattaccatgtgacagttcagatctatcatggataatagtacttggataatccaactctatttttcatggtaccatctcgaacaataacatattgttagattgtgtcagccgcaaaagggaaactagttaagatgaattcgaattacggtctgcttgtaattctatactgtactgcaagttctctccaattcccattcgtttcttctatgcttagctataatttttaccctgatataattactccctccgtcccataatataacggattttggagggatgcgacacatcttaggaccatgtatctggacatggtcctaactaggatgtgtcatgtccctccaaaatcccttatattatgggacggagggagtatattttagtcgagaccattcgtagtctttaatatgcgttttgttttagaaaaaggtgctaattaaattatcaaaaggggaaggggtaattaaagtaaggttacagtaaccaaaggctctgtttgtttcagatggtagattattgtgatatattattattgacattatggaattaattaaggacacaaatgaattaattaaataatgaaaaagttaaaatggatctagaaagaaaatctagcatgcttagcgactaaattgcatgataaatggtaggtgtaatattgtaggttgtgtttctgtaggtattattgttgcaactgttaggtgatcatgagtgagattttcggaataagtttgtttttgaaccttcagaaagattgaggggaatttaagggggcaagaattgggatttgaaacttcaaattttgaattccaggaattattgcggggaggggatcgatagagagaaatagggtttgagttgggatcgggattcgaaatttacattttaacttagcgaaatacaaaggatcaaggagagggcatcaactcgagaacttgatattttggggatgggtgtatatttggggactcaaaagattatttgagagggattcaaaagagagg

SEQ ID NO: 32160 - DNA, 1246 bp, Oryza sativa
ttgtgacttactttattatctatagtactttaagcacaacttttcgttttttatatttgcaaaaaaaattgaataagacgagtggtcaaacgttgcaagaaaaaactcaaaatcccttatattgtggaacggagggagtattagcttaaaaaggttaaactccttacacacatctcatcgaatatttacctggtcaatggttgaacaacttgaattgaacccaagatcagagcctctatagatagctgcttctactaagccagtacacaagtatccagaaaaggacacccctagtccaaaccaaagttcacatcgtctccacctactgaaggggtacacctcagccagctagctgcgctgcccaatctatcgatccccaatggcgaggcgcctgccaaagtccgagaggtcgccgtcgccgccgccgccgccgcccggcgaccaaagggacgctgccatccaggagctcagcaagggcagcgagctggcgacgcagctcatggcgcagctggagctcatcccggagcgggagctcgacggccgccgcgacgacgcgctggccaacgtgaggagcctctccatgtccctcagctcctcgctctacgccctccggtccgagaggagggagcactactactgcggctcctcctcctcatccggcggcgctgggccagctgctgtcacctccgtctccggcgccggcggcgaaagaaagacgaagcgccggcgaggcaagcatggcgaggagctcatgtgagtgccgaaaactacttatgtgtgttcgatttcttctcttctgcatgctaccactggcaatacatatatatgggactaattaatggactagataattaagatttaagaaccccatcaaccggcaaccggccggcagatctgtgtgtgtgtgtgtgttccatttgagcttgagtgactgattaatcagcttaatttccttgttgtctctaattattagcttgctttgagggggaaaagaaatggagctgttaatagtctatgccgaaagaagcctagatctattatacttagaggacactaaaaggtttttagcaagctggatattgttctgccccattcggattatttgggagcctcgtatgcttgcttttctcgagtagcactggctggatctatatttcatggttaggaaacttgttaacaagttaagtgcatgatttattttgtcttccttttttgtttcagcgagacggtattcattactacgaca

SEQ ID NO: 32161 - DNA, 1501 bp, Oryza sativa
tgattagccagagagtacaccacgcatggtacttgttctcctccctcgattagcaagggtcccttaattagctagtgtcggtgataaactgcttgtcaccttagagtagccagctatcactgcatgctgcacttaaaaaaaaaaaagaaaactgcattctgatcgatctcatgcatgcttaacttgtcggtgaaaatgacagtcaagcaaatgaattgaaagtcgtactctccagctcgtgacgtcttgatttgcacatcacattatatattctcatgctttcgatcaggaaggagtccagcacgcataacgggtgcacaaccgccgcgcattcatgcagcctgcatgcacacaacaatccaatatataccaacagatcgattgtctgacaatccaaactactgctgtcaaaaatgttttatggttaatttgcaattgagctcgatgaacaattcaatccagctttcgaaataatggatttggtcgcgtgagaatgggcaattcaattttggagatctagaactgaataaagccgcatctgtaatccgtccttctcaattcttgatcaggtcttgcgtgcgtgcgtgtgaaagccgttgacatcctactgtatatactagtattcagtaatccaataacttctgtacagcacacgagaatctcttcagggttagttaaagggatattgaaaaagcgctttttcagtcgtactcaactctgtcgtctctgcttgttttggactttgcttctggatccaaattcacttattgctttacgtagtaatgcatcgcgattatttaatccaagaataatttatgggtttctggtatgtaaaagaaaatagattaagactcggtcagattaatccagctcaaggacgaggttccagaagaacatacagcctatgcaactttccaggtaaaactaagatatattcagacttcaagtggcacatttgtgcatggcatatcttggagtttatacttgttgtctgatcgtacaagtagatgacgcattgacctatgaggctgttatcaattagtctgtacaattaactctggctaacaacctgacgacggggctaagtgtcgttatctttgaagctatacagtggcttctgaccgatggaacctcacgggacacacttgaaacttgatcagcagctagctactccctccatcgtatcctcgtaatataagagattttgaatgattttgaagggatctagattatttatagttgtggatattatgggtaccccatatccatacggcatggttatccgactagtcataggggataacttatatttatgtaatgtgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcaga

SEQ ID NO: 32162 - DNA, 1501 bp, Oryza sativa
actcctgccaacagatcaactccctgcattgatatggcattgaagaaaatacaagattagaaatgatagatgcttggaaatgctgaacaccacccacaaatgataacctcagcatgtctaccgtgatcagtatcaaccattgaattgcatcaatataaaaattcagcgagcaaaatgacaccataaggccaacagctttcaaactacttgaaaagagagtgttgttgcaacttgcaagggacatttcagatggtccaaacagtaaatttgaaaaatcgaagagcatcccataacaaactaaatcaagacaacatggtgtttcaagaattctaagtggcacaactatcagtaacctgttaggaaaaataataaaccagctacttgagcaggcaagtattacctttccttcccgataacaatctgaatcttctggatcatcatctggaaagcgcgcaacaaccgccacagcattcacatcagagcggttcaccagggcctcaactgccctcaggagagaatcagagttcccaacactccctgtagacttcccacattttggatcaaaccatgtcttgatctagaccacaaatgagcaggtcataagtaagcatgaatattacatcaggcactaaattatctttctaactagaggtatcactagatcttaaacgtattctcactcacaggacaaaaaaagaagggatcagaacagaatgagcacctccaaaggagtatcagtcacaatgtactcgactacagggagcccaagagaagccctcgcggcatccgcaacctgcaagtgacggagtcgaagctcctcctcgattccagaatccaacaccaaacctacctaggttgaagcagccacaatgtgtcaatgtatcaacaaaaccgtagctaactagctacctacagttacattatccatggttgtgtctgagcaatctctagaaccactaaattggtagtagtaccttgttctggtgaactggttggagagcccaggatccttcagcgaacctgtcaagggcgtatccctcaacgtagagcgtgttgggcatcggccagtagagcatcgcagcgttcagcacctgtgattatgtgaagacgaaatcttcaaccatggagaagccaaaactaaccctaacagctactggaagttaatacttacattggggtgggagatgacgcagtcggcgacggcaccgagcgcgcgcgccacgggaagcgcatcgccggcgaaacccccgacggcggcgccgactccggtggggaccaccaggacggacgtgtagggcctcctgaagctcgggccccgcgcgctggcagaaggggcgaggcaatgagcccgggagctccgacgagtcggccgcggcggcggcggcgacggccggaggaagggacgggtgaggtggagcgccattgccgcggcgaagcgagggcggggacgcgaacggataaggctgtgactcactgggccgccaaattgggcccaccactc

SEQ ID NO: 32163 - DNA, 153 bp, Oryza sativa
  unsure (1)..(153): unsure at all n locations
ggccccattgattgcttgacgatcgatcgnnaagggcgaanncgagctcggtacccaatgtgtttggtatcaccttaaatttgttggtgtgatgctttttgtaatgttctatttttttaactagggcctgaattaattgtgggttagtcatgg

SEQ ID NO: 32164 - DNA, 189 bp, Oryza sativa
  unsure (1)..(189): unsure at all n locations
tttgatgacgaactcgatgacccnagcgcgaattcgagctcggtacccttgaggcacgaggagtaagatggtggtgcagaataatcagcggaagccaggatagttttgtgaatgcttggttcagttcagaacaggttgttcttggtgattcatctggcagcttaattaacagggataattttggctaat

SEQ ID NO: 32165 - DNA, 435 bp, Oryza sativa
attcctgcagcccctcacagtacacgcacactcacctctacaaacacgcacatgcacattctatccctttgaacacctccgaaaaactgaagcagcatatcttgagatcatgggcatctcgacaggtacatcgcctaccactaaaagaataattagctgtaaatgtgagcacctttgtcaagtctactcgtggaggagttgtgcacatcattcaagctctgaaaatttgtatcacaaccgccgttgttctggtcaagaaagtaataacatatgttatgttactgtacactaaattccgttactgtcaattgtcatgggtgtctggagtagtaacagaaatgatgcgggatttacatcatccttgaagtatgaagtactcctacgttttaaaaagaaacctcacattctcatctgagttggcctttttgggacaga

SEQ ID NO: 32166 - DNA, 160 bp, Oryza sativa
ttttcgttaaattctctctcccggttgtattgccttgctatcgacctctcatgtactttatttaaatatttaggttcgtagctaattttttttttgacacccgtagctaaaaattgatggtgaaggggagtaaactttttcttcacctcgctctttcagt

SEQ ID NO: 32167 - DNA, 1501 bp, Oryza sativa
acatcgtcgtttggcattaaacctgcagccaaaatgaaaaaaactattaacacatgattaattgagttttaattattaaaagtttgaaaataaatttatttaatatttcaaagaaacttctactccctccatttcaatataaatatataagtactttttagatttcgacacagtcttcgagatattactttgactaacaatatctatgtcttatataaaaaagagttgtatattacgatagtatgtttaatggtaaatatatacaaaatcattttatacaaaatatactattttagtatttggacaaacatgcttcttataattctagtacatttctactcggccatattactctgtccattataggaaaaaacaatctaagatgagacattattttaacattatggtctcgttcttttctccaaccagagttgaatgaaaattaattttcatggcacgcttttcaaactgctaaaaggtgtatttcgtgtgaaaactttctatatgaaagtttctctaaaatattatattaatctattttttaagtttgtaataattaaaagtcaatcaattatacgttaatacgtaaaaaaaattaatctttatctttagaagaaaagaagaaccccaattattctggtttgtcccattatttccagttgattttttctgcacagaggtagtcctgtcggagtcgaacgcagccggcttccctttcacaccgccgcgccgatataaaagcgcgcgtcccgacggctggggactcccacttccacggcgccaaccgccaacccactccctcactcctccgcactaattcctcgcctctacaatctccttctcctcttccgctcgcgctcgcgctcgcggcggctactatgacgcagctcaggcgatccacctcgcggagcgcggagtggatataggataggatcgaggcggatcggaggaaggaggaggaatcctgggttggcttgattccccgccccagttcgagtgagcttccggagtttaatttggggtagtgttcttcttcgcaacaaggtatattctccccgcttgaatcatgggggcgcgtttgcctgtgtgtgagttttttttttttgtgaatttttcggtggttcggttggattattctcagccacattttaccacaggaatttgctggggttttggcgttccttcctcttttatataggagtagtagtcgacaggtcccatctcgagttttcatcctgatttgatgggattttcggcatttctcgcgatttttttgcacttgttgagttggtactagtacaaaagtaggagtactactactagctagtagctgccgctgcatgcatctgcggagtttagttgggacgtcgtggttgcgaattaggatggtgttactgtcaggtttcgttggcctgatgttgctgagtggcagatgtgttatttgtctctagtttgattgattttgatcgcacagagccattgcttgagcacaaaagcgact

SEQ ID NO: 32168 - DNA, 1501 bp, Oryza sativa
caagggaaaaatcttggtcgctcgtttaagcggggttttttcaaaacgagtcagtctagggttttagtaaaattattgggatttattcgtcagtcagttggggtttgatgggtgaaatgcattaggtcctagctttataacatgggttgcaaggtgtttatgcttcgtttgttattattaatatgtatctaatttctcattattttgtcgttatgtgagtctgtcttatttattcgctctcatgcaaaatgacctatgcataaaaatttcgctctggttcgtttcccttatttgagtctttattgctttatttaaatttggatttgagcatgcattgatcctactcctttgtcttctctagatggccggtcacccacccaaccaccgcggagaaggcatgatcgactttgtggcagagctggcacgtatgacactggtggtgggctaccccaacgcgccggagtacacgacgattccgccgctcagcggcgagcttcctcaccgtgtccgcttggaggtccatggctacgtggggacttgcctcgctaacatggcggtcgaggcatctggaggcacagcagatcacgcctgtcaggaggcggcctacttgatgatggccagactacgggagcgccacgactacatcttccacgacacggcgtaccgctaccacccccgtcgagcccatggtgatggcgtcagctccttccgtccgacagctggcgagaacgacaccacctttggtcacatgtgtgctgtgatgaggggattggacaggatgcactcggacctgcacaaggtgaccaaggctttgaacgatgggaagctcatgaggatcgtcgctctgaaggacgagatagcgcgcctgaagaaggagaacgctcagctaaagggtcttccagcgccaggaggagtccggatccgcaccacgccccgcaagacgacgactgcacctgtgcgcatccagcttgcgcccaggaacccacctccaccagcagctcccgcagcacctccagttccgcctgcagttcctgcagctccagttccagctcccgcgttcactctctccttcgctccagcatcagccgccagaggtccagccagtggtaccggaggttggttgtccgctactcccagtggcagcggcgagactgatctgtcaggctccaggagtcgctcagagggaccgggtgacgagcaggaggacgccttcgactccaccgaccgcaggagccgttccgagcattaggctcgttttcccattagtttatcgattgtctagcttctggttgttagtttgcgtgtttaggttgcttgtttggggtcagttgacggtcgatatcatgtgcctatgatatggctgtcttaataaggatttttgcttgctttttaagtgttttaattcagatcagaacaattgcagttttaattcctttgtaataaagcttagttcttgagcatctgtttttcttcttttcccccgtctgcttttccctccaga

SEQ ID NO: 32169 - DNA, 1501 bp, Oryza sativa
acttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtgatgtgcttggttagagggggttatgcgaatggtcctgtcacagcctctttccgggatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagggtaatcttttgaatttggatagtttaggtggacggttgggcctgtcgcaacgtgggttagcgttggacagtggatgtttaatactaattaattattacaaccgttttcgcattcaattcctgtttttaaatgccagtatttatgcaaatgaaccactctagctcttctttgttaattccctgcatcatactcctattccggtatgacttgctgagtacagtgggtagtactcagtcttgctctacttttcccaaccccagaggacgggtttgtgtcagatgaaggtttccccgaggagtaggcttcgtccgtgccgtcgaggatgcctgtggagtggtgttcccgctgcagtttagtcaaggcttagctccagttatcttttgtttccgctgcatttttgtaagacttttatgatgtttgtaagacgtggatctgaatgtcaacattgtcgtttgtgtaccccggctggtcctggatggggattataatgcacattctgcttggaattctatttgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagcggggttttttcaaaacgagtcagtctagggttttagtaaaattattgggatttattcgtcagtcagttggggtttgatgggtgaaatgcattaggtcctagctttataacatgggttgcaaggtgtttatgcttcgtttgttattattaatatgtatctaatttctcattattttgtcgttatgtgagtctgtcttatttattcgctctcatgcaaaatgacctatgcataaaaatttcgctctggttcgtttcccttatttgagtctttattgctttatttaaatttggatttgagcatgcattgatcctactcctttgtcttctctagatggccggtcacccacccaaccaccgcggagaaggcatgatcgactttgtggcagagctggcacgta

SEQ ID NO: 32170 - DNA, 1177 bp, Oryza sativa
tatctataattagggacaaataaagaaaattaaaaatgtgattccatgcaagaaatacgattaacaaaattcagaatttaggattaacaattacaaaaaaataatatttttgttaggagtccatgtagaaatacaatttaaaaacatccaaaagttcagattgaatataataaaactaacataaagagtccacatagaaaaattggattgaagataaatattatagcgaaaagagttttgggaggattgcagtttagaaatattttaaaatcggattaaaaataaataatattgaggggaagaatccaggtagctagaaataaaatttacaaatatcttaaattcggtttgaaaataaatattagtgagaaaacattttatgtagaagttgatttagaactattttaaatgtgaattaaaataaataatattgatagaagagtccacttttacaattgaaggctagtcttctattagctttatattaatactatcagctaaaaatcagctaaagaatctcatgtaaattagctagaaaactagcttatgagattggatcttaaccctataccaatgtgacaggagttagtccaaactgtcagcaacattaacaaaataaaatataaaaatacccagtaacatagtaatattgataacaatagaacgtttttaatttaaggttatgaactattatgaatatacaatacaatatgccatcttcagtaggtggaagaatgtcattcgaggtagtggaaagatgcaactatagatacagatgtaggggaataagacaaataaatatgccataggatttatgtatctttgatttattgtatttttatgagaatactaaaaattccatcgtgtttgttttatggacatgggaattactatattaatcatttgtcattttaaatactttttcacaatagtttggtcaagttaggtcaaagctcaaaatcatttgtcattttaaatatttttttcacaatagaatgtgaagtatatgtattatagaatgtgaatattttatagagatgctagtttatttcatagaatctgcgcggaccactttgctagtttatttcaaagtaaacgttgagacatgctagaatgccacttggtattggtacatagtatataccttctttgtcaaaactcttgcgagtatgtacca

SEQ ID NO: 32171 - DNA, 1501 bp, Oryza sativa
aaggaaaagcatccaacctctcaacagcaaaatctggggattatattgctgtctgctgatggctctttgcatccacttatgcaccacaggattcacaaagagcttcagacgactgcatcttgtgcagacaagaggcagaagaaaaaagatcagagacagtcaagtgcactataaacaaaggacaaacagctagcctggatctgtaactgcacagcacagaaagaactaagatctaagctgcccaatgaactgcagccttgcagcgcaaacaacagaacagtgcttgcgccggaatcatctcatggcaaccaggagcgccgcagccatgccacccagggacatggcccaaacgatcaaccgcagcagctactgtcctcctgagcgggtaaagtacagtttcatcatcagcttgcacttgcaggacctagttaagaaaccaagcagcaacaatcaatcggccaagtgaactaggacaatagtaggaaggcaactcaaatttattctgtaatgtttctgaagaattggagaccgggaatgaatccgagatacctgaacaccggcaaggacattttcagagactagctcagacggcgcaaccgctgcccagccgtcgacgtaaaccacctctatcagtaccagccatacaccaatatcctcaacatctggatggtgtagctccatgtgataagtgcagcagtctgaagagaatgacgacgtgcataggacgcagaaattatcatggagtagagcctgggtactgtaatctcctgttgcaagtgcctcgaccatgtccctcccttggtcctcttcttggacttggttaagctggaaatttcggatcaccattgttaatgaattcagtttggcatgagcagttaacaacgaagcacagaggtttccactattaatttgtgcacgagcaaatacccaaatactaatatacaagataaattaacagcattagtaagtagcaacaaatttacatagcatatgtagcaggatatattctattttcagttatctgaaacgaaaatggagcctcttttattgctagatgaccaaaatacaaacttctttttttatcctggttttgcacatgcttttgtccaagaaacctgtgcacgatcaaggcaacaagaacacatccacaaatcaagatggccaagaaaccctacaccagaggaaattgtaggcacgcgtggttccaagcacaactcgaagtatggacaagaacttaccttgcacattgtacagcagtagagcgcgtttgttggcttcttgattcgttggtggcagtccacgcagctcgagaaatccttcttccgcccgtacattggtggcacccatggtctcaacaggatccagttcgtctgttcgtcgcctctcaatctttgtataccttcccaatcgtactcggtgcccactgggtacctggcgagcacagcggggttttcagcgagcaactcaacctgcgagcgagaataagatgagacacaagagg

SEQ ID NO: 32172 - DNA, 1501 bp, Oryza sativa
cacaaacgacaatgttgacattcagatccacgtcttacaaacatcataaaagtcttacaaaaatgcagcggaaacaaaagataactggagctaagccttgactaaactgcagcgggaacaccactccacaggcatcctcgacggcacggacgaagcctactcctcggggaaaccttcatctgacacaaacccgtcctctggggttgggaaaagtagagcaagactgagtactacccactgtactcagcaagtcataccggaataggagtatgatgcagggaattaacaaagaagagctagagtggttcatttgcataaatactggcatttaaaaacaggaattgaatgcgaaaacggttgtaataattaattagtattaaacatccactgtccaacgctaacccacgttgcgacaggcccaaccgtccacctaaactatccaaattcaaaagattaccctagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataaccccctctaaccaagcacatcacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgtgaaccggtccttaactgccatgggtgcgaccagcaaaaccatgcacccacagcccaccatgtgattcattttatttaaccaacaccagagcggtggtactaatccaacattaccattagaaccaacagtctaaacattaatatgattttccccattgtgaactagttgaactaagcatggctaagcaattactagtccaaactctaatcatgttataaccccaagctaacaaaggagcatggtatcaaaatagcatggctgtaacaataggtaaccatcccatagtaatattgcaaaacaaatgcggtatttgaaagaaaacattaggacatttgcaatataggatcaatatgatcaagtgacaagcatgacttgccttgctctgctgctggaggaacctcggcgactatctcgaagtacaccggagcgtcggagaaatcggaatctaacgacatacaaagcaaacattgcaaacaggctataagactactgaaacagggaacaaaaccatttttaatggattctacacatttttcttgatttactaagacttgaatgggattaaacggagctcggatgaattagttatgaattttagaagattcactgtgtt

SEQ ID NO: 32173 - DNA, 621 bp, Oryza sativa
tgttgtgcaatatctctcccatttttggaaggatgaaaaaaacgagtacaaagcacgtgtccatttgagatacatctatcatacattgataagtatgctttgataagtatacatggatgatgctttgataagtatcatgaggtgaagaaatgcactacttgtaaaaaagaaaaaaaacaaaatcatttttggacgctgtgcatttattttcacaggcggcccaaaagaaacagagcttgtataaatggttgggaggctgtgaagggttaaagaccgtatttgaaaacctatttttacggttgggcaaatctgcctatgaaaatttgtctattctcgcagacgatttattaggaaaactaccctttgaaatggggtgatttttttacaggaatttttcatgaggaaaaacctgtaaaatttgacttttggcgaccagatctttcaaagaggtctacctaaaaaaatgagagcaccacagatcatgacaaactccatatgaaaattgtattgaagctccgtaaagctcagcaagatctatgattgtaaaagtttcaactcatcgattccaacaaagaagtagacatgaaattgcttcacaagatcagcacatcctctgataga

SEQ ID NO: 32174 - DNA, 245 bp, Oryza sativa
cccagtgaaacatcccttggtctgaactctgcagactgcactcttgcagtggctgtggctctgaacttttcgacagataagcagttagtacgagtacattgtttaaatggagtgcctgtcgacttagactttattaaaccacatcttgagttcgagagatcaatcatcaatgtgtgcactgggcactgctcctgctaatcgctgctacattagttgctcaattactatacatcgtcctcgttagg

SEQ ID NO: 32175 - DNA, 1501 bp, Oryza sativa
taattaagtatatgcatcaaccgttcaacatttaacgacattccagaggaccaattgccccatcagtaacctatttttaaaatttcttcacattctagtgcaatccatcctcccactcaatgatggcacaaggcatcggcagtttgagccctagacctgacttcataatccccttttgaatcatgtgagaataccatacaatttgtgaaaaaaaaatgacgaatgcgacgggaaaaggtgaggagctccagtttatatgagtagggtggagaaacatcaagccatgagctcttgccagcaatcccaatggtgatggcgactgtggtaaggtcctctcggtcatcctggtatgccttccaattgttacatactcctctcttcttcgaaactatagttagatccaatttgttcggtcgttggcgcaattgtggaacacgtggcaaagcgacgaagctacacaacaagatgctcaggccatgtctctactcactacgtgtatgtgtcgaggctatcatgccttctataagacacgagaaacctttgcaagccattcgcttttttccctctctcctccacgtcaactcttcgccaacgtggctgagcgaggtcacacgttagcaggaagagttgtttattcccttatgtcattaacaatgtggtgcaaaaatagtacataggtaatactccatccgccccaaaatgtaaggatttttttagggttggacaagagttataagaaagtacgtagaattaaatgagagaatattatgcttggtagagaaggggaggtaggtaagaagattgaacagtggagggttgtaattgattgagaaaataatgttggtgaataaattgttatattttgggataaaccgtaagggctaaaatttgttatattttgggaccgatagagcgagtaatattttattcagccatctaataatattatgtaagagaaataataaaagatacccatataaagtaaacaatattatctatatctacttttcttttcttttttgcctaatactactttgtatatatatatatatatatattgcgaggattgttataataaaagttgatttatttaaatctaataccccgattggtgatgcgctagtatcacagtatcactcagctggaccccctgtcagtcatagcgacagagcactccgattggatatggggcctataaaacagagaaaaaaagcgccccatccaatgaacatgcatgccactcaatgcatgcagtgcagtagaggaggagtactgacactgctcagcgtccctctccctgcacatttactcgtatgcacagcacaacacacactcctctcctctcctatctccaggctcacagatgagctgtgagctgtgtgtgtgacacagtctactgctctctctgtacaaagggagagggtgagaggaaattaacagaggaaggagggagaagaaatgcgagaaatgctggcgtctctctcttcttcgtcccgtgcgg

SEQ ID NO: 32176 - DNA, 1501 bp, Oryza sativa
aaacaacatgaagatatacttcatatcactatgtgtatagaagacaaaaaaaaaaagaaatatacagcatccaatttatagttacaaatctggcaattgcatattgcattgaggaaatgtgttctcttaacaagattttacctcagtaggagcattctgatctaaggaaccaatctcattcatggtttccatctcgctgaaatccttcaggagattttcctgcttcttgtagtattttgcaattttccgatgctttcctgttatggggcaccgactttttcagtactcagaagtactaataaacgaaataatcaaagaaagaagagagtgttaaaccaaatagttaattaagcttaatggaacttatcatttttcagtccatagcatgttccacatgcatttaacagcttgatcaatcaagttaaagtactgttcgattgaaacatggtattccactaggataaatgcatatgctaattcacagtttcacacaaggaaaaatatatatagtccagattggaaagagtcctagcagcatgggaagtgtcttccttcagttccttgctactaatggacctaatgcagtggacgtaattagcaaacatagttgagtaagaacattattcataggtgaagataaaagactgaacaagactgtatgagccttccttccttttttgggctggtcctcaaataaaaatctgtctggcccattatattttcgggctgggcctcaaaatctatcactcttttggaccccccattgggccatctctaatgctatgtgccaatataaggttgataagtatgtctatatgtaattgcaatacagtaaattgcagtctgtgccatcttttaatcgatctattttagatcaccctttaatcaatcttttttactttggactagataattttagcgttgttttacgttggaccactcctagtttaataaaagatgtcctaaaacacaatttactgaaatttccttcaggtgtctaaatcgtcagcaccttgattcttcatatgagcatcgatgcttgagaattagcagcacctcacgtattagttgccaagactcaagagacaaaatggttattcttcgttgatattcttaatatgcagaagtatggacagtactgaaatgacggccccttcgcatcaaaataatgcttgtgctgttaacgtcagtctacaaccaaagactagacactagtggaacgacagaattgagtccagctgagtctaccgagcaactagtatactgcaatactatgagtaaagacaatcgtgttgtttagtgcgggtcaagccatcacaagacaccgagattctaatataatcgatcacgaattgaacaaaaaagggaagaggtaaaaaagctgcacgagtaaagtaaagctggaaaagaagaagcatgatcagagcagtagctgctttttccatcttttgtttcctttctccctgaagattactaaactggtagtattactgtagtacga

SEQ ID NO: 32177 - DNA, 1501 bp, Oryza sativa
gaacaccaattgctgtactttcttctcaaaaatggagctagcttttttttcattgccttttactgttccacttcatccgtttcacaatgtaaattattctaacatttctcatattcatagtgatgttaatgaatttagatagatatatatgtctaaattcattaacattagtatgaatatagaaaatgctagaatgacttacattgcgaaactgaggaagtacaaaacaaggcaggggtatgcagtttggatctaatgttcggtgttcagttctctttggttgttcagcattttgttttccaaaccggtgttaattgtaaaatgtcatgaacaatgtttggcatttgttctagcatttaggtgagtcgtttatagccgtattattcgctcaaacgtcccctgttttgctgctgctgctgctgctgctatttttctgcactagaaattagaaaacgtccaaaaggatatcaaacaaaacaaccgccaaacattaggcgtggactgtctagtatagccgtaaagagaacaaattaatagcatatggcaattcaatcatggggtgccattgttaccaataatgctgtcagatgaatgcttcccaccacaagtccatgctactgctgatgcacaagggtgtgcatccatctcacccagcaatttaattttattttgttacaattaccggattctttcgggctggccgtcctcgttcctcctcatggctgctcgctttctacttgcttgagcatcttcgagtgggcttcgactatctagtcctcatcttttggcagcattgaaaggagcgaaattctagaattcttgatttttctctctcctaggtctctgtggtttgaaagtccatccttcaggaaggctgtttgtggtcttgtactaataccgttgtctttagaggcttattggaagagtagtatggctccgcctccaccttctgagttgtgaacacgccgttgtctttagaggcttgttggaagagcagtatggctccgcctccaccttctgagttgtgaacagccttccagtagtagttttttcctttactttggtggttcttttttttttctttgtttcttgtccccaggcaatgaccgtatgaccaattgcattgtttaaaaatatattatgtcttcttgtaatatattgacatgcaatcattttgcgcattcgtgaaaaaaaaattactggattctttccaatcccagctgatcgatgagaagcaacaacacaaggtgtggggctgtttggatcctagtgatgatcacagctacaatggccatgtcctttcttttccttccagctgaagaagctattgataatttgtcctgtcacttagggctcccacatagtaacacccagctgcaactcgcccaataaaacgaaccagcaagaacaacaagtcacaggcactgtcctcatgcatggtttgccctttgtatttttgtgagtttttctgccctagttggatagggcccaagctaacttg

SEQ ID NO: 32178 - DNA, 468 bp, Oryza sativa
gcgggatggatcgactacttatataggcgaattcgagctcggtacccagtaaaccaattattatcagaaactgctagcaccgttcgaatgagaacattgttgcattcacgaagcctgccttaatataatgcccaggattttattagcctgcagctacagcggattattccatctatctgactaaagatttgccttacttgccgatactaggaacagctgttatagctactttgatagtagagacttgctgttatagctactttgatactagagacacatgcatactgttatggctaatttatggtcaatagtgtcaatactctagttgtggtacgggaagtacttggcatgcttcctttcatcatagatgtaagattaagcttcttaacatgcttgtctgttgtttcttcattataacttatagtaggagtaagcctcacctagctgctctgtcatgaaattttcagg

SEQ ID NO: 32179 - DNA, 1501 bp, Oryza sativa
agaagcctctcagtttagcgttaaccagcgacgaaccaatttgtaagaaggactgctacacgtgctgacatgcatgcttgtttttcctcttagacatgcatgtgtttttcttccttcttataaaattttctctcaaattacttatccgatctaaaattcgattacaccagtgtgttcgttacaattaaatcttcacaaaaagatcttacatgattatattacgatgaaaaaatatttatatttttgaattacttttattataacataagttacttttatcatatatatataagttacttttagattcgactaagttacttcttagacatataaaagtaaattcaataaagtctaaaagtaatttatatatattataaaagtatcttaaaacaaaacggaaacatactatattgcatttttcaagttgaaaggaaacactagatggagtacaaaccagctaccactagttgtgtagtcacgtccaatgaaaaaaggcatgcattaaagttactttccttttgttataagttacttctataatatatgtaaattacttttaaaccttattgaatttacttttatatatcgaagaagtaatttagtgaaatctaaaagtaatttagatatattataaaagtaatttataatttttcatcaaaatataatcacgtgagatattgttataaagatataattgttacgatacaacggtgtaatcggatcgtaaattggatgagtagtttaagagaaaattttatttgaagtatagatggataggaactcttatagatagagtggtagctgatttagacaaactagttaccactagccgtgtaatttttcagggttgtacacaactactatgcctctcgtgacgtgacggtggtggtagccacgcactatcccacctttgtatttggtccacaaatgttgttcacgggtttgtcaaaagtttctgatgggcttatttccttatgggccacatgctgcggtatgacatgaccattccttatcaagggcttcaaataactatggcccgaataattttcctgatgaaccaagcctgcagcaaccatcggtttgtttcgtaccaaaccacagagaaaaattccgaacataaaaccgtgaagtaggtcacaaaacagctttccaaaaaatactaaaacgttcaaatcagagttcatatgcaaaattcactcttatcatttttgtgatggacagtctaagctgtccaagcataatccgaattaaattcaaactttgttaccttcgacttcctcctttggaaagagtaaagagacgggagatgtaatatatttctactagggactgcctatacattatgtgacagattttctagtattatctactctctctcaagttagtaccactctctcaagtattcgtgagggcattcgtaccgcaaatccgcaatctagccgatgttctttcgactgtctcccttgtgcgcacatgtaagagtcagaaagaaggatatatg

SEQ ID NO: 32180 - DNA, 327 bp, Oryza sativa
atagcctataaattttcacatttatgcgtggcatatagcagctcatgctccatattgaaagacgatggagctaatgcctatattcatgctgaaaaaatcatgtgtattttatgaggagactagtgtccatttagagctacactttagaagtggttgaaattcggtgtgaccaaataatgtatatgaaaagaggagactctagtatgtattacacatgagtagttacgtaaagtgattggctagtttaaaattatggtgcgcgtgtcatatctttcaatgatattatgcgagaacatctatgctattatatcatagaaaatgtgatga

SEQ ID NO: 32181 - DNA, 1501 bp, Oryza sativa
cgtgagcttctactccctttgtttctggaaaaaaaatagttttagactaatcatttgttttttaaaaaattatagtttaaaggtgtttaaaatagactaagaatccctttgttcgtgtttttaagctatggaaccgatagtactccctctctctctctctccttgttttagttggcttttaatctctttatttaacatgtatttcaactagtaaaaatatatctttttttaaagaatagatggagtttttttaattttttggcttgaccgtgggtggtggtcaatgacagaggatcctggtgctatgcacgcagagcggtaaagacaaaagaagtctctgtggcacaaactgcgatgatatatgcacatggctcggcgttattgcgccgaaatgaaataggagtactagagcggtgtggacggtgcagacgtacgtgcagctagcaggcgtcgacaccaaacccctcgccgtcgacggacggcgcgacacaaatgcacatgccgcatttgacgatgagagttatctgattctatctttattgtttctgaaaacagaaacatatacgcactccaaacacgtgaaaaaaaattgcgtggttcgttcggttcaaactctaaaccaatcttttcttgtggatagcggaactgcggaaagcttctgccgacatgcacactgccaaactccaaaaccaaactgatgcttgctcacggatttgcgtgtgagaaactagtttacgagggatttgacgtcgtgtgtgaagcatattgggaatgggatatcttatgggccctagcccttttggcccaatactttacagcgtgtgatcgcgcaaattaggcccaatattcaatcagagatgggccatgcgatgcgacagatgaaggaatatgtccattttaagtcccttaacttgacagcgagttcgattgtcttccctaaaccgatacaacgggtcccttaactgtcaaaatcagtgcaaacaagttctctcgatggtttagatggtgtttttggctgacgtggcgttcaagtgacggtgatatgacactagaagcaaaatataaaaattaaaaattaaaataaaaggtggggttcacatgtcagtaagacaaaagataaaaaaaaagagtagcatccacatgccagtgggtcccaccctcctctctgtctccatgcacgagcgcacgcaaagagggagaaggtcgaggggcggtggccatagggtgtcgtgatgtacctcatcgcgatgcggggtagttgttgtcgccgctgacagtgatccaaaacctgagccccctttccacacatgcgttgcacggccggccagtggagatgacgactggggagattgaggtctctatcgccgccctcgccacaaagaaggcactacaagaggccttcgacgtcctcactgctgcctgctcgcccttcacctggggcgacctcaactcctacatatcctcgctccagtcatcgattgactaacagcttggccggctt

SEQ ID NO: 32182 - DNA, 1501 bp, Oryza sativa
gacataatatatttttaaacaatgcaattggtcatacggtcattgcctggggacaagaaacaaagaaaaaaaaaagaaccaccaaagtaaaggaaaaaactactactggaaggctgttcacaactcagaaggtggaggcggagccatactgctcttccaacaagcctctaaagacaacggcgtgttcacaactcagaaggtggaggcggagccatactactcttccaataagcctctaaagacaacggtattagtacaagaccacaaacagccttcctgaaggatggactttcaaaccacagagacctaggagagagaaaaatcaagaattctagaatttcgctcctttcaatgctgccaaaagatgaggactagatagtcgaagcccactcgaagatgctcaagcaagtagaaagcgagcagccatgaggaggaacgaggacggccagcccgaaagaatccggtaattgtaacaaaataaaattaaattgctgggtgagatggatgcacacccttgtgcatcagcagtagcatggacttgtggtgggaagcattcatctgacagcattattggtaacaatggcaccccatgattgaattgccatatgctattaatttgttctctttacggctatactagacagtccacgcctaatgtttggcggttgttttgtttgatatccttttggacgttttctaatttctagtgcagaaaaatagcagcagcagcagcagcagcaaaacaggggacgtttgagcgaataatacggctataaacgactcacctaaatgctagaacaaatgccaaacattgttcatgacattttacaattaacaccggtttggaaaacaaaatgctgaacaaccaaagagaactgaacaccgaacattagatccaaactgcatacccctgccttgttttgtacttcctcagtttcgcaatgtaagtcattctagcattttctatattcatactaatgttaatgaatttagacatatatatctatctaaattcattaacatcactatgaatatgagaaatgttagaataatttacattgtgaaacggatgaagtggaacagtaaaaggcaatgaaaaaaaagctagctccatttttgagaagaaagtacagcaattggtgttcgtccaggcaagttcatcacgtgcaaaggagaaaggtagcaacaaggcaacctatacgatggatggattgagatggaggccggccgtggcgcatgtgagctatccgtcgtcgtcgtcgtcgtcgtcgtcgctgggtccgggcaaatggaccccgggcgaggcggggagccgtacaccagcgtcagccccaatcgcggcacggtgtaacgcgccgcggcacagtcgtcgtcaccctgcagcatctcttgcacttgctgttgtactacactagtagtactacctctcctcctctcgatcagtaactcattattataattactattattctactctgatgaaggtcctacgtcgtactgc

SEQ ID NO: 32183 - DNA, 1501 bp, Oryza sativa
ttcttttttgcgggaaatatttagtatttttctagctacaaacatacaactagggaagtggttaatggccaaattaatacaggtgtatatatatgagtccatgttaatgcccaaaatcaataaggaatttatccaataacaaataatcagaaaaatgcaatggtcaaataagtgtgatccaagagactaacaagatcctaaggaaattatctctcttgagtcttgaggaaaggaaaacaagatagatcaagcacaacacaattaagtccaataattaaaggatggtatgaacttggagatctgataccgtacttgtctcgaccataaacaatgtcaactagagctatggtaaaggttgagcgggaggaagaatcattcatcttcgcggagttatctaagagaaacatgtcactatacactaattgaggtatgttcactcttaatttcagggagcaaaccagggggtgaattaagccaagataatgagccaagcatatagggcttatagggcatcttaattactgtgtatttccaaaatttttagataggatcgtaaaagatattaaagagacaaacctagaaatcaagccctaattattgctcaaggctagtgagagtcgtagctactatattactactgttggaattttcaagaacacacttagttgatttgttcttataaaactgaataattataacataggggatattatattagaagaagaaaaagcaaacgcgcatgttatccctcgcggagaaaccgtcaaaaccaactaaatgttgagaagtaaggtgatgatttgacaagaccacagctaatcaagtaaattaagcttcgttctagagtcgttacacttatctatttagttttctgtttgctacactgaggtggttttcatgtcatatatacattccgagctaggtcagcatattgcaacagctatagcagtactactactatagcttgaatggagtaaacatatgacttcttttttttcctcctaataccgggtttctaattagtcagaaccttctgtcagatccctttctttttgaggcaagtacacaatatatattcaactcccatatatatatattaattataaccaagttaattcaacctaggaccacttggtcagccagatcgatcaccatcacatacctagtatgtatatataattatctaagtaattaaagtttagttataagttttagaagaagcttagagagatcatgagatggaaaagtgaggggcattagggtaacatcacatgtaggggagaaaaccagctttccactcccagggaaaccggaggctttccagtccgctgccgagctaacccacggctccacctcccaatgctttatatacacccaacctctccgcccacacacccaccaccatttcctcctccttcttctacctctagctcggcattgctagctcgatctcaccggtcgtcgtctccggcgagccgcgcgggttagtttgcgaggatca

SEQ ID NO: 32184 - DNA, 1501 bp, Oryza sativa
tgtcttatttcactgtcatttaaattggctgagtttttattaatcgtaaaaattatctttcccctattgcaacacacatgtatttttgctagtctctaccttaataaaaattgaagatgtttttgccgatattttggtatgtcatacgtgtttgagttagtttttaagtttgtttgcttttggaaatacaaatctgtatttgagttggattattttaagcttgtttgtttttggaaatataaaaggagtcgtataagaaatctctttaaagaaaactcatgctaacttgagatgaaatatggacttctaattgtagctcatgattttctaaaaaaatatttaagcgaatttccacggtgaattttatcctctaaaccatataacaataataatattaaaatagcatttacccgttataatgcacggatattttttctagttaaacataaattcaaaagaccgaattggcctagtgatgcgctgcaaccatcgttccacaagtgaaagaagaaaccacttgatgcttcctaagattatccgccgccaccgtcgtcgtcggggagcccttccatctgacctctcttcatctcccatctgccaatgtcttgccggcaatattctttctcatctagacggcagtcgtcgacgaggtaggcgcatctgggcttcaacgctgccaggaattgctcggcccggaagcacgccgagaattcgtggccgaggaagaccaactcgccgccgacgcctccacgagcttcttctcgtcgccgagcaccgtcgaccctgaagatcggcagatgtttggtgcagaaaggcgggtccccgttatcgccgtcgccggcgaacctccagacgatgttgttgtgttgccctttggaaatccacttaaaaaaataaacaggagagatacaaacaattttacatactcttttattatcctagtagcaaaatgtttatgtgttgcaacaggagaaaaagagtgaacatgttatagtaaaaatcatgaaacatcgtgtcttatatttacttttgtcaacataacgggcctgttcactttactgccaaaaaaaaccttatcaaagtttggcaactatgccaaaattttggcaactagtggtagcttgccaaattttggcaggaattcttatatagttactaaaatttggcaacaaactaaatgtagcaacttttttgtcaactttatcaaaatttggtaaggttgaaaatggcaccaaagtgaacaggcccaacatgtccagcaaatcgtacttgatttattttactttcatcggttaatcctccttgagtagctattctcatgagcaccagaaacagaacgtaatcagaattgagaaacgcccaggagtcttccggctagctcacaaggtggtgggctagacaacctgggttcgaatcctcaccccttctaattatttgatattaggtcattcccttatatttgcttctttttttaaacataacgtaattaaatataaaattg

SEQ ID NO: 32185 - DNA, 1501 bp, Oryza sativa
ccgcgatgggagcttgctaccagccgccgccgctgttccactcgtcctcccactgccgcgagccgccgccgccctagccgccgaccgccgcccccggttcggctacgctccggtgctgccagccgccgccactccccttgtccccccgtcgccgctgctaacgaagaaagagaaaatactaccaccgtcgctactgccaacgaagaaagagagaatataggaggggagtcactgacaggtgggccccacattaattttttaatttatttgatgactaggatgcctcgtaggtgccacatcagcgaagccaccctccaaaaccgccgagggagtcaaattgcaccggttttaagagttgggggggtcgagatatccggttttgtggtttagggtcagattatatttcgatgacttttgagggtcacaaagtgaacttattcctattgctctctgttaataaagaggcccatgatgtgttgatggcgcgtattccggcccagtttgggtagcgtacacttcggcctgctcaagattttctctcttttcggcgtcccgtggcccagaggcgagttgccctaaccaccccaccccacctctctatataagaaggcgctggactctcctgcttcccccaaccgccgccgccaccgccaccgcggccgcaaatcttctcgcgaatgggtcgccgttctccaaccacgggaacgtcagtcatcctttttcgtttctttgccttcctttttcgtttcttggttgctttctctgttcgtttctattgactttgcggcgaatttgctgggaaggaggtgcggccttgtgatgttcattcgagatcacatggctgagatcaccatggctctctcggagagctcttccctagaggaaaccaccgcaggatttaatgctggacggcccgtcccaatggccacccagtttggcttttctgtgacaatcctatctatcattccattttttttaaaacttcagatctatcttgctgtttctcttgccaagtttgatctgtttagcatttgttgtgatcctgatacgaacgttgcttcgacagagggttttgatttgggcaggttctggaagtagtttctcaaagcgaacgacccagaatatttctaatctcaagtttttgcccaattgcttgcgcttcagaagatttttttggacaatattctgtacaatctgtatacggacattgctggacgatgccatttagaaccagaaccaggaaacgcagaggtcggagaagagaacccaccgctcccatcgcggggacgggccaaattcgattggtcacaatgcagctaaccaaaaggcccagttaatatttgggccgaggaagggacggcccagattcgcagtgatccgattggtcacaatgcagctaaccaaaaggcccagttaacatttgggccgaggaagggacggcccatattcgcagtgatccaactagagcggaataagttcgtccctgttttggctgatggtc

SEQ ID NO: 32186 - DNA, 1501 bp, Oryza sativa
cattggtgctccatctattgagagcgcataactacgacgatatacgtttgtgatgatctgtatgtacttcttctacttcatccgttttacgatgtaagtcattttagtatttcccacattcatattgatgtcaacgattttagatagatatatatgtctagattcattaatatcaatatgatgtggaaaattttagaataacttacattgtgaaacggagggagtacctatctaatcggagaaaaaaatagtcaataactcttgcaagttgcaacaataagaggatgacttcaaagaaagaccctagattgaaataaccaaactgttaataattacttcctccgtttcacaatgtaagtcattgtagcatttatcatattcatagtgatgttaatgaatctagattgatatatatgtctagattcattaagattgattatttatgataatacaaaaatgacaagattgattatttaggatgatataagacaccacataaacatacaagtccaagggcttgtacttcactttgcttttttactttgaactctattaatttttggtattaccaattttaagtatggtaacaaactaaatatactcttgtccttatctctctactaaaagttactggcattttcggaagcttcttctcatacaaacacgtactactaaatttaggtaaggttataaaaaaaagcatccaaacgttaacaagattttagtaattgtcgaaatttagcaatgtaatattggtatggttaattgtcaagacttatggccaaggttgtcagtatcccgattcgtatcctagtatcttacgatattacgatcctaccaagccgaaacgataccgatctcacatagtatcttaatttttatagtatctcgatcctcctattcattactacacgatcctacaaaatcttaggtggtatcccgattctacgatccctacgatactacaaaatattattttaaataacacggtttgaaaataatgtaactaaatatgcttaaatttatataaaaaatcagttaaatatatcaaaacctacgtggtttctcttgataaatgtctctatttgcatgatatatatcattactatatttttttatacagaatggctatatataattaatataaatattaattaaacttaaaaaaagaaaatcttatagtatcccgatactacgatacgatcctacgatacgatattactttgagcaaaacgatactatctagtatcccgatcctgtcaaccttgcttatgacgtggcatgtatgcaacggtgatatattaaattagttagcacgctaccggtttttaatgcgcctgactttaccttgaatacaacgacgatgcatggcatggctagaatgctcagatctggagatagctttggataaatggaagagtttgttttttttaaagagaataaagacaaaatgtaaatcatttcgaattcccagcatgatttttttttcttttttacgagg

SEQ ID NO: 32187 - DNA, 506 bp, Oryza sativa
tgccccccacaacatgcagacgtatatattagccaagcatgtgtatatggctgagcacactcacatgtgtgtgtgtctatatatatatatatatatatatatatatatatatatgcgccattacgtgcatgactcatgcatgagtcatatttaattcattagcttgcttagcacattagcgttgttagctagctaatttacctgcttcctgcaaccagccactaacacacaatatgcgagcgcggcggaggagcggcggcgggcgagcgcagcagtgggcaaagcagcggagggcgagcgcggcggcggaggggcggcgggcgagcgcggccgcgggcaaagcagcggagggtgagctaggcgaagcggaagacagtggatgggatggggagctcccccgtgctcggccgccaccaccgccgtgccccgtgccctagcgggtgccccacggcgccggcgacgaaggcctcgaggccgtcgatcgcgccgtgagcttggcgggcagg

SEQ ID NO: 32188 - DNA, 1501 bp, Oryza sativa
aaagaatcatgtttattttggtgtgtccaaaagcctgtttactaattcctcctttatgcatgtacccctatatctaggatttaaatttgtcttataatatagctacttcttcacctattttcctatctcaactaatcataaccatttctcatttaattcttttacctactttctcatcttaagcaatcacttcgactttaatctctccaaaaaatgacataaatagctatatgttgagaccgagatagtatggtgtgaaagacttggtctcttaattagccattcaattttgtagttaagatggaattttttgtccatggtggagcgtgtcatgcatctgtaaatcctaatatatgaggtagagtgtaatttgtgacaattactcagacaactctgcattttgagacaaatgtaaattatgtgaagctttagagttgaaatgtaattctcactttcaggggtatttgaggattggtgtctaaatcacatcatagtatattgcaactatcttgaaagggtgctaccaaatacatagtttggccaacagctttgctagtcacgacacaaatggtcccatccgaagaaactcaaattaaatccccaaggagggagaagcgtcagacttgaagctaggaaatgaagcaaaatggaagaagtccctccaaagtccggcctcctcatttgctcggagagctcgctcattctactcggataatctgatgccttcaacttctaggttcagtgatcagatccctctctatctcgttccatttctattatctgcttcttgttcagcatcgattttattagaagtacaccttggatatctgtaacacttagcttgatttgtcttcagacaagacatccatggaaggcgccatggtcaacctcccagggaggcttgatgaactcctgcgtcgtcacggcaacatcctgcccaagggagcagaccaggagataccgctcatcaggcaagatattgaggaaataacctccatcctccatggtcaccacagcgatgccacggaactggaggactaccatgacatggtggtcaggtgctggacgaaggaggtgcgtgagctgtcctacgacatcgaggactgcatcgaccagtacgaggatgcagtcgagcagtacgagcacgctgccaccgtcggccggtatccaagcgtatctacgattcgccgccgtaagttcagccggcgacctgtggggagcaagactcctctggttccagagaagctaaagcagcgcctgtggatggcaaacaagatcagagaattcagccttcgcgtgcaggaggcgcttcaacgccacgccatcttgtacagcagcgacctcggtggcatagccaatactagtgctgggcatcccacgctttgcagaaagcgtgccgatggcgtccggcatgtcggtctcgatgccgccattaacaaggtccaggagtggctggctgatggagagaagaagctaaaggtggtatccatcgtgggagttg

SEQ ID NO: 32189 - DNA, 1501 bp, Oryza sativa
gtcgtactccatatggtagaactctgaaagggggcttatatcctggtacagttgcaggaagcaagtctgcatctactggtgatggatcaggtcttggccagtcgtcgtatcttggtccaagctcatccaatagcttgtcaatttcatcttcatatttgatttctggaactggttcaactagtgtatctttctcagcattagataccaatgctccattgttgtcttgcatctcgtttactttctcattaggcagcaacgaatgaccaggtggctctttgatggaggacttcataccaagagtttgtgtattcttacttgttcctttagtgggctcaggtatgtcataggctactcccctgtacagagaaacagaagttccagacctccatattaccaaaccccctgtttttctctaaccgccatcaatcaaaagaaacagagatcagattaactagagttaccaggcacataacacatatatccaaaaatatctgacaggttggttgcagaatgaagaaatgaaataccatattaagaaatttatacattcagtgtacatgttaacagatccacagtaaccttcggttgtataatttccacttagccggtaagtcaatttctctgttatttatcatgggagctacattacagcagcaaaaatggaatatttatgcagcatacaacatcttgctttcgacattagtcctcaattcagtttagttccaaaatttgattttataagcatgaaatttgctgaaatatttgcttggcatttaaacgtttttcgtcagaacctttttacaacaaagctaaataatagcacttggatgtcaggtgctcagttgaacaaattcaacagctgggaagaactggagtgagcaaacaacagtatcaataattatcatagagaccaatagttataaccactgtaaacacacccgaccttcactctccagttcatcacaacaaccgaatctctttacaggctaaatggtattgctcagggataacttcataagcaatttatgaaacaaagcggtgaagtaaaccgtgctcaacctcacattttgtgcttaagcttcccaagtaccaaatcacaaagaattctaccagtaatcaaatcctaaaactcctgtagttcacatagggcatcaatactagttacaactccactaagaaaaactgaaaaggtcaccaattctaaatttatgatgcagcgtgagcgtctagcaattagtttaacttctgagaaatgttccagcaattcagcattttcccgcttgcaataatctatagtgctgcattaaacaacttcaaggaacacaataattgcgaaatcggcaatgcacctcgagtatctcgtggaagaggcgcatgttgagcgcgggcgtgccggtgaccttgatcctgaccacctcgtcgttcctccacctgtccctgatcctctccacgatctccctggtgaccccggcgccgcccaccttgatcctcgacttgagcc

SEQ ID NO: 32190 - DNA, 1431 bp, Oryza sativa
ctgcaccccaatatatataatttacaaataactaaaatttgatattgaaaatgattaataactaacacacatataaaatataatatgaaaatttagaaataaaaataaataatattggaagaagagcatagagtctatatagaaatacaatttatagaaaattcggaattaaaaaaagaaatattaaaagacgagtctagagtccatataggaatatatataatttacaaataactaaaatttgatattaaaaataattaataactaacacgtatataaaatataatatgaatattactagttttataaagttattgcaaaatttaaaattatgttgttattttagtatatttgaataatataatgagaaaacatatatgctattaaatgagagaaaatataatgatgatagccgcacaatctgcgcgggccactatgctagtttttttaaagcaaactgcacacctagtattgtaccaagatagaaaattcagtgaactggaacaagcaattgaccaattaaaatcacagtttttctttaagcggcaatgctgtgctccaatcccatctttccaacgatgcccttttcagttcacgatctgtactagtaaaatatttcctcggattgtacgctgtgtcttcgctggctcaagactctttcttcctcccccgtatttcctcctgtttcttccatggctcgattcagttattatctcgtgtctgagaagccgagctgaagaatcagaggggctctgaagattctgacagctaggtgagattcagttttttttcagggatctagtgggtttccctgttcttttctttaatttgatattttggtatattttaatttgattatagtgccatgttctcccccaatcttcttgttgctctgcaattagtctgtgcaagaaaccaatctgaactctcaatccacgagatgtttattgtcgaaaaaaaacctaacttgagttgcaacagtttactcccgtgcacgggtgtactggatgcccactgtcgccgtagccccgtactaaagttcatgtcgagacagcgtcaatctccaatttctcatcaccatttcccatcttcgctagaggtcaatgagtcctttttcccggcatgtccttgcgtagcaatgttcatcgcagcttttgttttgggggattggtaaatgattatgaagcagtcaattccactgcaattggtcaatgtcttaatgaggagtcgtaattagcagttatattcagttagcgagctgaagttgattgacttgaccttggcataaagaatgcattgatttgggggggtttcaggtttgaatcaagatgcatctcaccggccgaattgattgctgttgatcaaacgccttcttctctgacgaaatttctgatcgatgctttggtagtcggagaagttctgcggcggcga

SEQ ID NO: 32191 - DNA, 1501 bp, Oryza sativa
gagtaattgtcacaaattacactctacctcatatattaggatttacagatgcatgacacgctccaccatggacaaaaaattccatcttaactacaaaattgaatggctaattaagagaccaagtctttcacaccatactatctcggtctcaacatatagctatttatgtcattttttggagagattaaagtcgaagtgattgcttaagatgagaaagtaggtaaaagaattaaatgagaaatggttatgattagttgagataggaaaataggtgaagaagtagctatattataagacaaatttaaatcctagatataggggtacatgcataaaggaggaattagtaaacaggcttttggacacaccaaaataaacatgattcttttccgctaagagcacatttatattgtactgaaatgcgaaataagtagtgaattacgaataaaaaacaagtagctatattcagtgtgcatatgtgtattccgtgtaatttattaaaaaaatcttctagtattttttggtatgaggataatttaccatccttaagaatataccaggagcaaatttacatgtaaaatttggtattttcaaatactacgtatcttaagatactaaaaatttttaatgtaaaatttaggtatctcaagttaaccgtaaaatttctcctggtataaagctgtgggttcatctaaagtttgttttaagaaaacacatacctgtggcagtagatgttgtgcatctgattttgcactcaagtgggcgtttccgcgcatatatacacatacgaatggtggattgttgacttgttgaaggttgcaggtctgcagctgccgaagctgctgctgctgctgctgggtggattggtctggagccatggagtccgcggtggcgagcgcattcttgaaggccgtgatggggaggctgttcatggcgctggagaaggagtacagcaagcacaagggcctcgcgcaagaagcccagtccctccagctcgacctccgcatgatcgccgccgtcatggacgaccagctccgcgccatggggagggcgacgacggccgacgcccgcacggccgtcgcgcggctccacgccgaggagatgctcgacctcgcgcacgacgtcgaggagtgcgtcgaccgcttcctgcaccgcctcacctgcaggcagcaccgcggcggcgccggcgccggagcgtcgtcgtcgtccttggtgcggcggatggcgcacgagctcagcaaggtccagagccggtcgagcttcgccgacgagatccagaggctcaagacgcgcgtcagggaagcgcagcagcggatcatccgcatgaaacctactttggatgtcctcgccggcggtggcggtggcggcggccaactcacaggcgctgccggcacatcgtcgacggcgccgtcgtgccgcgcgtcgcgcatcccggtgggcatcgcggagcccgtggaggagctcctgtcgatgctggacgaggtggacggcgagccggagcaga

SEQ ID NO: 32192 - DNA, 1501 bp, Oryza sativa
atacccctggtgagccataaccaaacaatgccggtccttgccttccccaatcccacctatggtgacgagcagaaggccgcgcgtgtcgaggcaggccaggcgactgcggctcgacaaggggacgagaggacgatgggctcttgtccaggcggtggcggcttatcgtgaggagcttgcggcggcggcgtctcagctaggcatcggcggcttcatgcgggaaggcgacgacggcagtggcccggccaagcggtggcggctagcacgccaagcaacaggccgcgcgcagcgagcaggtctcaggggcgctgcaagctgatggcgagcaggccgggcgcggcggacggccggaggtgcacgctgcggcaagcagcaccaacctggcaataggaagaagcaacatgctactagattggatttttttgacctcatgatttggatttgcttgattttgtgatgattgctattacatgtcttttgttagctgtgtaaaaaccatgcccaaattctgtctttttttttcttttgcaaaatatacaaattttatcaaatttgtcgcaaaattatattatgtcaaaaattttaatcttctataaaaaattgtcatatttgcaaaagtttgtgaaaaatgcaatgtaaaaatgggggcaaatacacaattattgaataaacattcagacaaatattcaatatcaaataggggtatgattgtcttttcgccagagatgtaacaccgtcaatatgtccatccaaagtaggggtaaaatttgctttaatttcaaaaaagtaggggtaaaaacgaaaaccctaaaaaaacaggggtaaaatcaatattgaagatgaaagtaggggcaagaacgaaattgccccttaaccagatcactaccatgaacaggatcttgtcccatctagaaaaaaaaactctctccatctcataatataaagcatggtcaaacttggcacagtctttaaaactaatatttgacctataatttctcatatactataagttttttacaacaaaattataaccatcttaaagtgaatttaaatgccaatctaatgatattaattttagcaaataaaatttaatttatattatagtcaaatatttttaaagttgaatcttgaaatgtatgtataccttatattatgggatagaggaagtaggagcttatttacatgaatgtgactttctttttccatcaaaacatccaggttaatgttttgtgtgacctcttctttttcttggcttagcggcattgacaccagtactgaatattgttcccgattttttttttcatcagtggagcagaggacacttgcatcttgacgaattttctcaagtcgatgggttgctgtggcagcgtaaataatctccttctccagtacaattcatattgtggttattgaactagacattacaatatactgcactgccccaatccacagacaagtagtgctgcttattatttgcatcttcaagctcataattaggggacct

SEQ ID NO: 32193 - DNA, 788 bp, Oryza sativa
atcgcgcatcacatgacaaaagcatacgcgacgcctaaagaggcattctagccgactgctttttagtcataataaaaagaacccgagtggtttacactctaaaaaggttcacgaatgaacacacttgacaggcatccgaataaaaactctaaagattacccaccaaatattataaaaattatggtaacaaataagtctaatagcctaggctatgactatttaccacaatggaaataggtatatatcataccaaggaaatgactatgataaaaacaagtcattccaagttaacccagacagcttttgtagcctaaaaaagcgtacaaaacagcataacgcctttctgtcaggcaccttttaatttgcatcgcaataattccaaagaattatatgaccgcgtaaaaaggattttatcagcattgggcaacactattgtgtacataaattgccgaagcaaagaatgcctaagtccctaaggaacacaatgggccacgctgttaaaagtattgggctgaggtactgttcaggcctaggcccattcgcacctccgatacccttaacaagaaaacccgagatccaaacgacgcttcgtcttccccgccggaactctcgccattttccccactccttgctacagtacagagctgcgccggcaaataagggttcaccattccactcaaatccaccttcaaaaagtaatcaaaatccttcccgtgatccaccgcctcaattcctcacctttcccaagccatccctcgaatcaaatcagtgcattcggggaaaatcga

SEQ ID NO: 32194 - DNA, 1501 bp, Oryza sativa
gctgaatcaaactagaaaaaaaaatgattcagccaaaaatccatctggtggctttgctggatcttgctataaggatgaagagcacggtctatgtcttgtgactggtagtggagagggcaaccgggtggcgagcagtagtcgacgatggaatcatggaaggatgtagcggtgtggtatagagatgagctcgacgttgcgcagtagcagccattcatcatctagcaagcacgaaaaaatgcaaaaacattctcgttcatgtcaatacagatgacgagcaaaagaaaaatagcaaacaacttccatcaccggcggactccaccctatcctctgcagccagccacatggagcacgatgtgcaaatgtaggacctgtgcagcccatcaattgagatcaggtaatattgaagattgcacgttaatttgatttgcaaaaaaaattagggcttcatgcgtgaagttgaaggagagtatgcatatgcaaatcagagtgtcatttccttgcttgttctatcaatgtcgccgatgtggagcagccgctggttgttgctattggcccaggtgaacacctctttgctggttaaggtgatacctagcgtccggcagcgaggcccgaagcgtgccttcgcctcaaccgtcgccggccactgccatcaaccaccacggtgtcatcctcctcctccatggtgtgtcgccgatctgtggggtgggatggtggatcgatccagatcccaaaaaaaaggaaaaaaatgaagtaggggcgagagtggttggttgggtacgggaaaaatataatatataccggaagcagagaaattgtttttatcgcagttaatcatttactccgataatggtgggagcacgatgcgggacgtggggtgggatcggaagcagtggagttgtttttattatcgaagtaaatcgtttactcgaataaagttgggtggttggggcgcgcgataggagtaaatcgtttactccgacaacggtaggagtgaaatgacggaacgtggggtggggtgggcctgggctgatgcatgtttggcgcttagaattctatcaaattaatctatgtttcaagtttgtaataattaaaacttaattaattatacgttaatattacctcgttttgcattaaaacacttaatttttatctctaagagaaaaaaacaccacctaaattaaattttttaagcatggagaaagtacatattttttgtttttacacagctggtagatgtgtagcaaatccaaaataaaatccacgaggcaaacgcgtccgtggagcagttgagccgaagcaaacgccgcccgcttccgagttccgagtcggcgcggcggacggtatatttatcatcatcctgcccccctgcaaaatccttcctacttttacgacacctccccaccccccgtctccttctctctcgtctccagatccgtgggtcgaagcagcggcggcgctccgatccacggcggtcactccctccgccatgaatcccgagtag

SEQ ID NO: 32195 - DNA, 190 bp, Oryza sativa
caatgatatattttgatcgttagtttattccatgctatatatttccaataaatatgaaattagcatcacatgaaagtattttaaaatatgaatgtaatgatataatatgcataatacttagcatatatatatatggttagtataattattaatcaaaagttaccgagtttaattttccttaaaaaaaagg

SEQ ID NO: 32196 - DNA, 1501 bp, Oryza sativa
actcgaacaataagccgttgtctgagtgaaggaccaaataaaaataatgaagctagaaggtgtttgcatgttacttgggagacttgtgtttcccctggacttgagagggacatgagaacaatgttaatattatcttgtgataatagatatatattgtctatattatctgtcagcaaggaaaatctgtctaccttaataaccatcaagtttaaaaagatcaacttcttttattacactttactgattagcacatcatcatgtcagaagaacatattacatatactcctagtactatataacatagagaatctttttcatgtaatcaattaatgattaaacctttcataacaaaaatattcctttgaacggggaagcatcccataattccacccacagacccaccagatttgaatcatagtgtgcacaaatattatgtatgcttgagtgcataagaggtgccacaaatcatagtgtaccacaaatatttggtacatcggcatattttctagtgtaaattttggtacctctagtgtaaagtttggtatctcaagataccaaacttttatgtgtaaaatgtggtacctcgaaataccaaatattggatggtaaaattgctctttttaataggatagtaaaaccatagatttgttgattggatttatttctttgagtgtgataagaggtgcactcaacgatggggtggaaaataagctcaaagtcgtagtctaatgagtctagccaagctaagcttttagctcattaatattatagtttcatgtaattagcacttcttaactaagtgtttggtctttcggttatatctaaattatttgtattaagatgataatcgtgtggctacatttagtttttagtgccaaatatttgataatatctatagaattttggcaatattacattgagtctattctaccaaaattttgacaaaccgtcactttactaaaattttgatattactaaattttggaaagatttattttggtatcaatctgactctactaattttataggacggagggtgtgatttgtttgttgaggctggggcatgttctcggggaatagatcgaatccattcctgtaattatgagaggtcaccgtcaggtttgcaagttgttgcaaatggcgagcatcgtccacgtgatatgtaggaagagttgcttaattagccgtggtagatcactcgactgtactgtgctgtgtgtaccatcagattatgctgtggaatgatgcttctctccatgttactgatactgagaagtgacgttgggttatacattgtaaggaggtataggttttgcaattgccaaattaagtgaggttaattaagcactgatgtctcctaatagctacagttcttgtactttagaaagtaagcttgggagaaacaccaagctgacatgtgcattccagatcgcagaccagggtcaaaaaaagacgcacctgacgaagttaatttccaagagaaaaaaaaatccgatctgga

SEQ ID NO: 32197 - DNA, 1501 bp, Oryza sativa
agaaaaaagttaggtggaaaagaattctacccctcaccaataaagagtattattattattaggtggataggtaaaagctattaaaagtataaaactaatttggtgcttctcaatatacggacatgacaagatatataggagtaagcaactaaattttttttagaaaaaaattttaaacattactataattcaattttttttttgtaaaataagcattgctcaactggttagatcttttatggtggaacctgaccacttagatttaagtttttgagatgagcttctctacaactatttctttgagtgataggcgactctcaatgataactttatcaatcttaacaaataccgtactattcttaaaaaatgtttatagtggtagcttatatgtgttacatgtgtgtaaatatgcatctgcaatagtcggcaatgattttttttttatcataagatatgtcatccttctctcgaatgtgcttcttaggctgagttctatcccttaagtagaagagaaaatttttcaacgcacgtgaacaggaaaattcattagcacataattaataaaatattaataattataaaacttaaaaatgaatttattcaaatctttcaaacaacatctctatagattttttttttcaaaaagcagagtaaatacgtactcccatccttagccccgttttgttcaggggtgaaaagtttagcgtgttacatcggatatacggagacacattgaagtattaaatatagactaataacaaaataaattacatattccgcttgtaaactgcgagacgaaattattaatcctaattaatacatcattagcaaatggttactgtagcaccacattatcaaatcatggagcaattagtcttaaaagattcgtctcacaatttacacgcaatctgtgtaattactctttcctgtctatatttagcactctatatatgtatcttaccattcgatgtaacaaggtaaaaaattttacgtgagaattaactccttttcatggaaacaatttctctgacgttactgtacagcgtgacatagacactgatatgtgggacccattatctatgggcccatatatcagccaccaagtgcctctgacttagggggtgtttagatggggctaaaactttttagcccatgtcacatcggatgtttggacgctaatttggagtattaaacatagactaataaaaaaactaatttcataaatgagagctaatccgcgagacgaattttttaagcctaattaatctataattataaaaagtttactgtagcatcacatcgtcaaaatcatgatataattagactcaaaagattcgtctcgtgaattagtccaaggatatggaatgtgttttgtaattagtgtatgtttaatactccaaattagtatctaaacatccaatgtgacatggacttaaaataagtccctggaaaccaaacaggcccttaaagtcagaggatctctctcccctttttacatagg

SEQ ID NO: 32198 - DNA, 1501 bp, Oryza sativa
actgctctttagctctcttcttacccatcggtctctttggctcttcggtctctgtaggttcattatcttcaccaacatgattggtagtttcatcatttgtgggtgtagcttttgctgaaccatctgtgcttggcttctgtctgttggtggcacagggtttctgggatgttatttgcttcatcttatcatgccacttagattgtgaccgcaagagagaccaacagtgaaggaattgaaagggctttccttccaactccttaaatacagcaattgcctgagcaatctgcacaagtcaagtatggtgaatgtagttagcaaacatcacatttttatttataaagtaacataaaaacacaagctacataactatgtattaccttgtcgtgtatactaaccccgctttgccttctaccctcaatctggctcagatgtccacaaaacttgttgacattctcttgtatagttttccaacgatgcataagtgaattttggctgcgatctggtgtggatttactcgttttgtagaagtgctcatatattctagtccaatatgcagcacgagtttgatttgtgcctagcactggatccaaacttacatgcaaccacgccgacacaagtatcttatcttcttgttcgctaaaattcttcgatcttttttgatttggtctagccacggtagtcctctcagcagttgggaactgctgcgtgacaggctcgctactcatgccattctcatcaagctggttactcatatcatcctccacaggcatactactcaaactatcccaatctaaggaatcgttgccctcattcatcaaattagtatagaatccttcttcttccattatcaataggacctacaaatagtacatgtttgtttaatttagtgatcaaataagaacagtactactaatacgtttgtagaagtactagcatcttgggactctgcaatttaattcagacatatgttcactgaatccattacaaaaggctaaaaagttaaggtcagaaaatactagaaactaatagcaatatctagccaatgagcagctaactggtcaggtcatcaaacacttaaattatctaagaaaaggtcatcaaatactgctgcaagcaaacaaaaccctgcacatatagaagctcattgtttagttaatttagggtgctatacaacctgaagaagaatgcatctgactgaacacaaacgcaagcaaacactattgaattaacaattggtataggccagtaacttttgtgacatccatgttagtataatcctcaaattatatttgatcagtatattcgtaaaatgagttcctgatttaacacaagttaagttcaatctaggagaacaattctcaactgacgcctgaatgatcctgaagctgagaagcagcaacaggtatgatgcttagtaattctgaacttcttttgaagcagtatcacaattcgttcaggtgttgtgcctcaacatttttttctatatttttctgaatatcca

SEQ ID NO: 32199 - DNA, 1501 bp, Oryza sativa
tgaagattttatctcggtttttattaacatgtttttgaaaaaaaaactttattacatatgagtcaaataaatctaccttttaagtttataataattaaaacttaattaattatacattaatggtctttttcgtttcacgtgtgtacttcgtcttcgtcttcttctatatccgacgaggctataatcaaaactcccggtggaacataagaattcaccctaggtaaattcaggctttacttggaagagtggttgatgatggctgagtttagttttaaactttttcttcaaacttccaacttttacatcacatcaaaattttcctacacacataaacttctaacttttctgtcatatcgttctaatttcaaccaaactttcaattttgatgtgaactaaatactgatattgaattgggattgaattgggcatatatatctttagcaataataattagctcatttcctatcaaaacaaaatttagaccctgttgagatcctaggctaaaatttttcaccttatcacatcgaacgtttgaacacatacataaagtattaaatatatgctaacaaaataactaattgcacagattgcgactaatttacgagacgagtcttttaagcctaattgcttcatgatttaacaatgtggtgctacaataaacatttgctaatgacggattacttaggcttagagcatctccaatagatgactaaaattaaactcccaaaaatcctgtattggggacagccaaaaacatatttagcctaaaatacaccctcttctccaagagatgactaaaatttggttcccaaaattttaaaatttttccacatcatcattagtgggcccttcccaactaattttctacctgctcgttaaaatcacatgcgagagcggagggggagatcgcgtcgcgcgtgagaggcgaggaggagatcgcggcgtgcggatgcggaggggaatgggcatggtcgacgcgacgcacgcggacggaaggagatggctgctcatcctagtcgcgcgcgagatcgcaactgataccgttggcgaggttatatatcagacgcagcgatatacgaaattgatcgaaggacacagtgctatagacgcacatagagctcttcctctgtcagcgccggcggcgttagcacttcactcaatcagagctcttcctctgtcagggccggcgacgttagcacctcacttaatcaggtagctgcagcaagcagcaacgattggtgacaggcacaagctcttgtgcagtgcgtgagtagcaaaattttgctagcaaccatgttttttactttgttctatttcctttttttatgtttctgatctgacaatgtcttgatggaaaaaaaaacttaatttgatatgatgaataaatatttggaaaaacggaaggccaatcacatttttttttaatttgatctgacaacgtcgcaaggggaaaaacttaatttattgtgatgaataatggtttggcagttgatttgatcca

SEQ ID NO: 32200 - DNA, 1501 bp, Oryza sativa
tgcgcccgcacgatctccactgatagaaattgatttcgcgtatcttgcgtgaaggcggcgactcggtttatataggataggtcgcttgatcagggagcccgcatgatatatagagataggtcgcttgatcagtgcgctcgcacaatctccacttcgcaaaacaaaaccgcaaaagaaggctaggcgaggcgagtgttccccctcttctctccaccacacatgctttaattggctaggagggcatcatcccttttaaagaggtccccctcttctagaataagtaaggtggtactaaactttccatgtatactatctcataaggtgggcttttatgattttctaaagaattaatctttgaatgggttaaggcccatctattaattcaacatttagcacgtcaaaacaaatgcaaggatccattcgcagcccctggctagccgctagctactcccaattactagtactaatcaaaatcaatttgcatgtactattaaaaaacaaacaaacaaacacttaccttttgcactctaatccatatgcatgtgactctcagaaacaatatccacgaaaccgagcaaattattaatcaagcaaacaaacacatacctttcgtactttagcgcaaacataatctaagctagtgtccatatcattaaaaagtacacttagccattctcacaaagtactcgtacttgacaccggccaatggaagggacaagcaaaataaaattaaaaaaaaagaaaagaaatccccctgaattccagtgaagtggccttcacgtgaccaacctaatgagtggcgatgcgttcagcttcttggtgagattgaactgcacgtgacatgtttcaggcttgagagtgctaggttgagtgcagctgtaatcacacagcactacactacaagtgtctggctgcattgcaagaagatccaacagaaagaagaaaataagaggaagaaagagaatcaaggttcaaggaggattttcagcaaaaatgaacgaaaaagaagtactaaactaattacagacagacaattatacatatttatttggtaattctctatgagtggttgtgcccttttacacaaatctagggttttgtctgactactatatattagaaaattaagttaatctcagcaatagtttgaagtataatagtctgtttgacacagcttcagcttggagcttagccaaacagttaacacttcacctaaaatagaaacggagctaggtgcagcgttctcataaaataaactaaagatgtggacctagatttagactactccataactcatctttaaacccaactcttattttaggagttgaagttctatcgaacaaaccctgaattacaacaacacagccaccacctctctttgcaagtctgtttgggaaagtccgaagaaaaaaggattttgaatcctccttttcctttttcccttagaaaaataactcaatcaaaatccaattatctactctacaagaacgaaacgcttgtta

SEQ ID NO: 32201 - DNA, 1393 bp, Oryza sativa
aggagggagggagagggaggcggcgctgctgctggtgctgatcgcggcggcgtgcggcttcgtcgtcgtgctcctcaacctccccgacggccgcgccctccccggagccggaggagtacccggtgcgcctctctctctcgtggaatctactacttgctcgttcccgttcatcctcctccggcggccgcccgcgctgatgaacttcgcgattcctttaggcatttggtgctctgattctgattctgattctgattctggcgtgctgcttaatttagccgcgtgcttttttttttgtgctgttcctgctgcgaactaatggcgatggcttgatggctttgcggtggggttgggtacaggtgcggttggggagcacacgggagggacccatgtgtcggtgaaggaggtgggtgattcggattcgagttctagttcgattcgattctactctgttttttttttctctccaattttctgtacattttttttcaaattcagttcagttgttgattcagtgttggtttttttgcagaggcggatggtagagatcgtgagacagcagcaggacgtagcagcacaggaggtatgtaaaagttagcttgattttagctgcatgtggatgtgtatacacattgtgtggttttcgttcgatttcgtcttggtggagtagtgtggtcgcagaatggagtagtgacactctctcagtctctctgttcaatccataaagatgcagagtgctatactgctatcggagtatcgattttgttgtgctcagtgatctgttctaacctgagatgattcatctctgctgaaatatagcttctggtgtaaggggaatgcttagtcttctgacaggacagagtgaagtaaattgaattagggatgagatttgggtgccctttttgtgcatttctgacacttgtcctagtttacagtggagacagttttgtgttgcatccctgagcaatatgcgtaatgttgctcaagctcaactaactgtgtttggaggctagtatagatatccaatcaatgcaaatttagtgaagtataacttctggtgagtggggaatgcctagtattctgtcattacagagtgaagtgaattgaagaagtgatttttgtgatccttttgtttttcattttatacagttgtcctagttcacgattcaatcgattttgttttggtcccctatgggatatgctcttttgctccaatgataatgttttgtcttgactggtttggataatagaataaatattcaatcaatgcacttaagagaaactgatgtcagttaatttttctgcagttagaaggacaaactgatgaaaatgctgcagaggcagatgaaagaatatctagatctcctcctggcactaaagagaagttatggatgat

SEQ ID NO: 32202 - DNA, 1501 bp, Oryza sativa
gcagatgtaaccgggtccgtttcgcgagttcaaacagacgctattgctgcttatgcacatgtaggaatctgaatttgttttagcttgctcacatgtggaattaccaatagcccagtccaccacaaaaggtggctggctaccaagattgtcattgaaccttgatagggaattgtaaaccgtggagaaattaaagctggatgtctcgacaagtgctgcgtaagcacaacgagtccagttgtagatgtccgttgtgttgaaacgaccgtcgaaccaaaccttgtaataccggatccccttagggatgttcgtttggcaacaacctatcccagagcacccggcactgttgatactcacgagatcatcgcctataccacaagtggccgcacaaccgatagttaggttgctacctacatcattttgttcacctgggccaagataagcgagcatacggcacccaaagacaataaacttgttagcagtgtcagagaaagtgaagggactccctttcaagttcagatcaaccatatcgacgcagtcgatatccttccttgtcgtgttgtagcagtcgtaggacatatccatcttcatccgagcctgacctaacggcagcgagatgccgagcacctccacgttccgcaggagcagggtgggcacgccgttcccggtgtcgttgcagctcagcttgaagccggtcatggcgcagccgggctgaccggcgatgccgaacgggaaagggatgtctatctcaccgcacttcctctggcaggatgctgcaacagcggcaagacatgccgccattgctacggtgagacacagtaaagtggctaccattgtgcggcgcaatactagtggtggcattagcagcgcctgcatcatccctgttgttttttgggtggaaatgagggcttctaatagctagcagctctgcatagtgcatacaccactggaactagactgtagtactatatatactgcatggttaccttgacttggacttgccctagctcaaagtcgtcttcacctaatatttagggcatcgagtagagactgcatgattgaaccaacaaatatgctaactgcagcgttaatttacttcatcctgcggtgttcacagtataactgatagtatgtactttttcctagctctgaacatctgcaccgctgaccaagattctcattcgatttaatgtgaagcaagctagattgtcattaattagcttgattcctcgagtggtttatatgtaccaactaacagctctctgtcctctgcttaattagttcgattaattaggaccacactgaagatgtctagctatgcttcacctgagttgtttcaaaattttaaaacatcaactccaataaattaatgcattttatgacacagtacagtaccggtggttgtgaacggtttaccatccagggcatatataacttcgtaatattcattgagaaaaataagagagctgcatagtagagagggattgatactatgtggtgtggt

SEQ ID NO: 32203 - DNA, 1501 bp, Oryza sativa
gtttcctttggattctatcccgagttggacgtggaggagggcctgtagagggcaagactaacccctatatgagggacatggccggttcaattgtaactatccaatctacaatcaatcaatcgaatcgttttacatattggttttagttttcgcttagtttgttcatctttatcgttttgcgtcgtaaatcacccgtcgccgctgcgagagtgtcacacctctttgtaggtttgtcctgaaaacctttcgttttgactacgagacgggtagttatctagaatcggcttcgctagccggtttagttatcaaaacccatcgtggtttagcttttgctaggttgcggtggttggcgactctaagatcaccgtaaggcggtaggtgttgtgatcgtgcttatcaacttgtcacaaaaaattaccaataataactctcaaaagtaaatgtagggagtaaaacataaattcctagctggcctcgagtattgaattccgtctacggtccatggatggggatccagcggaaaatgatcaaagccgaacggtgttttcgcccgattggccacgttttactaaacactttgtgtttaagtccctttcactgttcaatataatcttacgatttgaacagctcgtatataactgattgaatgtgttcgtgcacatagactataactttgctgtttagggcttatgggtctctggactagtatgtaatgatgtttttaagcatttaattgtgtttactcttgatgcaagtccaattaattaatctactacatatgatttctatgttgagctttccataaaaaaatgtgtttacctagtgtaagtgacgctctccctttgtttgggtttattttcatgcatatataatgttttttggagagcataaaaatttgataattaatgttatataaggccaataataataaaaaaaaaataaatgtaagaaaaattacggaaaaattctgataatgacatacttcctccgtttcataatgtaagtcattctaacatttttcacatttatattgatgttaatgaatctagacatattaacataaatatgaatgtgggaaatgctagaatgagttacatgcatttcccacattcatattgatgttatatgtctagattcattaacataaatatgaatgtgggaaaatgttacaatgagttacattgtgaaacggagggagtagtcaaatgtggaaaaattccgataatgacatatgacatatgtcacattgttatgtgaattggtttttgcatgttaaacagaacaatatgtgtgaaaccaattcaaaatatcaacattgaatcgaaatgagaaacttggtcagcgcgcggcgcagatgttcagagctaggaaaaagtacatatatatcagttatattgtgaacatctgcatgttaaacgcgtttttaaaattaacaccacaccacatagtatcaatccctctctactatgcagctctcttatttttctcaatgaatattacg

SEQ ID NO: 32204 - DNA, 1501 bp, Oryza sativa
cttgcttaaaattatgcgtagactcctccggcacctaactgacaatctgtaatgtatcttaggtaatgccaagaagatgagattgtaatcaagaaactttttatcatgatctgattctgcaagctagcaattggatccatagggaattagcagggatcagctggaaactcacctaacagagatgtcatgtttgatttgattctgcttataaggtaggaaatgctccctgcagggattaattgaagaattgttgtctgacattagactaatccacatttctcccttcagagcccaccaaaaacactgcaaaaaaagagttttttttgtctttaaataaacaagatcttcaaggacgattaagattacctttacattttcaagggccacacgcatgcacaaaatttagcttacttaagaaaacaataattttgctaattaatataatgctcaagaattttttttctcaaagtctaactaaggaaaccatgcatgttgcatatggacattttaaacggcaacatgaattaaactaaccagagcacctaactacaatttgttatgtttaattacccccccaaaagtgcaaccatatatggcaacaaggagacatcaaacattgccgaaatctgccatccattttctagtgctaccaacgccggtgatgcttatgttgctgacgtggggttagccacttaatttttgtcgattatttgctgttgcttttcaatcaggcacggcggaatatttaaatatacaacatgtcaatttcccaaaaccgtcgaagaggttccgtggttttctcttttcttctgccaaagctgatttgcaaaaccaccgcggtgtttccattcttgtgccaattccagctgctaggttttgaagcttttctggttttcaattaggttcagtgttgtaataaagtttcgtactccttaatgacaggtttggtccaagtaagctactccatcgattttaaattaattatcattttaattttatcctaagtcaaacgatatatctttgaccaattattataaattcgtatagttaacaacatgaaatatatttcttttagtgaatctaaaaacatgaattttatgatattaaactataggaatttcgataaactaataaagctataatgacaagcaatttgaaatggagggagtagttatacgctgcattttccaagcatgcaaacaatatttcaatgttgagaaattttacggttcaagtagtaccggaggcatcacattacactataaatgtaatgcgagggtcatcggttcaaatccgatagtcggcttttttctctatcaatattccatgaacaaaaatacctctttttctctgaattaaatggagaagccaggatctattatgtcgttctaccctacaattttgctagatacaaaacaataaaataaataatatatatacaaaaattcagatgttgatgaaattccatttttttgtggtacttttagtagattttactctg

SEQ ID NO: 32205 - DNA, 1501 bp, Oryza sativa
cagacctgaaggcttcttctgaagcaagagagagccgcaactctgagctactattagaaaaagataatatgatcaaacagcttgatggaaaactctctgatgcattaagtgattctagcaaagaccgtgagaacatcgctgcgctgaacaaggaattggatgcaacaaaagcaatgctagagaatgaagttgctgcagttaaaagtttaagagaatcacttcaatccacagaggaggcactgacagattccagaagtgaggtatccaaactttcagtggaacttgatgaagcaaatagaatgaaccaggacctggtgctgcaaatttctaaactccaggatgagttcaatgaaatgcaagagggccttactaacaaactaggagaggtagaatcagtatctaaagctctgtcagacgaacttgtctctgttaaggagatggttcacaagggacaggaagaacttgaagccacttctaatgagcttgcatccattgtggaagctcgtgacaacctgaagaaagaattgctcgatgtgttcaagaagttggaatccacgtcacaggagcttgttgatgaaaggaaaactgtcactactttgaatagggagcttgaggctttggtgaaacaactacagatggattctgaagcacgaaaagctcttgaagcagacctggatgaagcaacaaagtcactagacgagatgaacaggagtgcattatcactatcaaaggagctagaggaaactaattctaggaaggacactcttgaagcagagaaaaaaatgttatcaaaggctcttgctgagcaacagaagatcacaactgaagctcatgaaaacactgaggatgctcagaatcttatctctaggcttcagactgagaaggagagttttgaaatgagggctagacatcttgaagaggagttggcgttagcaaagggtgagatattgcgcctaagaaggcagattagtacaagcagatcacagaaagcaaaaactcttccaaacacaaatgcatctccagaggtcagtcaggctccagacgagcagcctgtgaatgataatcagaataccagcaaagttgctgctgggtctcaatatactgcaaagaggacgactaggagaagaaaaggtggtgcatcaacgtgaatgtgcttgggagattgataggaaaggaaatcatctgctttcattgcttcctgtttagtcatcaatgataacttcattttttatactgtcttcctttgcaacattattagtattatttctatttgcttatttgttgcagtggaaacttccaattcattagctattcctatattttgagttttggaagttgaggatcagggtcaaatatgtgtacagataattttttgaggttcaacatgacagaaaatatttttcctatacgtgcttgtgctgaattattcacacatcatattatgtgcttgttatcaactaaactaaataaaatgtgtcattaactctttatccagcaaata

SEQ ID NO: 32206 - DNA, 1501 bp, Oryza sativa
tttttctgacttataagctgcaattaaaattcggattttctaacttaattttagaagaaatgattttaggagttttttcatcgtgttatattctcccctcttgatttgcaggtatataagttctatcaataaaatattatttttatttattttatttatttttctaaccagttaaaaaaacattgaccttactaaatgttgataatgtcaaatatttatagaattgattttgacgagaaacgttaaaaattcttgcacatagagaaaaatctgcgcaaaattcttgccggccgagacgctgagattatcacccgttagcacagatgacattattaccaacaaaagagggcatatgaaaattacggtgtggagtagtattacacattgggtacatttacacggagggtaaaaacctgagaaaatgagtactgtagtagaaagaaaggagggaaaaaatcagaatccagcgtagcgggccccaccattgaggtggtggggtcggtcggctttgtcaaatcggggccatcgctgtccccgtaaaagtggacgactactactgttggagtacgtcgtacctccatcactcccgaaattttgataaattgacccttccataaaacttattttaaaattagacattgctaaaaacttattgtataaatgagacattcgctcagcattcattgaggttgacgctgaggtataacttctcagcgccgataacgttatcagcgctgagacgttatgacggtctagtttttgccaggggctattttcagaataagttttttaaagagccaatttataaaaaaacggtcatcactcgctgctctttgggccccacagcgcacgggatacgttgtgcggttgtgggtacgtatgcttcggtctggacatatgccagcaaaattttgatcattacagtttgcattactaaatttcaatattatcaaattttaataagacaacatacttaaaccattacttcatctgtcctaaattataagatataggtaacaaagtgaacaaactgtttgtatttattggccattggacaaaaccggctactgagagcatactcatgtttacaatgctaagataaaaaaacatattataatgtaaactagcctttataagatatatatatatatatatatatatatatatatatatatatatatatatatatatatatatatattcgcgagatgatgtgacatgtagattgaagccactattgaagtcagtttccttatcaatgcaaatagctagaatgggctcgaaatgcatttcaaccattactaatttttgttcggttcatagaatgagtttgatgtgagttttatgaagaatgaaattcaaacccctcacaaattattaataccatgctaatgatgcacctatagccggaggaaaaaaaatattacttttgatccccttagttccatccctttcacttgtcgtcgtcttcgctctcatatcgaatcgccaccccaggtcc

SEQ ID NO: 32207 - DNA, 1501 bp, Oryza sativa
ctcacgtttgttcccaaacaaattcatttttaccaattattgtatcgagtttgtgaaagtacaaataaatgtatcagaaatagataaattaatggataattgtatcgggatttaactgaagcgggatattatggtcctttcgattttatatcgatatgtagggtgagtggaatataacttgttttaggacgaaggcattactagtaataaaatagagtcgagtttatttcaatatattgaggaaaaaataatcatatgtactaaagtgaaaatcctaaaaagagaaaaggggacagcctcaatgtttttttccccgaacatgttgaactaattttgagtaaattataccgttggcggagctacaaggtaggtgtagcctgttacatgaacatgtaaaaacctcagaccaatacaccaaaacggcaaaccgcatcaattcttgctgcgtcgagtacattgagtaggatatcacgtagtcgtaggcacacacatgaggaggatgttatgcggatatgtatgtgatcagtccactagagactaaggtacacttgattatttaggttgtgtttttaagtcaatgttcctaatttcacttgtttctttttcacgtgtatgttttccaaaccgttaaatgatatttttttagaaaattattataggaaaattgcttttaaaaagttatatcaaactatttttaagcttttatacttaattaaccgcacactaatgtgattgttataaaagtacgtcgatataatggaacgacaattaactttttcgatcgcttcagtcattggtcacctaagacacgctaaatgacgacataagaacacatgatatttgttaaagagatttagcctaagcctacatgcatcccagggctctaattatgggcaacaccaagacgctacgagtctatggcctcaccgccatagtcttcctgcgtgtctatgatacattatagtcgccatcttttatattgtggtgccctcctctctttaagagaataccgggttataaagtccgactttaacttcacccctaccaaatattacaactccaagtccaactttaactaaatagtactagtatatttgacatttattctaacaattctcaaccccttctcccgaacacaactagagtgactttcgtcccaccttaaatgaagcttactcgcattatatggtactcataaactgaaaatagaatctccctgtataaatcacattgggaaatcaccctcatcttattgccatattatgcgctagtcgagatgaggacgctcttggcgtcgttgacatccattgctaagtcccacgctataacctctatcacttgaacactaaaaactccactcctcgtctcctcctaactcgaatgacttccatcttataaaccgttattgaaatttaaaatttaaaattatttttttcagcattttttgtttttaaaattacatttgaaattgttaatgacacacatataaaaaattcaacca

SEQ ID NO: 32208 - DNA, 1501 bp, Oryza sativa
agttgtatttattttcgaatgaagggattatagttttgtaaagtgtgactgtgtgaattgtttgagggacctaaggaatggatatatatatatatatataatgaaatttagaaaaatcatttttatttgaaattggacacgggaaggcagacactatgagttcgtgtagtaaaacagggtgtgccttttgtgtgcgccagctcaggctggtggcggcccatcagatgctgagctggatgggggcccacacatcagtctaacaaaaggtgcggacgtggtacactcgagcgcgtcatgggtttctcctgattggccgcgtccggtgggggccacctgtcagtggtaagtaatgcgcccccatgatttgcctcgtgagtcgcgacaaaattaataacactcctactagtacaatctgattaattactactaatagatttttggagatacatataccgattgttttgggatttttgaatataaatcacttttctacccaaatggtttttgcactacttttattctgtttgttttttatgtgagtcaattaaaccagcgaggaaatctaaacggttagaaaatgtatgttatttcttaaaacttgtttttttatgcaatttcaacacgttgacccggagaagtatttttagccggcaaaataatatattccaatattatttccgaaaacaaaaataagaaaaatattagatcctttaattgtcaagttagtattgttttagagcctaacaggtggtcggtttggttgacttgccagctgaacaacgtttctcatacttcttttttttttctccctgccctaatttttaaacgcctcccctttcacacacaaacaaagcaagcttaattagattcttaatctttagctttctttcagtttgtttggtcgtctttgtcaaaccttttggatggatggtaaaggggagctcaagctaaaccaggacaccctaatttcattttcggccaatgctttttcattgctacgaaaggtggtcaatatttttttttaaaaatgtttttttatcaacttctaatcacatatgcatgtggagatgatctcacaatgccatactataataaaagatcttaatttttttattccgaatgtgagatcataagatggaagctagctagggtgcgttcggacgtaggtttcaacttctattcccttgttttccacgtgtacgttttttaaacagttaaatgatgagtttttttttaaaaaaaaacattagttttaaaatcatattaatttatttaaaatatttttatagctaacacttaactaataacgcgttaataagccaccgtgttttacatgtataggagagaagttcacaatcttctcttccgagggcatcctaaggccccgtttggtagagctcctaactccaactcccaactccaaactccaactccagtgagagctagctcctctaggagctgaggtaggtaaaaaagtgtttggctagattactcagctcca

SEQ ID NO: 32209 - DNA, 1501 bp, Oryza sativa
ttgactgacgattgggctagcaagagtcagtcacagtagcgtgtaacccgttacagaggtaactgttcaggactggtcatcggctcttttaaggtgatggtgccacctacagcaatgtatggtggttgatttattggtactcaaatctagtttctcttggacattgattccgcgaaccaaattcagtccacgttcgcacaatcgcactatagttaattactccctccattctaaaatataaccactctaacctaaacgctaagaaatactccctccatctatttttgatagacatatttccaaatctgaaaaaattatttttgataggcatagtttaatccaacaacatatcatcttaatgaccttctcggatttaatgcatgactcttcattcttacacacaagattggctacatagacattgagaaatgtaaatattaatgaatcgcttgtttacgaggaatgactagtagcatatttaaatggatgataaatataattacttatctttggtctgtgtgccaagatgaaatatgactatcaaaagtagatggagggagtaattattatcaccttatagtttgaattatcttaataaatactccatccgtcccacaatataagggattttgaatttctgtttgcaacgtttgaccactcgtcttatttaatttttttttgcaaatataaaaaatgaaaagttgtgcttaaagtactgtagataataaagtaaatcacaaataaaataaataataatttaaaaaaatttaaataagacgagtggtcaaacgttgcaaacagaaactcaaaatcccttatattatgggacagagggagtagaatacatgcaccctacaattatagatcttgatggtcaaggatttgaataataatattttagtgaaaaatatgtgctaggtaatgacatgcatgcatgtccgtcttatattattaaataactttaaaaaatagttactccctccggtttcattttaattgacgttttgaacaatgacacggtctacaaaatatacctttgaccttattttttattataatatacacaataaataaatgcatgtttacttttattatagtgttttgaaagacaaatatatatatgttgttatagtttctttaaactaaatatttttgaagttattgatggtcaaagttattaaagtttgacctcaaatttgtccaaaacgtcaattattatagaaccggaggagtatacgttattaaataactttaaaaaatattatggaatggaggaagcaacattgattacgagatgctttctaatggaaaattatgtaagagctgagttacaatcgtgaaacccatctaacacgttacacctagtcttccgtcacaagagctatccttggtttttctgatccactgcatgcgctagttttgcagctgctctcctttatatattcgtgtcatttagataccataccacatcctgctactcataatccatcttgttaagtgc

SEQ ID NO: 32210 - DNA, 1501 bp, Oryza sativa
taactggttacactttgtaggcttgtggatggatctgacgaggttgattaattagtaatttttctgcagaaattgcaaagctagatcgatcgattgatcgatctatcgagcacgagtggcacaggggatcagtcggtcggtccaaggtcgccatcagagttcgtcggttggtctaattacccaactgacctagtagcaaaatactactccctatcattttttaatagacgacgccgttaacttcttacatgtttgaccattcgtcttattcaaaaaatttacataattataatttgttttgttatgagttgttttattactcatagtactttaagtgtgatttatatcttatacatttgcataatttttttaataagacgaatggttaaacatgtgagaaaaagtcgacggcgtcatctatttaaaaaacggagatagtactaatctatagttatttgattttaattgcagctgagatcgatcgagtggtgctccatgtctcctccgtgagagatcgaaagcttcttctttattaatccttaattctgctcggccatcacgtcgtgcgtgtgtgtacgtgcagtaatggccggcgatcgatctccctgtccatgggtggattaattactctctttaatcttcttcttcctcctcacgtcgttgctcagatgataataattcgtggatactacgataggaaggcttagaaattagcttgaatttttatctttagaaagttagcttaattttcactgttgcgattcagacgatcagtgatatgatatgatgcaggtgttgtgccgcagtaagcggtaaccagcaattggttagttatcagttgacttgcaattaagtaggcagacaccggttaaactttttcgtgtcaggattattgttaggtccaatgccaacaaaatactactccgttagttttgtccatatacatcatttcgatctcgcatgctgtttattcggtcaaacctgtcaaaattttgcctaaacatcgcgacaatgaagccaatcaaatcgagcaatagtcgccttgattggctcttctgtcaatggacagatggagagagagagagagagagagagagagtttcagtacgtgacagatgcagatcgaattcgatcactttcatggaaaaagtttttgctgtgaatcaaacagatcatgcaggaaccaaaggatctggaaagaaaaaggatatttgagcacaaggaacagcgaccccaaccttatagcacaaataaagaaagatgcaagaacatggataatggcaggcgcaaggcgacttgaagaattccttctaagttaaccacaacgtttatgtaattttgtatagctcttttttgcctctaggagatgtatttttttacgcctatatctaatgaaatagcacaatctcgtgctgattccttaaaaaaaaacagatcatgcagattaatcttgagagttgagagctactcttactgttcatgcatgcacggatgcatacat

SEQ ID NO: 32211 - DNA, 1501 bp, Oryza sativa
tgacaactgaacccaattaaaccagctgcatttctcttctgcacaaaatagtcatcgtgatcctctactgcattcattatgcgaagaaacagaggcctgctcattctattcctgcgaatcataactaatgagacatgcatatctatgcatataacaaaaataaattatataaaatttacttatacaaacctgcgcctgaataaaactgggccataggtaggattatcagaaaagtagtcttggtataatctcaagtgccgtgcttctctgttgcgatcaatcacttcatgtcccatgactgacccaccatgtcttggtgcattgacagagtgccaatagctatggacgatttgtgccgtggcaaaaaaaaaatcatcgtcatcgtcagacgatgattcatccacgagctgttgaaacgaggagcgaggtcgactcatcttggatcaaatcaactgccaaaccattattcatcacaataaattaagtttttccccttgcgacgttgtcagatcaaattaaaaaaaaatgtgattggccttccgtttttccaaatatttattcatcatatcaaattaagtttttttttccatcaagacattgtcagatcagaaacataaaaaaaggaaatagaacaaagtaaaaaacatggttgctagcaaaattttgctactcacgcactgcacaagagcttgtgcctgtcaccaatcgttgctgcttgctgcagctacctgattaagtgaggtgctaacgtcgccggccctgacagaggaagagctctgattgagtgaagtgctaacgccgccggcgctgacagaggaagagctctatgtgcgtctatagcactgtgtccttcgatcaatttcgtatatcgctgcgtctgatatataacctcgccaacggtatcagttgcgatctcgcgcgcgactaggatgagcagccatctccttccgtccgcgtgcgtcgcgtcgaccatgcccattcccctccgcatccgcacgccgcgatctcctcctcgcctctcacgcgcgacgcgatctccccctccgctctcgcatgtgattttaacgagcaggtagaaaattagttgggaagggcccactaatgatgatgtggaaaaattttaaaattttgggaaccaaattttagtcatctcttggagaagagggtgtattttaggctaaatatgtttttggctgtccccaatacaggatttttgggagtttaattttagtcatctattggagatgctctaagcctaagtaatccgtcattagcaaatgtttattgtagcaccacattgttaaatcatgaagcaattaggcttaaaagactcgtctcgtaaattagtcgcaatctgtgcaattagttattttgttagcatatatttaatactttatgtatgtgttcaaacgttcgatgtgataaggtgaaaaattttagcctaggatctcaacagggtctaaattttgttttgataggaaatgagctaattattattgct

SEQ ID NO: 32212 - DNA, 1501 bp, Oryza sativa
tgagcggttattttgcatcacctataaatgaaatgatttgaaggatttcatttttgccttgtccatttaaattccgcttgcaatttgaactttgcgatgatgagttttgctctctcttcctcacctctcttctagtttcgggaattccttttctcttcctcctctagtttcgggaattccttctctcttcttttgctctcttcttttctagatccggcttctctaatagccgcggttctagtaaggattttgagaaatccggcttgatgagtattttcgggggcaagatttgaattgctatattcacccccccctctatagctgttctttgtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatcaccttacactgtgcccgatgatgctgacatcacgcctgcaaatatggctcaggttgattttaattatcgtgcaagaaatgcaatcattggtggaatttcttctggtgaatttaatcgtgttcaacaccacaagtctgctcatgacatgtggactgctctgtgcaatttccatgagggaaacaatgatattcaattggttcgtcagaatcaatttcataaagaatatcaaagatttgagatgcacccaggagagtccattgattcttatttcaagcgttttggagaaattgtttcgaagttaagatctgttggaaaagagttttctgataatgataatgctcgtcatcttttgaattgtcttgattatggtgtttgggaaatgaaagttacttccatcacagagagtgcacctctgagtgaccttaccatggacaagctttactcaaagctaaaaacccatgagatggatgttttccatcggaaaggcctcaaacactccatggctttggtagctgatccctctggtagtacttcttctaatgactcagcttttgtgtgtggtggcttctctcttgccgctttacactcagtcactgaggagcaattagagaagatccctgaagatgatcttgctctttttgctagaaaattctcaagagcttacaaaaatgtgagaaataaaaagagaggaaaaaccaatgaaccatttgtgtgttttgagtgtggagagcctaaccacataagagtgaattgtcccaagttgaagaagaagagtgacaagacgaccaagaagcccgagggacaagggcgaaaggggaagaatgatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctca

SEQ ID NO: 32213 - DNA, 1501 bp, Oryza sativa
accgctgaatctccagatgagtctccacaggcagatccttcactggcgccaaagagcacacccaaaaaaaggtctgtaaagctttcagttcaaagttacagtaatagacatttctcgcacacattgtatttgacatgtccttataatgaacagaggtagacctacagaaaccaccacaattgccaaaaaattgttcaaggatagtacccagaagaaacccactgacaggttaattctgaataactcagctcacctctccacacatacgcattaattctttagtaaacttcactaaatttctaaactcatcattcattcctacagtgaatgagacggatatatgtagtccatcagcaagtcttttgtgtatatgtacagaacgaaccacccaagctagaagtgtagaagcaacaagttagctgcaagcctagagaggctaagaagcaagcccttttgttcatgacccctaggtcatgattatcattgtaaataagtaatgttatgtttaccttccttgccaccttctgtgctatgaaatgttgttcgaacaactactacttatatggaaccaatatagttatggctgcgtactacctaaacatttctccttcatgtcaaagacaccattatacgcaaaccttttattttctactatagctatatcgaaccatacaatacactacatgataaatagcacaaattattctgacaagcaaactccattgtctcaatcctacggcatggaaagatttttaaaatagagtaaattccctgtgtatccctgaaaactcactaaatccctttcatacccctaaaatttacccgaccccttctatacccctgaaatttcaatttgatcccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaattaaaatttttatttgaaattttaataggacaatggatttttttatcaggagcattcataaaaaaaatgttgtgaacattggtatacctatctttatatgaatgctcctcatttttatgatctttttttaaaaaaataaatacgtattttttttatttcattatctaaaaatatttttttgggataaataatgcatcgcacaacaaactcataactataatagtctcatgcgagaagcttttatatttttaataatgtaatttatgaatttctttgttcatccaagggtaaaatggtcatttttatagaaaatacacggtcaactaacgggaggggtatgcaagggatcaaaatcaaattttgggggtatataaggaagtaagcaaaattcaggggtatagaagggattaggaaaaatttc

SEQ ID NO: 32214 - DNA, 1501 bp, Oryza sativa; identical to SEQ ID NO: 32000

SEQ ID NO: 32215 - DNA, 1501 bp, Oryza sativa
aggacacagactagcacccgggaagaattaagaaagttcttatgaacccaggaagtaaccttagagttctttcgagatcggcttccggaaaagaagttgcaacttgttggtatgagtattctattaatcctctttaagccctgagccgggatgtcacattctctcccccttaagacaccgacgtcctcgtcggtcaacccaggccgggaacgtctcctattagcaccacgtatatacagacaattttcggcgcacatacgtcatgccatacgaccacatcgtggatcatcccgtgtgcaccgtatgcccgcgtacatattcatatatacgtatagctgcaagggtcggcactgataccatctgtaacgctgcaagggtcagctctgataccatctgtaacgccccacactctccgaggccgggccctctctacatctggcagctttcctaggatatagactgccctcatagcacactttgtcctcactcgtgcgcacccgggaagaatttcccggtgaccgccaggccctctctatatctggcagttttcttaggatatagaatgctctcacagagcaacacaagtcttttctgcacactttgtcctcactcgtgcgcacccagaagcggcttccggaaaagaagttgtaacttgttggtatgagtattctattaatcctattaagtcctgagccgggatgtcacacctggctccttggatcatgtcaatcttctgcccagccttgacgaaggtgaaggtgggtactactccgttgacatcatacgagtctgcaatttcctccagctcatcgatatcgaacttcaggaaaactactccagcgaactccttggcgtactcagcgaaaactggagcgatcctgcgtgaaggttcacaccaggatgcaccgaactcgatgaccacgagcttgccacacaccatggcctgttcgatgagatactagaactcatccatggtgtggcactcggtcaacatcccttccacgccgaagggcatttcctcttctcccctctgccggctgcaaaaagttaagagatctgtttcaatcttttgcatatattatctacgtaatattgaatggttttaatctattgtaataagactttaatatttcacatctgcctcaaaattgtgaccatagtgaactttacaaaattttaagcggttgattaacaaaaataatcaggggatgaagtgagcgtagctcaactagctaagtttctcatggtagaacctttgttcacctgaaatttaagtctcagacttgacacgggtgatcaaatttacagctaattattcttttagtgttagacgatatatatatatccatcgataacgatgtgtctatggtgacttcgttaacctcaagatgtattggctcagtttttccaaggtgtttataaaggtagaatgtgcgtgtatatgttcttaggggtgagagtgtgagcgtttgcgtttatattgtgtttctaaaaaaaatca

SEQ ID NO: 32216 - DNA, 1501 bp, Oryza sativa
cgatggccgacggcggccaggagcggcggcgggcagcggattcgtgcgcacaaccctgtggaggtgcccctcgcccgcccggcataatctggaggcggcgcccctctcccgcatggatccggcggtgggcggcggtgacggggccaggagcggcggaaggcaacggcaaacaacgacaatgacagcggtgaccatgaggtgggcggcggctagggttaggttcttgattttatttttttgcattttttttgtgcgtgcaggcgacataagccaaccgcacgcgaaaatctgatattttcgcgtgcgggtgcgtcacccacatgaaaattttcgtattttcgcagacaccccattgtagacgggcatgagatccgcacgcgaaaatccctttcgaccacacacaaaaatcgttttcgtattagtgatggaaactaattaagatgaggattggtcatccctgatcagtacaattatctcattgttcacgcacgcaagtaaaaagctggacctgcaaatgccatcctggcatcctaccatctgttaactctaaacctatccaaacgtgtccagggacctaatgatggtgacataatgtcccagccctcgaacgatctactagcgtatgcaagccattttgaagcatacaatgatcagggcgcctccactatttgtcttgctggtctagagcactcgataccgagatgttatgctctggcttgaattgaggatgccttattgccttccttcactgcgtgatggaatgttcaggaaggttgccatgtacgtaaaatcaggcctagaataacgtgcagactctccaggctggtgttggtatcctggtgacttccattccaattggctaccatcatattttctaggcaactccgccgatttctctaattgctgctggacttcctctctttttagcccatatagtcgcagaggatagctggctcaggttttgtgccttctactcatttaacctcactggatttttcacattttggtccttttgaaaaacttatttcgcaaatagacccttggaaaaacttatcccagaaatggtcctttttggggccagagtggctggcgccgtcgtccaacttgacggcgctagcctctttggcgccgtccccctgccgacgtggcggggcgatgctaaggtggctagggggagcgcgtcagaatggctagcgccgtccccccccccccccgaaattttttatttttcttttatttgtttaatatttttttcattcttagggacacacaagaaccaaccatagaaaaaatgaacccaaatggacgtaatatgtgacctgtaaaatttttcctctcctatcctctctttccgaactagtgcagaggagagagatgtgcaacttttttatttttattttatttttttgatatttttttcacacttaggaactcacaagaaccaaccatataaaaaataaacccaaacggatgaaatatgtggcatgtggaattttccaaa

SEQ ID NO: 32217 - DNA, 1501 bp, Oryza sativa
ttacatgtccatcagcggtggtgagctaggaatatttgccaccataagtgagacagctgagaaaaagggtttgtgaactcggattgccattcaaatggcaatctctagcgctgggatagaaattagaacacgtacagcctgctggactcaatgccacgaagcccaagttactgtctgtccatcctgccatgagatcgatccgccacgtgccggccaggggacggaccgggaacggcccccttcgggggccttcgccgggcgtcgaacaaccgactcagaactagtacggacaaggggaatccgactgtttaattaaaataaagcattgcgatggtcctcgcggatgctgacgcaatgtaatttatgcccagatctctgaatgtcaaagtgaagaaattcaaccaagtgcgggtaatcggcgggagtaactatgggcctgttcactttgatgccatttccaaccttaccaaattttggtaaagttgccaaaaaagtggctacatttagtttgctgccaaattgtggtaactatataagaaatcctaccaaaattatcaaaatttggtaaggttttttttggcatcaaagtgaacaggccctatgacactaattaatgacgcccatgaatggttaacgagattcccactgtccctgtctactatcccgcgaaaccacagcgaagataatgggcttggcggaatcagcgggaaaagaagaccctgttgagcttgactctagtccgactttgtgaaatgacttgagaggtgtaggataagtggaagctctcgggcggaagacattgtcaggtggggagtttggcaggggcggcatatctgttaaaagataacgcaggtgccctaagatgagctcaacgagaatagaaatctcatgtggaataaaaggataaaagctcgtttgattctgatttctagtacgaatatgaaccgtgaaagcgtgacctgctatcacatgggtctagtgacatgttagacaagtccaaaatttgaatagagatcgcttgtgattgtaactcactaggacatcttatttattgtcattttcttttaataattaattacaggtagttaacatccaaactatcgtgaggtttaaagtgatcttactagtagtagtttccataattgtcccttcactcggacaaactgtacttttaagcctttttggacaagtttagataggagtggtcccatcgccttcggcgtgctttgccatcttggcatcactagtattttcttgttttgccatccactctgttcatgattcgtcccaatataaaggctgcgtttgggaggagtggttggcaacccctccgtccggcacgcaaaacgaagctcgttttattacatgattaatgttgtattaactaatttttaaaaagtagattaatatgattttttaagcaactgaaaagcgtgcgcgcggaaaacgagacaggtgggttgggaaaattggggaaagaacacagccaaagggtgggcta

SEQ ID NO: 32218 - DNA, 1501 bp, Oryza sativa
ctcatagatgtttagttccaatctcatgcagtgatggattttttttttaaggggacgggtagggagctcctacaatttcactatagaagaagggagatctgaggatgatgggtcccatggctacacccctagtccgactcctgcgaaatctggggcaggttctcacatttctccatggggagaacaccctccttgcgatttccagtactgcggcgaaatcggggatgaccgccaggaggaagaaaaagaaagggaaggttgtacaagtcgcccgcggcttttcagactatatagtgcaacttgtctccctagctctcttcttttctcagaactagtctgctggtcgactagaaaacacgtgttatatataagtccggatattcttccggttagttctgactcctctaataggtgtgttgcatgctacttaattacataatactgtgccatggtaaattaaaccggcaatactagtacacaaaataactaggagattttcagggattggatgaatcgagggcttttacttgcatgtgaactctgctggacaagagttaatttaattgttttgggatgatgtattagtcgatcctgtcagattaaatgggggaataatgaaggtgcacagtgattcgatggctagcttttctgagaattatggtgcaactgagccgttaatcctgtcaataagtttcgcattggtgagctgcatgcatcagccagttcaggggaaagtttaaaccaatggagaataacatagttcatttatactctaatagatgcaagcaggcaatgtatgcgtaagcttttttaagatgttaacttttgtaaaaaatataacggaacctttattgatcattgttggagatagatcgtagccagtagcccaccctttggctgtgttctttccccaattttcccaacccacctgtctcgttttccgcgcgcacgcttttcagttgcttaaaaaatcatattaatctactttttaaaaattagttaatacaacattaatcatgtaataaaacgagcttcgttttgcgtgccggacggaggggttgccaaccactcctcccaaacgcagcctttatattgggacgaatcatgaacagagtggatggcaaaacaagaaaatactagtgatgccaagatggcaaagcacgccgaaggcgatgggaccactcctatctaaacttgtccaaaaaggcttaaaagtacagtttgtccgagtgaagggacaattatggaaactactactagtaagatcactttaaacctcacgatagtttggatgttaactacctgtaattaattattaaaagaaaatgacaataaataagatgtcctagtgagttacaatcacaagcgatctctattcaaattttggacttgtctaacatgtcactagacccatgtgatagcaggtcacgctttcacggttcatattcgtactagaaatcagaatcaaacgagcttttatccttttattccacatgagatt

SEQ ID NO: 32219 - DNA, 1501 bp, Oryza sativa
gcggcggaacaaaagggcctaacacacggacggctgctgaagactgcctcctctactcctcgtcggcctggctgcctcctgtggtcggctcctcagtcgaagaaacgtcgatcggttgacgcgaagggaccggcggaacctgtcgagggccggcagcagcacgggccgctggcggtgggggagctgggtagtggaatcggaacacggtagaagaaccaacaacacgcttccgcgcagtgcggataaagcgtgggccacggcgggaggaagcaactagggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtgatagaggcgacctgagtcccaagagatagtgtcaactgaggtgacaccctcctcggccagacgggcctccaaggcggcgtagcggagggcaagggagcggtaagcctcaaggagtaggtcgtgctgagtggcctgagcctccgaaagctcaaccatgcgagtcagcactggctgagactcgctgtacggacaagggtacctggcgtctgcgtggccagaaggaaggcgtggaagctgccggaaggcggagcccccgagacggtggctgtagttgtgggccaggcgacgaagcgcagtccaggagaggtcctggtacgcgatctggagagtgggcctggccacagtgaagtggtgtgggcgaaggccagctctgtgtatacctccacaagggtaaaggtacatagagagctcacagtgagggggaacacggtccacggagtaccccgtgtactcgggacacgagaagccaaggaaacgggcgaggtcacgaagctgagcgacgtggtgaccctcaccaaaaccgtgggaactgaagctggcgttcactgccatctacaattttgaaagagggagaaagatcagtaaccattttagaaacaaactattgaaaataaagaaaacaaaagaatccttagcttttcgcaagtagttttgaatttagtatccttagggtcgtcctaaacgtcgggtttcgccctagggccaagcctgtgctctgataccatctcttatcacgccccgaactaatcccgaccggaactagcccgtgacgctccaaattaacctgttgatcgataccagtcccaggaaacagtgctggtatcacagggagacagaatatcacagcaacaacggtctctttattatagagtagagatacagtcatgttgggctacggatagatcccgagctcacaactgcattacaaaaaggaaacggaagccaggactaggaccaaccaacacaggcgtgacttgggaactaggccgaaaccctaaaactcatcgtagccggcttgctcctggaagaactcctcatcagcaggatccgcttcatcttcttcagcaactagggggg

SEQ ID NO: 32220 - DNA, 604 bp, Oryza sativa
catgcaaatatcttgcccaaaatttcctcttcttttattgaattcggtaaaagaaatgttcaaatttagtcaaaattttgcaaaattttaaagtactttggtgcagtaaagttccaaaaattttgaaaatattggtgaaaaatcagaactttcagaacatttgtgaaaaataaaagtgtaaacctccatgatacactgtatcgacatagaatttagtcaagcgatccgcgtgtgagcttggaacgcagctgatgtcactctaaattttttggtacagtctattcctatactccatccattccgtaaaggccaatctgaaatataatatgacatttttctagtagaatgaatctgaacataccatgtctagatcttcattacactagaaaacatcacatgttatccttggttggttttcatgtgaccgagtgagtactccactactttgccacatggctactcatgtttgcttcattgcttgtaataacatggatagtacatctacaactaccacatcgtcaaagatagtcagacagacagtctaaacatgataatggcattgatcgtgataaaactgatgattcggtcgacttctgccattagt

SEQ ID NO: 32221 - DNA, 1501 bp, Oryza sativa
aagctaaggattcttttgttttctttattttcaatagtttgtttctaaaatggttactgatctttctccctctttcaaaattgtagatggcagtgaacgccagcttcagttcccacggttttggtgagggtcaccacgtcgctcagcttcgtgacctcgcccgtttccttggcttctcgtgtcccgagtacacggggtactccgtggaccgtgttccccctcactgtgagctctctatgtacctttacccttgtggaggtatacacagagctggccttcgcccacaccacttcactgtggccaggcccactctccagatcgcgtaccaggacctctcctggactgcgcttcgtcgcctggcccacaactacagccaccgtctcgggggctccgccttccggcagcttccacgccttccttctggccacgcagacgccaggtacccttgtccgtacagcgagtctcagccagtgctgactcgcatggttgagctttcggaggctcaggccactcagcacgacctactccttgaggcttaccgctcccttgccctccgctacgccgccttggaggcccgtctggccgaggagggtgtcacctcagttgacactatctcttgggactcaggtcgcctctatcacgccagccacctgtcctcccacagctcccgcggctctgcccgcactcccagtggcccgcgctcccccagctcgcgtgcgccgtactcaccagtgtactccccctacccacacccagttagcccttcctacacccccggacacaccctagttgcttcctcccgccgtggcccacgctttatccgcactgcgcggaagcgtgttgttggttcttctaccgtgttccgattccactacccagctcccccaccgccagcggcccgtgctgctgccggccctcgacaggttccgccggtcccttcgcgtcaaccgatcgacgtttcttcgactgaggagccgaccacaggaggcagccaggccgacgaggagtagaggaggcagtcttcagcagccgtccgtgtgttaggcccttttgttccgccgccaactcttttggagtcgtggcgaggtagtgcgtgcgtgtgtttgatgtgggtgttgattggtagtctggttctcctaggtggtgtgcgcacagtcaagctcagcgtagctctgtgacttgtccacacccgttgtatcaggtgtttttatgatttgaaaaatccagtttatgcctagtgtgtgctatctgacttgctatttactttgctccttgccctcctaagtgcttgtctgactcttacctcgccctcttctgggagtttagatggctagccgcccccgccgtgcagctcgtgcaccagcccgcttcggttttgaagaaggtagagttgagccagaagaaaatcatgagtcagctaatgagcagtctcaccacagcaaccgttcgcaccgtactgcttcccgcaacgcagaagttgagcaaccccgccgcagcaacc

SEQ ID NO: 32222 - DNA, 374 bp, Oryza sativa
ccagcccccagccctcattcttctctcctcaattccagtgaaaaaaaaaagaagagaggggaggagaagagaagaaggggcgaagccctgccggattcagacgctaatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaattcattaccgttgcattggcttacacaagaagatattacgttgtagatgtttattgcatgaaagagtaatatgatctagttatttcgttgacagata

SEQ ID NO: 32223 - DNA, 1501 bp, Oryza sativa
ttacaggcagtcctcccggaccagcatattacaatgtattagagtcacaatgactcgttgtcggacaccgccggctgtcgctccctctcgctatgctaagtcgccatatggttataacaagtccacccctatatttaagagatattctaagatggagtccgctctttctctagtcctactacctgttacaactctaggtgctaaattgtaaccgactttgtatacatattcgacacaaactctagcatagattcgtgagagggttgcacgacaacaggatgatataaattgcttgatgaattagtagatattcaaccaatgtatactgcaacacttgcctggcttctcggaatggaaggcatctgggatttgagatgcagtacacaactcttccatcaaccatcaacctgagcagcggcagcttgtacccatcactatgtaagaagagctaaccaaaaatatggtcttcctcttcgtccatcagatcaagagcttgaaacatgagtgagtccaccctctcgttatctctctataccaccagaagctgaggtgagaaagctgcagacggaaaactgcatgaagtgtggcacaaagtggataattagaccaaaatttacatgtaatggttgatggtctcagcttctttcgacgaactcttaggctatgcaaaaaatgactaacgatcgttagcaatattgagcagaccactagggccaatccatttcacgatctcctcaactgttattatgcacgcctggtagttttttttaaaataaaaatgaaccacacgtgatggtgcaatgtgtcatattgatatagcagaaaaaattataagactgtgacacatcgcccattgcgagagatggacaaaaatatggcattccacgacgctcgaaaccatccaatttgtttacgagggagagggcaagagagaaggatatatccacaccccgtgtgtagtcctgccagcgtggtttgtggtggatagaaaagcaccaccgcaggagttaacagactgctagagaagaggtttgtgggggaggaccttcaaacgacacctccaaccaggatgtgacgctgaaggcactgccgttgtctaaatagaagccaggacaaagttttctctacaacgatttctcggaagggaagaagacaccacgatgacgcctccaaggaggttgcagcgcctgaaagtgctgcccctgctggccctgaaacggactaggccttcgcccggagaaactcatgccctcccgtgcaacatccacatcgcccccaacagccaccactatccaagactagtttgacgtgtgttaccattgcaccagcaccacaccactaactggccaccatgctggaggttcctttctgaggaagggccggtgtccggcacgccatcactgtagcactgccattccccaccaccacctacaccggagcccggagccatcgccatagaggaaagttgccacaatcaacaccacacaagtgagcactacag

SEQ ID NO: 32224 - DNA, 213 bp, Oryza sativa
tttgatcgctatcagataacaattgttaattattttaacactagtgtagccttgtaggttgttgtgatgatttctggaaggtaggaagaaatagagtgtctgcactgcagaacaacaactcgaagttcattagtcctggactgcttcagcaacaagttgcaagatggacagcaccttcaacagctgatgatttatttgggtcaccagagaaca

SEQ ID NO: 32225 - DNA, 1501 bp, Oryza sativa
tttataagtcaaaagtttatatatccgattcaaatttgaatttgaattcaaatattttatatatatatatagtatttctatacatctaaagtttatacacataaagtttatatacctaaagtttataagtcaaaagtttatatatccaatttaaatttgaatttgaattcaaatatccgattcaaatttgaatttaaattcaaatatttttcatatatagtatttctatacatctaaagtttatacacctaaagtttatatacccgattcaaatttgaatttgaattatattcaaattcaaatttgaatttggatttgaattcaaatattttctatatatattatttctatacatctaaagtttatacacctaaaatgtatagatccaaagtttataagtcaaaagtttacatgcccaattcaaatttgaatttgaattcaaattttttataaatagtatttctatacataaatttttctaacttttgttttttaaaaagttttgtgtggtgtactgtagtagaaagagaagaaggggaggaggaaggggggagaggagggaggagtatatagtataggagagaggcaggggagtgatcgctgggtggatggaggagcgatcacccacccaataggaattccggaatattgtatcatttcgcgccattattttaagaaagggaaagaggatgaggaatctgtcggaactacggagcatgcacggccggcaatctcgttcacacgctgctgaaaattgaggccatgttcatacccatgcacacgcctgactactgctggaccctcctggtgccatgtccgtgcattcacagcagtgtttgttattcagtgtgtgtgtttttctcctgcaggatgaatgcaacagctagctgcatagctgtattgccccttttttttctattaagatacatattttactcgtggtttccattagtatacttttcaaaatgctaaacaatacatttttttgcaaaaaaaaagaaatatatatataaattactataaaatatcagataaatccattttttaagttcaaaataatttaaacttaatcaagctaatgattttctcattttacatgttttacacttaatcttcatgtacaatgaactcaaacaaagccagtgttgtcgttgtatgaaaatcagcctcaccaattgatttcatgagaaaaaaaatggagcaacaaatttggcaggagtagcaatgtatcatgtcgtagtctggaaattttctccgataaaaacgccagagactgttgtcggcatgataaaaatctgtataaaatttatgggccgaaattgccctcagcatcacaagcatccggcccatccggataatcttggcccactagcccagcccatgccaccgctacgttaccttctcctctcgtgctctttctccgcccaataaatagcccacgacccaaccactccggcgaggctgagctgaccaccaccggagatggcactcgcagcgcctc

SEQ ID NO: 32226 - DNA, 1501 bp, Oryza sativa
gaaataaactgaatttcttcactgagtttcttcttcagtgtgtttttcttgttcccttttccttctctgtttcctataccaaaattctccttctccccaaaatagaacaagatatcaataatactgctaataattcaccccaaattacaacgagttatccataatactgctactagtcaccagctcgggtcataacaattactacctccatattttaatgtatgacgctgttgactttttgtctaacatttgaccattcgtcttatttaaaaaatttatgtaattattatttattttattgtgacttgattcatcatcaaatattctttaagcatgacataaatatttttatattttcacaaaaattttgaataaaacgaatggttaaacgttagtcaaaaagtcaacgatgtcatacattaaaatacgaaaagagtacgagcaatcggtctctcacgagttcgggtcataacagataatcatcatgacgacagtatccttgaagtggaggcaaaataaaaaaaaaaaatggcggtcgattaggttacctggagcttcagggtcaaagcaatcgggggagaggtcggcgggtccgggggagtggtcgccggggatcatcgcgatgccgcgccggaggatgacgagtgggcccgacggggcgtgtggcagctgaggccgcgtccaggcggcggcggtgcaggtggtgtcgccggcgtagccacaccgaggagcaaagcggcccatgtacgaagccacatgacgggcggcggcggccatggcaggttgatcggatgtgaggaggtccggtactcgattccgatctagggtttcaactttgcaattcgttggactaattatccttgcttgtgttttcagttgagtatgtccctgtggcaatgacacgtttagcaagtccttggagcgtgatgacccacaaccaataatcttcttgatcaaaactcaacgaatggttcaatgattcaatcagacattagtcaatttgttgatctcaataaaagaatataaggttattatcgacaatgaaagacaccgccgacaaaatatccggtggcatcggtttagtgattttatcattttcagaaaaaataacaagctcaaaattattattttttgaatacactcacccttatgaatagacacacaacttactcctataaacatctacgaaggacttagtcggtatatcataaaattaatgaagtcaccacggccacgggcgcctcactgtcgacgtatacatcgtctaccactgagagaataattagcctaaatacaaaactcggattaaattgacctaacagaagtgatgaaagtgcattgtaaaataccaaaaatttgtatactgacatattagggtttaacggatattgagtggcaaataagggaatttcaatatatatattcccctgattttttttagaaacacaatataaacgcaaacgctcacactctcacccctaagaacatatacacgcacatt

SEQ ID NO: 32227 - DNA, 1501 bp, Oryza sativa
ccaaaatcctcaggatgctccgatgagtcatccttatcctcaagtgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatcattcttcccctttcgcccttgtccctcgggcttcttggtcgtcttgtcactcttcttcttcaacttgggacaattcactcttatgtggttaggctctccacactcaaaacacacaaatggttcattggtttttcctctctttttatttctcacatttttgtaagctcttgagaattttctagcaaaaagagcaagatcatcttcagggatcttctctaattgctcctcagtgactgagtgtaaagcggcaagagagaagccaccacacacaaaagctgagtcattagaagaagtactaccagagggatcagctaccaaagccatggagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatgacgagcattatcattatcagaaaactcttttccaacagatcttaacttcgaaacaatttctccaaaacgcttgaaataagaatcaatggactctcctgggtgcatctcaaatctttgatattctttatgaaattgattctgacgaaccaattgaatatcattgtttccctcatggaaattgcacagagcagtccacatgtcatgagcagacttgtggtgttgaacacgattaaattcaccagaagaaattccaccaatgattgcatttcttgcacgataattaaaatcaacctgagccatatttgcaggcgtgatgtcagcatcatcgggcacagtgtaaggtgatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgataccaattgaaagacaaagaacagctatagaggggggggtgaatatagcaattcaaatcttgcccccgaaaatactcatcaagccggatttctcaaaatccttactagaaccgcggctattagagaagccggatctagaaaagaagagagcaaaagaagagagaaggaattcccgaaactagaggaggaagagaaaaggaattcccgaaactagaagagaggtgaggaagagagagcaaaactcatcatcgcaaagttcaaattgcaagcggaatttaaatggacaaggcaaaaat

SEQ ID NO: 32228 - DNA, 1501 bp, Oryza sativa; identical to SEQ ID NO: 32003

SEQ ID NO: 32229 - DNA, 287 bp, Oryza sativa
tgcaagtagttcatcaaaccacattaaactgagttcaaatgaattagttatgaatttttaaagattaaatcggattaaaacacttatatggattttaattgaattatgacgcaataatgaattatttttgaaaaggaaaaggaggattattgcgtcagcggctagggtttgcggtggaccgggtgcacgacgacggttcacgggaacggacggccgagatcaaccctatccaaaacggacggccgagatcgatcgggtccacggcggctcacgggagacagcgacga

SEQ ID NO: 32230 - DNA, 368 bp, Oryza sativa
agcccccagccctcattcctcccccctcaattccagtgaaaaaaaagagaggggaggagaagagaagaaggggcgaagccctgccggattcagacgccgatttcaggtaatattcatagatcctatatgtgactattgagttaaatagtgtgtattttttaaaatttggtttgaataaatgcattatatttgtagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatat

SEQ ID NO: 32231 - DNA, 1501 bp, Oryza sativa; identical to SEQ ID NO: 32004

SEQ ID NO: 32232 - DNA, 214 bp, Oryza sativa
tgttagtgccaaatggccaaatatgccaaagtcctttggtggacataccgccgcgttgagcagggctcaactgtcattttacatccgccgccggcgctcttcttctctcctctctccactctcaatcgcggttccctatgcgcgtcaaatcgccattgtttctctccaatgcctgagttaattcgccccaatacataagcaagtcactcgaaaa

SEQ ID NO: 32233 - DNA, 830 bp, Oryza sativa
taatgatagttcacgatggtcaatcgtgattggttaattaattacttgccaactaaaacttgataatagtgggttgtgagcacatggttttgagagtcgtgcttatgacaattaaggaccggttcgcgagctactattgtgaaacattaatcgtgccaaccacaagccagcgtgggcaacggctttaccttttgtataacatgattcattgcggagcaccagactgagaagtggcggagataagcccacgggggtcacttgggagtccatgccttgttttataaaggggtgattatgatccaggaatggtgcactgtggtgagttgtgttgtgcagagggtattgtcacagcctctattcgggtactttccagtatcgcgacgtatggtagacatgatgttgaggctgtgtcttgtgggtacagtggtacacctctggccagagtaaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaataatcaatcaacctca

SEQ ID NO: 32234 - DNA, 1501 bp, Oryza sativa
acaagccagcgtgggcaacggctttaccttttgtataacatgattcattgcggagcaccagactgagaagtggcggagataagcccacgggggtcacttgggagtccatgccttgttttataaaggggtgattatgatccaggaatggtgcactgtggtgagttgtgttgtgcagagggtattgtcacagcctctattcgggtactttccagtatcgcgacgtatggtagacatgatgttgaggctgtgtcttgtgggtacagtggtacacctctggccagagtaaaaactattcgaatagccgtgcccgcggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaataatcaatcaacctcagttgaagacaagttgcgaaggagaagacgtttggcttataccccagttgagctgcctgtgggagtggagccggagctgcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaagttggtatcagagccatctcgactgtaggataagccaaatggtcaaaccttaaggactaattttccgaaaacatgatttgtgaaagtttctcctttcttccttatctagaattctttgcaaattgtttcattgtctacttccctctctctttcaacttgagtagttctgaaactagttgttgaaacttgaagacgccaatgtggtctacttatggaggttaagtcaagtggatcgatgaataagaaggtgatggtcgatctgaagtgcccagatgtcaagatggaatgaagtttggatcctaccttagaacctatgccgccaatctatccttgaagaatagttagtagggaagagcgtttgttgtttgctttgtttgtaggtatggttgcattcccatcattggagtagttcattgatgagtgtgtaactatactaggttgcttgcttaatcaacttgaacaatataatggtctacgcacaccagatcagtggtaacctggttaaggtcttgtctttagtgtaacctctctccttctatcttctctaatatgcaataga

SEQ ID NO: 32235 - DNA, 1501 bp, Oryza sativa
ggcagtttgtgctgatctgaataattcagttgacatgacatgagagaagcagtacagacatggtgaaggttttccttcctccggtaccagtgcactttgatggtgttgcccccttcgtcttcctcgaagccgacgtgcagcggctggtgcacgtcgccgacgaagtgggccaggaacatcaggctctccgtcaggttgtctggtttatcaatcagtgcatgtgtatggatgttcagagatcatcggatcagtgtcctgcctgctgaatcagagcactatttggcactgtgttttgcagataagcttacatgaactctttgaatcgccatagctgtagagctgatcggtgtagttgttgatagccccgacaacgcacatcccttgctggtgacgagaattatggcagtcccctggataattgagagccacaagcagattactccatgatgaaagtaaagctcatgtttcagaaatcagagaaatgtttgtgccttagctctactcatctctgctatcatctaatcagagtggcagatttcaccatggaatgctgaattattaatgtatacctcagttaaggtcagctgctccaattagcaaactttatcattccattgaagaccacaaacaacatatccagtggttaggattatctctgaactatactagtaataattaacaacaggtctgtgtgggcacatgtgtgactgtctctgtcagactgtcagcggcacattcctggtcccataagaacgtgctaacaaagtttggaagatatttctcgagatattaagaacgagaagaagcagagaacacgcaattattataatcaagtcgtcagattcctgttgttagtatgtccttttttttcttccttggagtctaaacattcattttacatgcacaattacgacagatgtctggtttttatggtgaaagctactgattgaatgcaacatgaattcgttgtggtttggaacaaggaaattagtggatcgaatcattggtgatgccgtgagactctgaatctgtctgtgatgagagtttgagttgtgtatctttactcaacctctttctctgattgtttgtcctccccaacaagcaacagtacgtgccggtataatttggatattcgatagggaataattcagaatgggctaatggcatctacgctgacgtacttgctgctcatactgttactgatttttttttcgctagcgcaaaaggattgcacgttaatatataagaagaaaaaaagtttttattacacaacgtaatcaccagaccggcttatgccaagggaagggagaaaaagcaaaacaaaaattgaagcaaggaaggctaattaaactactacggcggctaaacataactcctaacagagcgagaagggcagagccactctacactcaagaaaaacccaaaaacgttactgctactactccatccgtttcatattgtaaaattttttagtattgctaacatttatatagatattagt

SEQ ID NO: 32236 - DNA, 328 bp, Oryza sativa
tggatcatgaatattcttgctgcttgctaggtcatgaatcctcgtgctactgtatttcattttcatctccaaaaacaattctactcttcattagtcattaccatgcttcgatcacacatcactaatctgctgcagtgctaagccagtttcacgagttttgtttgcattgtttgaatgaactagtagagtgtcatacaaagaggtcaaattctatgttatgttgttttttctgctcaaacactgttatattttattgacatccctatgtgctacaacattgagtgcctgctttatgatttgcaatttgttgtgtaatcatttatagata

SEQ ID NO: 32237 - DNA, 1501 bp, Oryza sativa
caaatttgttgctccattttttttctcatgaaatcaattggtgaggctgattttcatacaacgacaacactggctttgtttgagttcattgtacatgaagattaagtgtaaaacatgtaaaatgagaaaatcattagcttgattaagtttaaattattttgaacttaaaaaatggatttatctgatattttatagtaatttatatatatatttctttttttttgcaaaaaaatgtattgtttagcattttgaaaagtatactaatggaaaccacgagtaaaatatgtatcttaatagaaaaaaaaggggcaatacagctatgcagctagctgttgcattcatcctgcaggagaaaaacacacacactgaataacaaacactgctgtgaatgcacggacatggcaccaggagggtccagcagtagtcaggcgtgtgcatgggtatgaacatggcctcaattttcagcagcgtgtgaacgagattgccggccgtgcatgctccgtagttccgacagattcctcatcctctttccctttcttaaaataatggcgcgaaatgatacaatattccggaattcctattgggtgggtgatcgctcctccatccacccagcgatcactcccctgcctctctcctatactatatactcctccctcctctccccccttcctcctccccttcttctctttctactacagtacaccacacaaaactttttaaaaaacaaaagttagaaaaatttatgtatagaaatactatttataaaaaatttgaattcaaattcaaatttgaattgggcatgtaaacttttgacttataaactttggatctatacattttaggtgtataaactttagatgtatagaaataatatatatagaaaatatttgaattcaaatccaaattcaaatttgaatttgaatataattcaaattcaaatttgaatcgggtatataaactttaggtgtataaactttagatgtatagaaatactatatatgaaaaatatttgaatttaaattcaaatttgaatcggatatttgaattcaaattcaaatttaaattggatatataaacttttgacttataaactttaggtatataaactttatgtgtataaactttagatgtatagaaatactatatatatatataaaatatttgaattcaaattcaaatttgaatcggatatataaacttttgacttataaacttttggtctctaaactttagatgtgtaaactttaggtgtataaactttaaatgcataaatttactaaagtaggaaagtaatgaggtgccaaaaaaggaaacaggtggagggagggagggggggcggggggcgacccgatcgctaccaggtaggtaggaactaccccactattcccgcttaaaaaccccatcaccgaggcactgatactgatcgatcgtctagctagcttcttctacctcgcatccgatcaggaattcaggatgcagcagtcgatcatgtcgacgctgc

SEQ ID NO: 32238 - DNA, 211 bp, Oryza sativa
taaaactttgtaaatgattcacacaatacaagtggactattcatgatcaaatatagatgaggaatctttatagatcatcttttttgacaaacctctctaaaacgcatataataaaattacacttcatggcacgggaaaaaaagggagaaaaaacctcgcttgattggccctcctgggcttcttcctatttctcttctcttaactcttaagt

SEQ ID NO: 32239 - DNA, 568 bp, Oryza sativa
tattttaggttcttctccctctgccatccttatttgatgatgtctttcccttaagtctaatttagagaaccgttgggatccagccaactcacccagcaactcttcaataatgggcactgggtacttgccttttatggtgattgcattcagttgcctatagtcaatgcataatctctatttcagctacttgtttttcaaactcatttttaagggctggtttatgcctatagggtcttaaattcactggtttgtctccttcaatcaggggaatatggtgatcacaagctcttggaggaggtaatccagcgtgggttcttcgaacagctcctggaattcctgcacaattggttgaacagattctgagattttaggtttaatttactccttagctggttacaattgtatcacacatacaacactgttttagccattccattaagctggtgaagtgaggttgcttcacacaaatccagtttgggtattaagccttgtagccttatcaattattattattattactattataattatttttgtgcctgacatgtgggtcccactaacacgtagg

SEQ ID NO: 32240 - DNA, 1501 bp, Oryza sativa
cctcctctctctatggcgtgcaagggtggatccaccgctcccaaggccactggaggcggatccgcccttcctaagctcttcggctgtggatccgccgctgatacggttgccattgccgtctgaggccattgacaccgccgcaccgccacatagagagagtgtgggagagagtagagggtggggaagatatggggcacggggatggggggagagagtagggtgggggtattgaggggaccgtgggagagagcatgttggcggagtgatgagtggcagagagagaaaggagggagtgtgattgaaatggtgagttgtggaagtgtgggcacacggttttggggggaaaataatgaagggtggacggccgttacgctccactgacaaaaaatcattttggcaggttgtcgaaacaagatttcggcaatactaaaagggatggctatcaagctggaaaagtggatgggtttagagacaaggaatttttatacaggttcaggccttctaaattaagaagtaataccctactcctgttcggagattgtccgccgagtgtattattgatcgtatgatctgggagaaaatcgtgcccctagaggcacccagacccctccttgtatagcggaagtggtccgtattacaaaatacagtctatatccctaatggaatatgtagttacagataaaatacaatcgtaaccgactaggatctcagatatttccttgacatacaagtttagattttaacccaagtcctctttaagatattctatctatacatggcaccccatacccagttggactatacatgccgtgtaggtatggggtatccataatctccacagtagcccctgaaacctttaaagtcgacgagataaccttctctcagaacgtaaaatgataatccgagtgcttcaatttcttctgtattgatctcccgagtaccaaaattaaagactgtgaagggctgaaaatagaaaaaatcgggtgcatcgacaagatgcacctaattaggtgtagcccccgactatgttattagttaaaaactaaacatatagtcaaggtgtcaataacatccatccaactgctttagccgtaatataccaaaaatgaagatataaagaggcccgagtagaaaatactctaacggtccatagatcaacacataagacaaaaatccgagtaaaaactcaaaaagatccatcaaatgtggtataaatgtgatatcatgaaaattgacgagtctaaatagcctagactataactcacgccataatcaaaataagcatataacatgccgagagaataactattcaaaaaccagtcatctcaataaaacccgaacagcttttgcagcctaaaaagacttacaaaactagtataacacttttctgttgggcacctttttatttgcatcgtagtaattccaaagaattatctaactgcgtcaaaaaggattttaacagcattaggctaaactgtcgtgagcaagtgtttttccatgg

SEQ ID NO: 32241 - DNA, 1501 bp, Oryza sativa
atggtaaataaaatcgatcggccataaatgacacaagaaaagtaaaccagattttcgaggactatgtgaatgaaatataatgtcagctattaaagactttaacgtccatgtgggctctgctttaaatattttcataataatacatctatactagaagcactgtcatgttatatgcgcaagtttaatagttgagctaactatcggctataagctcatctaatactagaagagtaccgcgtggatcgctgcagaagtatgtgacaaaataacagatatgagttgtaaagttttatatcgtactatacgatttttctttatatgcttatatatttagtaacttgatcattattcaaatgattagttgtatagtgtagcttttgagggataaaagatataatttgtacccttgatgaataatgcaaaggctaaaaataattgagatggtgtggcttcacgagagaaaagaaaattaacattaattacatttagtagagacaaactttataaatatataggattagcacaataaacatgtatagtggattagttataatgtcatctctactttttttcgcttatcaatttaatgtatttctcttgagcatgtacaaaggactcttggataagagctagcagtatttgctctaaggaggatatgccacaaggagatatgggaaagcgctttcaggagattcataactagaaataatgaaatgtgccactgaacttgttaatttcgatatttcattaacgttccctgttctcacaaattagaaactttcaactaagagcttttttacggtcctgcagggaggcacggtaccttgtggtacgaaatctgggccgtccattcgagaggatcgaatggtctgtaaatgagggtaccgcgaggtaccgtggttgattgtgagccgtaccacgagttggtggagacgtggaagggcaaatgcgtaacttcgcatatcatgagagatcgattcggtttgaggcaggagaaatcctagggctctctttctgatccgatctgaagccgagcgttgcagcagcgattcgttttgttcttggcgcaggttgtccggcaaagccaagggcggtgtgcttggcggagcttctccggcgaagtccagggcgacgccggtggcacggcgaagggagagacgacggtgccgtggcgcggcgcaacgaagatagagagacgccggcgccgtgcaaggcgatgcgaagacggagaggacgctggcgccatgcaaggcaattcgaaagagacgagatgaggatgagctgcggggaaggaacggagaggataaacccttgcggcgccgctcgattttcgtcctccaaccacgcgcgcaacacatttcccatcttgcccaccgattgaattcgctctggtaccgtgcggtaccagtaccgagcggtactttctgccggaccatagcaacgctcttcaactaaatactactactctatacaatcagtacttgtttctaagatgacaaaa

SEQ ID NO: 32242 - DNA, 1501 bp, Oryza sativa
taaacttgtatgtcaaggaaatatctgagatcctagtcggttacgattgtattttatctgtaactacatattccattagggatatagactgtattttgtaatacggaccacttccgctatacaaggaggggtctgggtgcctctaggggcacgattttctcccagatcatacgatcaataatacactcggcggacaatctccgaacaggagtagggtattacttcttaatttagaaggcctgaacctgtataaaaattccttgtctctaaacccatccacttttccagcttgatagccatcccttttagtattgccgaaatcttgtttcgacaacctgccaaaatgattttttgtcagtggagcgtaacggccgtccacccttcattattttccccccaaaaccgtgtgcccacacttccacaactcaccatttcaatcacactccctcctttctctctctgccactcatcactccgccaacatgctctctcccacggtcccctcaatacccccaccctactctctccccccatccccgtgccccatatcttccccaccctctactctctcccacactctctctatgtggcggtgcggcggtgtcaatggcctcagacggcaatggcaaccgtatcagcggcggatccacagccgaagagcttaggaagggcggatccgcctccagtggccttgggagcggtggatccacccttgcacgccatagagagaggaggtggaaaggtggtgcggcaatcacggcaatggtggcggctggctcataggctacggtggcggcacccaacaactgcgtgcgacctagggtattagacttattctatttttttctaaaaaaaatgttgcaagcggcttccttaggatgcctgtctacaaaaatggtttttcacatgcagttgtgatgcccccactcaaaaaataccaatttttgcagacatctggctctagacgtgtgctcctcctgcctgcggaaacaggttggccgcatgcaaagatcattttcgtagtagtgatattacatttcgttcaaataggacttcaaaatctactatgtcttccgtttaccattatttatacccggtttcattcaccattccgcaacgagcaacaatggaacgtacgctcttgcatataccttcttggaatggtaggcatgtgtgacttgagatgcactctggaggtctctggtctcgagccatcacccagtgtgggcagctcctgcatctggagattgagacgttggaacttcatgatctgtccagtatcaatctgtcattaccataagaacctaaccacgggatattctaatactctaataaggatagctcggactgctgctgacctggtgctgtagacctgcctcgaattgcagaaaaactggtttacattgaacatgggtgcaaggattaaattataaagtttgcattatctcggccaactccaatacgatgttaaaaaaagtttgttcatcattaatgattggac

SEQ ID NO: 32243 - DNA, 154 bp, Oryza sativa
tccctcgacaaggctaggaaacattaactcggcaatccctttttcaagaaaaaagaaacatgcatgtatggcaatgcatgctatggcaggcttaatgaactgctagtcacattgtctacttaatggcttaatgatgataaagttattgagagga

SEQ ID NO: 32244 - DNA, 1501 bp, Oryza sativa
caatggtagctgtgaactaagccgcatacttggaatggaccaagggtgtgccctggttaactctcttgaggccagtggtggattgagttgaaaactggagttacttgaggcatacccgctgacattctttcctttttctctgttaaacatctgttacagggattgaggtgagagagaaaacaagccaggaaagaatagaccagaactagagacaggaccttaaaggaactaactcttcttgctgatgtgttgtttgtttcacttattctgcaagttgattaagcaaacaacctagcatggtcacatcacagcccaccgatgcaaaccacacactacacacacaagcaaggaaacacacgacaaacgaaacactagagggtggcttaggttctgcgacgagttcccaagatcttcactccttcacagctggcttcactgcttcctccacttcgctagcggaccctgcggtcttccggaccttcggcgaacaattggcgacatcttcttcttcgcaaaactaaccaactagtactagttgaaatctgaagaaggaagaagggagtaaaccttttgcaaatagcacaggggaaaggaggaaaaagggactttcggaaatagttttatgtataaaatatgtccttaggttttatccacttggcttatcctacagtcgagatggctctgataccagcttgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcgagccacaccggcagatgcatgattaatgcaagggggtacaaggggtaataatatataggggttaagttttgcagaaaacagcatttaaaagtcacttagttgcccaaagccattttaaaaagacgatcctagagttacacagtattattaatcagggtcgtgaacccgcacgagcctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagc

SEQ ID NO: 32245 - DNA, 1501 bp, Oryza sativa
caaaaatttagtatgacgtatttgcaactactggtaaactcatattgtcacgttagcattatccgagacaaatctatgcttttcaggttaataagctaaatatttcagaaaacgtataataataacagttactccggtgattttggaaatttgactacggtgacgacttgttatcttgatcgaaatgagcgccgtatgaatcccttcttcggacttttgagtttacagagcagctgctgatggaagcaaacctgaggtaaatactgaggagctttgctctattggggatttgggggtggggtacatatccaaggaggtccagacaactggatttgatctatttctcctaaaatatactctctccggttccatattaattgatgttttggacaaggttgaggtcaaatttttataacttagactatcaataactttagaaatatttagtttaaagaaactataacaacatatatagatttgtcttttaaaatattataataaaagtaaacatagatttatttattatatatattataatagaaaaataaggtcaaagatgtatcttgtagaccgtgtcattgtccaaaacgtcaattaaaatgaaaccggagggagtaagttgtttgtgcttttattattattatttttaagaaaaagaagaaaatttatgctagccatggatttcagtctccttgctggataggataattgccagtggctgaaattacccagtcagaaagaaaataacttaccttatcttgtattgtcacaggctcagaatttatctatttccccccttgatagtaataataataccatctttggcagagaaacccagattcttaccttctgaagtcccctcattcctgatttggagtaaatatttgagtagcatctgaatgtgatgccctagctagtgaccatatattaacattcagttcttttagataatggattaaaacctggcctctatatccaaactcggatgtacatggccaaattaacatccagttcttcatccaccttcatatcagaacattccagaatacagattgcaatggcatccattggcaccacatgttttgactgattctttcactgtttcttgatatatttgttgatttttaatggtaaatagctcatctgtccaatcctggcaccacataatttcccctgttaaaacagtgccaacacaaatttactcatgtccactgaaaatccccagaggataacgttctggcactgccatatcaggaccggaccatacgcggcgcgccacgtggcgcgccggcggtcacacctgtgctggtgcaccctggcattatccccatccaccatcctgtgggtgactggccaccaaaggtttttggcgccacaattatattgagctgccattgcttctcacctctgctttgcatccatccatccatcagagatcaggtagaacagtgagagtgaggtgcagaaaaatttgagctgaagctgaggatggcaacatcca

SEQ ID NO: 32246 - DNA, 524 bp, Oryza sativa
actgtctgtggccgtcacccgggaggagccacgccggcacctgctgggaggaaggagtgaagggggagagggggatggagggggaggtctaaggaggagtgaggccttttttgcagccggatgtctttacattccacctgcaaaaattaattttcacatgcgtggtcttaagacgcccgcatataaaaataacccttattttgtaggcataccttttaaaaccatgtatgtgaaaatcgattttcgcagacaggactagttctattcaacctttagctatttttgtaaatggtgatttttgtagtccgtctggaaaaataaaatcatgatgttgggaaaaatagtttttctagtggtgtgattttggtttcacctgtgtggtaaatgcatgattaacatcttctagtcccacaagtcaaaaacccatgcagtgcacgagctagctactcctgaaccattgatctcatttgatcaagtgtttagatctatttatactaccacgctagttagcagtagcagaaaca

SEQ ID NO: 32247 - DNA, 284 bp, Oryza sativa
aataaagatgtgtcttttatatcatgtttgtatggtgtaccccggcttttcctgggacggggattaatacactagcgttcgggaaaatgcaattttctcggtcgcgacacccaacctgtcaaaaattttctcatctctgattgctttctagtccagaactctaaaatataggaactatctctttctaacatcttatgacaaaccatctccttaaacccattttcagcaagccaggctgactcgaacttaaagtaactacagcttctttccctttcctcatcagt

SEQ ID NO: 32248 - DNA, 1501 bp, Oryza sativa
ggaacggctcctgcggtcggtggagtcgaaggcgtcctcctgctcgtcaccaggtccctctgagcgactcctggagcctggcagataagtctcgccgctgcccgactctgagccactggagctgctgctgctgagatcgcggctgccactgggagtagcagacaaccaacctccgttgccactggctggacccctggcggctgatgctggagcgaaggagagagcggacgcgggagctggagctggagctgcaggaactgcgggcggaactggaggtgctgcgggagctgctgatggaggtgggttcctgggcgcaagctggatgcgcacgggtgccgtcgtcgtcttgcggggtgtggtgcggatccggactcctcctggcgcgggaagaccctttaactgagcattctccctcttcaggcgcgctatctcgtccatcagagcgacgatcctcatgagcttcccatcgttcaaggccttggtcgccttgtgcaggtccgagtgcatcctatccaatccactcatcacagcacacatgtgaccaaaggtggtgtcgttctggccggttgtcggacggaaggtgctgacatcatcaccactggctcgacgagggtgaaaacggtatgccatgtcatggaagatgtagttgtggcgctcccgtagtctggccatcatcaggtatgctgcctcctgacaggcgtgatctgctgtgcctccggacgcctcaaccaccatgttagctaggcaggtacccacgtagccatggacctccaagcgaacacggtgaggaagctcgccactgagcggtggaaccgtcgtctactctggcgcgttggggtagcccaccaccagcgtcatgcgtgccaactctgccacaaaatcaatcatgccttctccgcggtggttgggtgggtgtccggccatctagagaagacaaaggagtaggatcaatgcatgctcaaatccaaatttaaataaagcaataaaagactcaaataagagaatcgaataagagcgaaattttatgcatagatcattttgcatgagtgcgaataaataagacagactcacataacgataaaataatggggaaattagatacatactaataataacaataagagctgaaataccttgcaacccatgttcctgagctaggacctaatgcatttcacccatcaaatcccaactgactaacgaataaatctcaagagttttactaaaactctagattgactcgttttgacaaatctcacttaaacgagcgaccaagatttttcccttgaaccacaagaacggatcccaattttcccggaacaaatccaattgccaagaacatatgcaatgaaaaggattcagagggcttttaggtttttccatttggcttgtcctacggtcaaggtcggctctaataccaacttgtcacgcccagaaattcccgaatagaatttcaagcagaatgtgcattaaattccccgtccaggaccagccggggtacatg

SEQ ID NO: 32249 - DNA, 176 bp, Oryza sativa
aatatttggatcagcaaatgatttgatcattagttattctgtgcagagatgcttttccaactttacagcgaagcatataattaccaataatcccatttttacccttttgatttatcctagttttctcatcagttataaagacttatgaatttctttgtatttattttctctgcagg

SEQ ID NO: 32250 - DNA, 1501 bp, Oryza sativa
agaaggaaaggcgcggccgaatttggaaggagacggcggcggcttgcgctagggtttcgggcggcggcgacggcgcgaggaagacgaacctgacaggtgggacccacctgtcagcgacaccgagagagaaaaggaaggagcgcgggctgactgggccgactgggccggggagggagagagaaagagagaggggttttgggccgactttcggcccaaagccaaaataagacttttaaaaacctttttcaatttaaattattcatgaaatgcaattccatttattaaaaatacttccttagctcaaataaatcccagaagaatctaggaattatagaattaagcaaagtatttaataaaattttatctagcccaattttatattgagatttagcaaattaaaattagatcttctcttttaggcttttaaaatcatttctaataattccttttaaacaacaatttataatttaaggatttttaaaccagaaaagctcttaacaattataattagatcattaatgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcccttgtaaattaaagatcatttaatataaattctattaataatttattaaataatttataaatcctgaaacaaaaatcaggatgtgacagtacacaaacgacaatgttgacattcagatccacgtcttacaaacatcataaaagtcttacataaatgcagcggaagaaaagaaagacaacaggagctaagccttgactaaactgcagcgggaacaccactccacaggcatcctcgacggcacggacgaagcctactcctcagagaaaccttcatctgacccaaactcgaactctgggttgggaaaagtagagcaagactgagtactacccactgtactcagcaagtcataccggaataggggtatgatgcagggaattatcaaagaagagctagagcagttcatttgcataaagcgagcatttataaacagaagttgaaagattaaaccgttgtaataattaattaatatcaactatccactgcccaacgctaacccacgttgcgacaggcccaaccatccacctaaactatccaatttcaaaagattacactagggtgagactaatcacggtgaatctggttgaccgcccataaccgcgggcacggctattcgaatagttttactctgatcagaggtgtacaactgtacccacaagacacagccccacgacacgtttccatgcgccgacatgccaccacgacatatcagaaagaggccgtgacaggacccttcgcataaccccctctagccaagcacaccacacctcaggtttcacccccgtccccagcgggcaacgggcagtcccctctcgtgcctagg

SEQ ID NO: 32251 - DNA, 1501 bp, Oryza sativa
tgaacaaccatacccggctgtacagatctaactccaaaccaggagctaagcaaattattaccagttataatatccataaattattgtgagaggtgtgagactaatcacgaaaaacattgctcaactcgcccataaccgcgggcacggctattcgaatagtttttactctggccggaggtgtaccactgtacccacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaattatatctaatatctagttgaaccaatatatataaagctcaactagtccaattataatcacccaaggtatcaaggaataaagtaatcaatgaaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacaacggaaacgacaagctatcacgcaaaacgaggaaaaagactaataaaaaccaattaaacaatacataaaaaataaacaaacatgtcgatcataattttagatgaattatgagacttgaacggcctcattctgacttcaaatgaatttattacgaattttacaagattaaatctatttaaagcccatttaaaaagaattaaataaatttaattcaatttatggacaattttaatatgtagatctttattttatataatttttgcaacttgaaccacattaaactgagttcaaatgaattagttatgaatttttaaagattaaatcggattaaaacacttatatggattttaattgaattatgacgcaataatgaattatttttgaaaaggaaaaaggatttattgcatcaacggctagggtttgcggtggaccgggtgcacggcgacggttcacgggaacggacggtcgagatcaaccctattcaaaacggaaggccgagatcaaacggtccacgaccggctcacggg

SEQ ID NO: 32252 - DNA, 1501 bp, Oryza sativa
cgagtcaatctagagttttagtaaaactcttgagatttattcgttagtcagttgggatttgatgggtgaaatgcattaggtcctagctcaggaacatgggttgcaaggtatttcagctcttattgttattattagtatgtatctaatttccccattattttatcgttatgtgagtctgtcttatttattcgcactcatgcaaaatgatctatgcataaaatttcgctcttattcgattctcttatttgagtcttttattgctttatttaaatttggatttgagcatgcattgatcctactcctttgtcttctctagatggccggacacccacccaaccaccgcggagaaggcatgattgattttgtggcagagttggcacgcatgacgctggtggtgggctaccccaacgcgccagagtagacgacggttccaccgctcagtggcgagcttcctcaccgtgttcgcttggaggtccatggctacgtgggtacctgcctagctaacatggtggttgaggcgtccggaggcacagcagatcacgcctgtcaggaggcagcatacctgatgatggccagactacgggagcgccacaactacatcttccatgacatggcataccgttttcaccctcgtcgagccagtggtgatgatgtcagcaccttccgtccgacaaccggccagaacgacaccacctttggtcacatgtgtgctgtgatgagtggattggataggatgcactcggacctgcacaaggcgaccaaggccttgaacgatgggaagctcatgaggatcgtcgctctgatggacgagatagcgcgcctgaagagggagaatgctcagttaaagggtcttcccgcgccaggaggagtccggatccgcaccacaccccgcaagacgacgacggcacccgtgcgcatccagcttgcgcccaggaacccacctccatcagcagctcccgcagcacctccagttccgcccgcagttcctgcagctccagctccagctcccgcgtccgctctctccttcgctccagcatcagccgccaggggtccagccagtggcaacggaggttggttgtctgctactcccagtggcagccgcgatctcagcagcagcagctccagtggctcagagtcgggcagcggcgagacttatctgccaggctccaggagtcgctcagagggacctggtgacgagcaggaggacgccttcgactccaccgaccgcaggagccgttccgagcattaggctcgttttccattagttaatcgactgtctagcttctgcttgttagtttgtgtgtttaggttgcttgcttggggtcagtcgacggtcgatatcatgtgcctatgatatggctgtcttaataaggattttcgcttgttttttttaagtgttttaattcagatcagaacaattgcagtttaaattcctttgtaataaagcttagtttctgagcttctgtttttcttcttttccccgtctgcttctccctccaga

SEQ ID NO: 32253 - DNA, 1501 bp, Oryza sativa
tatatcgttcgatgatttatactgctagtatatacttacagtatattgtaccaaaaagttctcatttttttccttcgcaatcggttctctcaatttctcaacaggacaccacatcacttccttttctttctttccattcactgtatgatttctttctgatttttttagagtgaaatcaattctagattggagtgcagtgagcttgatccgatatatagcccaaaacatttattctactaaggctactctttacaatatgaaaaatataatttttttatcaacatcaagtactaaaaaaataagagaaaatcccttatatacccctaaaattttagctaatcccttatatgtccctgaattttacttacttccttgtataccccctaaatatgattcggatcccttccttatctctctcgtcagttgaccatctaatttctataaaaatgaccattttactccttggatgaacatataaatttatgaactacattattaaaaatataaaagtttattgcatgagactattatagttatgagtttgttatgtgatgcattatctaccacaaaatttatctttagataatgaaataaaaaaatgtatttattttttaaaaaaattcataaaaaattaggagcatccatacaaagatatgactaccaatgctgaaaataattttttttgaatgctcccgataaaaaaaatccattgtcctattaaaatttcaaataaatttttttaatttattacatttgttttattttcaaaatttatgtcaaaattttctgcactaattatttagtcttattagtttcataaaatgcacatactgtgcactcaaacaaaattttcaattatttttcaagcttatattcaaacttaaagcatcaaaggcaaaaagacatttgcaaccaaatgtaatagtgaaatgaaagaaaatataacggtaggggcatggaatgaatcatgttgaaatttcaggagtatagaaggaatcgggtaaatttcgggggtatgaaagagttgagtgagtttttaggggtacatagggaatttactcaaaaaataaccatgcattgcaatcgactctaataatacatgacaaaagtacatattatggtttcaaactttagtctgtaatacataatttcattttaaggtggtattaatagttttcttataatcacccatgccaatggatttagagaaaaaataattacatcatgtgagcgtctttcttacaccgggaagattctatttgcttataaggaactcaattaaacttggtggctttatactccccacacactcactactactctttttggcttcactcaatgcaaggcacatgcattttggtagtatacctttaaatttggatcacttctctcttttgcaaaagggaagaaaaaaaaactcaaagcgcaattaactgcctgggtttctaggtgggccttgtggtactgggcttaacgcattccctcacggccctcatttttc

SEQ ID NO: 32254 - DNA, 1501 bp, Oryza sativa
ccgaactgccgcatcacgcggaaaggggcgtgaggctcaacgcagatgtcgaagaccatcggaaccatagtcatccagcacgcctggtccctggtgcagagtgtggacagacccaacggcgcacgagcctaggtagccgcggcactatagggctcccacacgacgtcagtcggcagaaggcggtcgaactccataacaaactcaggatacgaccgcctaacctggacgtgagcccatcggcgctgcaatacgagacgatcgatgtgatgtacaacgaacttagcaattaacttaacaatacgataagatcgatgcaacgtacctgacgacggcaccacagagtacccatcgtagggtagtcgacctctggtcgctcctcgtacagtgactcctcctacgcgtgctggtccacctcagggcggccgatcggaatcctctcagctgcccagatagaaagaaagagagggcacccaccaaaggtcgcgctgggatccgtcttcgtgcaagactcacaaagtgcacggtacagagccgccaacaacgcggaaccccaactccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcgcgctgtactagtgcgaaacgtgccgtcagatcgtcctgccagtccacagccgtggtcactggcccaacagcgtcctgtagggtaggggctacctcaccgcacggcaagtgaaaagtgcgcgtctctggcctccatcgatcgaccaaagctgctaggagggacctgtccacagtctatcgtctggccgggtccgcgtcgccggccgcagcctccaccagtcgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccacagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaatataacttgcaaaattatgacatagtaatcaaatcatgagattaattatgtacaacaagagt

SEQ ID NO: 32255 - DNA, 800 bp, Oryza sativa
gcaccccaatcagtcgaggtacacaaattgacaatttaatatacagattcatcaaatttactaaaacgataaatacttacttaagaggcattaagtcctcaccaagaagaaaactgcagcggaaaataaaatctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaagaatggcataatataggctcatttgcaaaagcaacgtttagccaaatatttaagtgaaataaaacagtagagtagttaatcagaaattttaatcaacactgaacagcacacccatgctgcacaagcccgaccatcctgaacaaccatacccggctgtacagatctaatctccaaaccaggaattatccattccaaaccaggagctaagcaaattattaccagttatagcatccataattatgatgagaggtgtgagactaatcacgaaaaacattgttcgactcgcccataaccgcgggcacggctattcgaatagttttactctgattagaggtgtaccactgtacccacaagacacagccccacatcatgtcaccatgtgtcgcaataccaccacggtacctcggaaaggagctatgacaataccccttgcataacacaatccaccacagcgcaccattcctggatcataatcacccccttataaacaaggca

SEQ ID NO: 32256 - DNA, 1501 bp, Oryza sativa
taaaattgggctagataaaattttattaaatactttgcttaattctataattcctagattcttctgggatttatttgagctaaggaagtatttttaataaatggaattgcatttcatgaataatttaaattgaaaaaggtttttaaaagtcttattttggctttgggccgaaagtcggcccaaaacccctctctctttctctctccctccccggcccagtcggcccagtcagcccgcgctccttccttttctctctcggtgtcgctgacaggtgggtcccacctgtcaggttcgtcttcctcgcgccgtcgccgccgcccgaaaccctagcgcaagccgccgccgtctccttccaaattcggccgcgcctttccttctccggccgaattgattgagggcaattgatccttgagatctcctcttccttttctcttttggaaacatcggctaattttctttggaaaccggtggatttgagttggattcggattcatctctctcctctaaccccgacctttccttctcgtcgccggcagccgtgggccttcactgccgcctccttgcccctttaaaaggacccccggtgtctccgctacccgccgcctctctcgccttcgcccgccgtcgtgtgtagcgccctagcctcgtgagcttttgcgccgccgtcgccgccgttcgtccagccgtgcgccgccgtcgctacggtcgtcgtcgtcactcgggaaggccaccgtcgggatcgccaagtcgtcgccgtccccgtccgccgcttcgccgtcgccgaagatcgccggagcaccgtcgccgccgtcgacccgatctccgccgccgcttcttcctcgtcgccgtcgccgtccgttgttcctccgccgcttctttggtcaccggtaagttcgccgcgccgcgctctacgtcctggtgccctccgttctcgttgtcgcgccgtcgttcgccggcgagcttgcgctcccgacccgccgccggtgctgacgtcatcgttgccgttccccgtgagccggtcgtggaccgtttgatctcggccttccgttttgaatagggttgatctcgaccgtccgttcccgtgaaccgtcgccgtgcacccggtccaccgcaaaccctagccgttgatgcaataaatcctttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcttgtaaaattcgtaataaattcatttgaagtcagaatgaggccgttcaagtctcataattcatctaaaattatgatcgacatgtttgtttattttttatgtattgtttaattggtttttattagtctttt

SEQ ID NO: 32257 - DNA, 1501 bp, Oryza sativa
cccacgggggtcgctggggagtccatgccttgttttataagggggtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctccggccagagtaaaaactattcgaatagccgtgcccgcggttatgggcgagttgagcaatgtttttcgtgattagtctcacacctctcacaataatttatggatattataactggtaataatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgcaataatcaatcaacctcagttgaagacaagttgcgaaggagaagacgtttggctcataccccagttgagctgcctgtgggagtggagccggagcttcgctagattttattttccgctgcagttttcttcttggtgaggacttagtgcctcttaagtaagtacttatcgttttagttaatttgatgaatctgtatattaaattgtcagtttgtgtacctcggctgattcctggacgaggattttatgcacaaataagtttggaaatcacttgtgaatttccgggcgtgacatgtaccccggctggtcctggacggggaatttaatgcacattctgcttgaaattctattcgggaatttctgggcgtgacaagttggtattagagccgaccttgaccgtaggacaagccaaatggaaaaacctaaaagccctctgaatccttttcattgcatatgttcttggcaattggatttgttccgggaaaattgggatccgttcttgtggttcaagggaaaaatcttggtcgctcgtttaagtgagatttgtcaaaacgagtcaatctagagttttagtaaaactcttgagatttattcgttagtcagttgggatttgatgggtgaaatgcattaggtcctagctcaggaacatgggttgcaaggtatttcagctcttattgttattattagtatgtatctaatttccccattattttatcgttatgtgagtctgtcttatttattcgcactcatgcaaaatgatctatgcataaaatttcgctcttattcgattctcttatttgagtcttttattgctttatttaaatttggatttgagcatgcattgatcctactcctttgtcttctctagatggccggacacccacccaaccaccgcggagaaggcatgattgattttgtggcagagttggcacgca

SEQ ID NO: 32258 - DNA, 1501 bp, Oryza sativa
gttcattctaactcctaatttagttaaaatgtgatctctcttctctcattaagccaaatcacatcaattgttttgttattagataattatctatgatccaaattatctccctcctttttcttattaagtcatatcacctccattttttatcccttagatgattaatctatgatccaaactatctctcttattttcttttctcataaagtcacgtcaacttacttttacatttcaataatcattttatatactatttaaatttaaattatcataaaccacatcaacttacgtgagtgtgtgtgtgtatacacatacatacaggacactcatatgaggcaccatggtgccggtgcccgggcaccatggaatgaaatacacaaattcgcccaaatattttaaaatttttaaattgtgagcatatacctagttataagtattcgattcatacctatacctagcaacaaaacaactcaaatttaactttatttcacaatccaatattacatacctaactaattatatgtttggatgctatatacctagaattaaaatctgacaaaaacatgtttaaattcagttcaaacttgttttgaactagttagtaaatgttatacctaaacatttaaaaaaatttcatactcatttgaattgagtatatactcaatttaaatcatggagcccgagcaccatgaaacaccaaacaaatttaccatacatacatacatacatacatacatacatacatacatacatacatacatacatacatacacatatatacatatatatatatatatatatatatatatatatatatatatatatatatattactcattatttttacttagtactgctaaatttctacgacaacgcgtggagtagtatttttggatggaggagtatcgtagtggagtactatttttcattgaaatcattcaaggtccaatcaggatctcgaaattaattcttcatgcccatgaagacatcagctggcatcaatgtgacaacgtgcccattgcagctggcgtactacccatgcttgtacattgggatcgaagattaggctgcagaattgatgaatgtacaggtcaaacaactcaactagtggctgtacaagtattaattaaaaatcttattcacacacacgagctagcttcacaacttgtaaccactttatttatttatttttttattcacaataatcacgatcccacgttttagactgcataatatattacttctaactctccctccatttcatattaatttattacctccgtaaataaaaggaatcctttgcattttggatgtacgaaaagtactatctagtattattttagcaaatctcacataaaaaataaggagcagtgtcaaattacatcgttaattaagtacccacatgaagtacatcacttttttttttcaaactagccgttaactttgattaacacagttatacatgcaccggtggagaagtgttttttagtcctggttcgta

SEQ ID NO: 32259 - DNA, 476 bp, Oryza sativa
cacctagattccccgttggattttgagcgagaagttggcgtcgaagctcatcctcttcgcgcgcatcacggttcccctaatctccacctctaatcggatccgtcacccttcgcttgttgacttgccactccggccgaatttggagggcgcttgtccatcaccacctctgtgtatgaacgatggtcgcgcttgcgctctggaactctccagatccggcgagcaccactaccaaatcaccggacttcctcacctctcgcagggaaccctagctttggttgcacctctccttgcttcacccaaatccactgctctaccgaggggataaacttggggaaaagtcaggtttcccaatagctctcgaactctccgcatgggctccaacagtattaggctgtactgtagatgttgggctgccgccattgatgacgtcatgcatgtgtgctgggctagcccaaaccatcccagctagaacccca

SEQ ID NO: 32260 - DNA, 1501 bp, Oryza sativa
aaatcatactccctccgtcccataatataagggattttgagtttttcttataatgtttaaccactcgtcttatttaaaattttttgaaattattatttattttaattgtgacttactttattatctacagtactataagcacaacttttcgttttttatatttgtaaaaaaaaattgaataagacgagtgatcaaatgttacaagcaaaaactcaaaatcccttatattgtgggacggagggagtagaagttagcagttgaggataaccatatgaagaatctcaaggacataatagattcacattttactgatagtatcttacccatcgcaattatcaagcagcgaggtacactgttaaactgaagctattgtcctaggcataacaatgtaaatatgagagaggaaaaaaggcacgcgatgaatttgaagtcatcattcttgaaggatatctcagggaatgtgctaggatcagaagaaaacaatcatgaacacatccactgcatagttgtttagcagagaaggtgcatacatcgttggataaaaatgcttcctgaattgagagaaaaatttcatgaccaaatcaacgtaatacatagcataacttggcttcaatgtgatatgagtatactgcaagcaacaaagagataacaccaacaaactttgtgctggcctataatacctgcaatagccatctttaagtgctctagaactgaaccatttgggacaaaatattatacagttaatagctgccatatcctttaaggcctgactcttatgtaactgaacgtgatgagaaatctaaaattaagtgacagcagtgtgtagttttgagtacttaactaataatgcataccgacgggctaagtccatcaagcatttcatcaagtatatgacatacacaaacatatatagtagacgagtgtatggttaatttaccttctatttcaaagagttgtaggcaatcaatttgaaacaatgattgagatcaaccatcttacctataagactgtaaagaaaatcaaatgaagctactgaagaattctgaaaatctgcaaatataattaaacaaaaggagaagagcacaacgtaccttggttctattaaactgagctgctcacaaagtcactgcaccatatatatcaaaacacagctgcaatggagtagaaggtgcatctaagcttatggcatggctataagaaaaatagctttcaagttatacaacgcagcagcaggccagtgaatctgacatactttggtcaagataagacaccacccaacattaaatttacattgtaaaccgtccatgaattttcctgtggatgaaacaatggccatggaaatcatctgttgtagagtaaacgatggcgaaaccaaccaattgacaacaaaatgaatagagtcagaccagataaagcgctgttgcggatgaaaatgcagatctgcaaggaaaagaatcaaatattagatattaatgcctaaaattaatgatgcttcagcagc

SEQ ID NO: 32261 - DNA, 1501 bp, Oryza sativa
ggcttctatctttaccttctatgcatcttcaacctgacttgatgattgtttgaaaccaattttaatggaagttaaatgttattgttgtgaccctgaatcaggttttgtatgctaccggaatcctcttcacgtcttcagagtagaggtaattttgtttcttgtcattttacagttacagttcatctacttaaggaattaatgggaggtcctatattttctcgggtacctagaaggtgtggttcctagtcttacctccttaagaaccgtagaatgttggccctaacacttggatcaaagaacgaaaggtgtatgcactatagtatcctttatatattgcacaagtcaagacatttgttaaaacacacccagtgctagtaatttgtttactgagatatgaattatcgccaaatacccatactgagcctattagtaaaatatttacgaggtgtttgaggacagcataactttcagtaaagaatttactacgtgaggtgtgtgttttaggtattgcgcatcttgggtgcattttagcgcaaacgtgtataatatatatcccatggtactaactcatgtcttaaccataattgcacaccaacacaaaacatacactactacagagataagtatcgaagaagacatgcccaccggtgcggaagggacggtgattgtgccccacacaatggagcagttcgccctccacatgagccaagccaagcaatcccacaagctcgtagtcatccagttcactacttcccggtgccctgcttcacgctacatcgcgccagctttcaccgagtatgcgaaggagttcgctggtgcggttttcattaaggtcaatgtcgacagcgatgagctggagagtgttacggactggtatgacatcgaagggatagtgccaacatttttcttcgtcaaggatggggagaagattgacaagattcctggtgctaacaaggagttgctccgagccaaaattcgaaggcacacagcttctccttacttcctccgttgataatgacttcttttatcgtctttgtctagtatatatatggcacttatatagttaactaggaagggcaccttgtttaatgtagctttcatttttattatgaatgttaaggatgatattatattgttgaagtatttttttactccttgtaaacatgtattggttaataacgaagtagtttggacattagttatgattttcttctgattacccttgcaacatataaactccatactaaaattattaaaaaaaatgtgtcataataatggagttggtttatatctatttgtactatgtgtgatttttttaaaatatctagcatatcagtttccaaaattttactaacaatttttcttgtatgctatcaatgactttatggatttattatagtaatgaaaaatatttttcattaaaacgtagctaatagattactttatttaagtaaaggtagacttatattggttatactacctccgtcacagcacgcatcat

SEQ ID NO: 32262 - DNA, 1501 bp, Oryza sativa
acgcaaaataccttatattatgggacggagggagtaaataacttgcatatgttcgtatccatgggacggacatgcatgataggtgcacacttaagtacctgacttggatcgagttgttttatgcatcaaccttgcattatttgaggaaacttttttcataccttaatgcaatatcctcttatttttacatgcatttaatattttttagaaacatagtataaacacaaatacttacaatgcgcgcacattcaccctatgaacctatgagggccttcattgataaagtcgacacggacgcctcactatcgatgggtacgttgcctaccacggaaagaataattagctatcaacgcgagcagccatgtcaaatctataatttaaaccagatgagctagttccacaacaagaaacctacccagttgagttacactcacttcgctatatgcacctaaattgttattaattttttttaaaaaaaatgacatgatatattaatataagatatttcatgtcacaaacgtaccaatttaaaatcaatatatacaaatagaaataaaaaaacaataaatttgaatgtgaacagtgcgtaccattcgcaacgatatttattatttttttataattgtctaagttaaatttaaatttacatatttgtgaagtctatcttgttaatattttaatttttatcacttttaaagtgataagtacaaaacaagggaatatcctcatggaatggatatatgtctcccatcactgtagtgatatttggcatggtgagttggtgacatttctagccattcgatatttatttagtaggagtaatcacaaagtttgtttaatggtgtcgctaaatgcgtgacgcggtactaatatatagaatgacattatgttgcatcagctgggactccctgcccctgccctgataacctgatccgtatatctgatcattatctgaagatgtctagctgcagctatgcacacggaagaacttgcgtagactttcacaatcttcagctcctcagacaacctggattttcctatggatttcgaaaatcaatagctatagtatttaaaaattgaactaaaaactagaaacggaaaaacttctcacccgctaactactcatctcttaacaatgaatcctctaattcctgtttggcacaattccagctccagctccacctccatcctctactagaaaaaaaacacttttaccgacgttaggtatttattttcgcaggcggacatgaccctcggagccaaatagccgcctacagaaatacaaaccggggtgaagctcgttgtccgcctgcgaaaatagacttggaatataaatagagccaacctatagggcctattttttttcaaagtcctcattctccctcattcctctcccgcgttgtaatatcccggcctagggcttaatagaattaatagaatattcatatcaacaagttacaacttcttttccggaagccgatctcgaaagaactttgaactt

SEQ ID NO: 32263 - DNA, 1501 bp, Oryza sativa
cgccatcgccacctaatacggacaccatagccgtaccatcgtcaatctgcgaagcacgcacctccgtgggatcatccactgcaaccctagtttcatccaagtgcactccagcaccaccaccttcttccttggtctcatcagccttgccaacatcagccaaaccagggtcttccgcaactcccacagtctcttcttcagctatatggtccatatcctcacgaccaagggacagaccaaacgtagggcatgggggttcggctcaaccccccaaaaagctcgtcggcgacggagaggcccgacgaggaggggtgccctcgagtcggcggggacgccgagcggagcggagtgtgcggcagcgcgaatcctggagccgagcggacctcgcgggctggcgcctagtacggcggcgcggggcggcgcggcgtgacggcgacctgccgctagggggggaggttcgccggcggcgggatggcggcgccggcgaggtcgcgaacgggcggcggctagggctaggtcgcgacgagccgcgctatggggaattgaggaccgacgggttgaggtaggggtaggatgatgtggtctagttgggccgggccctgacaccatctctagcccaccaccgacgaagaaaagttgggcccgatgtttagttgggccaggcctcattccatgtcatcaccgaagaagaaagatggaccacgataaactggcccaatgttcctttgaatatcagttctggcccattaacttatataggcccaatgtgccttcgaatcgacatcccccggtagtggagttgagagtttcagacaagcaaagcgccgtgactgactgactgtcaaagctactccataccacataaaaaaaaagaactcaacgaacggagtgttatgagtcgacattgaaacacctacaatgatttcaatctcaatatatgttaaaatatttttttggagatgttcaaaaaaataatatgcatatgtgtctttacatatgagtgtgtgtacgtgtatataagtgtgtgtttctgtactaaattttgagagagagaaaactaaatttggcgccacattatgcagctctcaaacaaagactacgtgcacattattgcccaaggctaccagcaggagcaaggaagacggggacatcagagctcggatcgaccagacgttgatctaccggacctgatatttccttgtctgaaaaatcgctgtcaagcaggctcatgagccgacttgtcttctctgatcccaattcgcagctaccgataccaagttaccaacacaggagcacactacttcttctgtctcaaaatgttgtatttaggatgagatttagatctatcctaaacaaattctgtccagatttttttagaatatgtaaaattcttcctccgttttatattgtaagactttctaatattatccatattcatatgtatctagattcattagcatctatattaatgtagttaatgctagaaagatttacattgtaaaac

SEQ ID NO: 32264 - DNA, 1501 bp, Oryza sativa
ctcatcaaacatgtcgttttataaagttcaagttcggagtgattccacacacgcaatctatgtgtgaaagcaactgctgaaaatcacagaaccaagtgaaagctgaagaacttttacgctatgcagtaatgtagacactcttaaggcctcatgttttgctttggcaaaatttgtttttaccatgatcacacttcccaaactgttaatgtttttttcataaaaaaattatgtagaaggttctttaaaaataaccaattttcaagtttgtaataatctattgtattataagaccgtcttgaatccctagcacatggtagccgtgacactgagagctgctgctaggtcactactccatggcgatagactgttgttgcggctacgacaacacatcctggtggttgcgagtggttggaaggtgagagaggaggaagaggaaacgggaagagaggagagagtagagagaggcgatgaagatgatgaggcggaagtcgctgacatgtgggtcccacctatcacgtcaactgaaaccgtttcccaaaccagcagagaaggcagttcgcaccagtttttaagttggagagacgttatacccgattttacgattgagggatatggttcgatcaaaggcaaaagatgagggaggtaaaatagactaactcagctcaagtaggactttccccaaactgggccgctaccatcagtcgtgtcgtttaccgtgcagaacttcagtcaagcaaatcatctgtgagaatatgactgtcaaagctgtgtagtaccacatcagaagaggaaaaaaaaatgctcctactcaattttgcgggcatgcacctcgcactttgacacgctaaaactttatatcctgttatatctcgaatatttaaacacatgtataaatattaaatatagtctaaaaaataattaattatatagattatgactaatttgcgagacaaatcttttaagcctaattactccaagatttgataatgtgttgttacagtaaacatgtactaatgacggattgattaagcttaataaattcgtctcgtggtttaccgacggattctataattagtttttttatgagtacatgaatattttatacactaacctctataatatccgatgtgatacgctaaaacttttcacctctaattctaaatatctcctccgttgctgactaccgtgcacattattgcccatagctagtggagtggagtactctaccactgtaccagccaagaagaggagatttcagagccgaattcacagctagtaccgacaacttgccaagatatttcgctctgtagaaaaatcgctgtcaggccatctccctagccgacttctttgatcctagttctttgtcagttcattatattttctctcatataatagcatatatgttttctcattatattattaaaatatattacaatgacaacataattttaaattttgcaataactttacgaaactactaatgtgtaataaccactctagt

SEQ ID NO: 32265 - DNA, 1501 bp, Oryza sativa
cgttcgttgagttctttttttttatgtggtatggagtagctttgacagtcagtcagtcacggcgctttgcttgtctgaaactctcaactccactaccgggggatgtcgattcgaaggcacattgggcctatataagttaatgggccagaactgatattcaaaggaacattgggccagtttatcgtggtccatctttcttcttcggtgatgacatggaatgaggcctggcccaactaaacatcgggcccaacttttcttcgtcggtggtgggctagagatggtgtcagggcccggcccaactagaccacatcatcctacccctacctcaacccgtcggtcctcaattccccatagcgcggctcgtcgcgacctagccctagccgccgcccgttcgcgacctcgccggcgccgccatcccgccgccggcgaacctccccccctagcggcaggtcgccgtcacgccgcgccgccccgcgccgccgtactaggcgccagcccgcgaggtccgctcggctccaggattcgcgctgccgcacactccgctccgctcggcgtccccgccgactcgagggcacccctcctcgtcgggcctctccgtcgccgacgagctttttggggggttgagccgaacccccatgccctacgtttggtctgtcccttggtcgtgaggatatggaccatatagctgaagaagagactgtgggagttgcggaagaccctggtttggctgatgttggcaaggctgatgagaccaaggaagaaggtggtggtgctggagtgcacttggatgaaactagggttgcagtggatgatcccacggaggtgcgtgcttcgcagattgacgatggtacggctatggtgtccgtattaggtggcgatggcgatagctttgttgagcaagatggtcaggatactagcggcggcggtgcttgcaatgaaggtaatgagcctgaggaagatgctcgtgttcaggtgcgtttggatgatactagtgccgctgtggatgaggggggtgcttccttgattgatgatgttatgaatacgctccccgttggaggtgtggctagctttgatgatggtcctcagacggacaagaatgcgcaggatgagggggcgcttatagatgtagtttcctcaactgtgctgaatgatgcgagcatagatcttgtcaaagctagtgatagtgtctcggaggaaggcacagggatggatatacttgtccaaccgggagaggacattaaggaaatggttacaatagcctgtgatgcggccacagatgacgagggcaggaaggtggatgcagtttccagctccagtgatcgcaacgaggaagtggttggtgcagctggtcttgatgagacagatgaagacatgcgattgggtacagttggcctgtctggtgatgacaatgtggcaaatgaggctgctgccgcagctgctggtggtgcagatgatgaggacttgaagatggatggggtcattaccgccggagataaggatg

SEQ ID NO: 32266 - DNA, 1501 bp, Oryza sativa
tccttcacgccggcgacgaggttggtgtagagcgtgacggtggcgtccggaggcaaggaggcggccgcggcgttcgcgtcgtcgtcgaggaggatgacggggaggcggagccccgcaatcttgggcaccagggcggagatggtgatgacgagcttggcgcgcgcgtcggagacctgcttggcgatctcccgcggggtgtagtccgggttgacggtggtgccgacggcgccgaggccggtgacggcgaagaagcagaccgggtagagcacgcagttgggcgcgaggaggagcacggcgtcgccgggtcgcacgcccgcgcgggaggagagcgcgacggcggtggagaggacggccgacctcagctccgcgaaggtgagggcgcggccgccggcggccgcgtcggcgagcgcgaccgcggaggggcaggcgtcggcgcggcggaggaggaggtcggtgagggagaggcccgggtcggacgcgacgggcgcgggcgggcgcagcgagcggtacacgccgtccgcgccgtagccggcggccggcaccgacgcgctcgccatggcttcccccgcctcttgggtttggttggtgcgggagaataggagggctttgttgtggtgagtgctgactcgagggtgcgttgaattggaatttttttgagaaaaaaattaatattatttttatggaaaatcgtaaaagtagtggccaaccggggaaaatcgtgaaaataggtccctgtcgaacgggtgcaattcgatagggcacctatcgaacgacgggcagtcgacaaagctctgtcgaacggctggcgttcgacacgctcacctgtcgaacggagggagttcgacagggcccaccacccggcgccgcgaggcctgttgaaccgggggcgttcgacagggccctccaccgaccctgtcgaacaatgggcgttcgacaggccggtttaaagccccgtccacccaggccgcgagttcgatttgtgaccacatcgccagctgccgccaagagtcgccacatcgtcgccgtgagcgccggagggagcgaggggaggggatagcaggccggagaggaggccgaggaggcaccggccgggaggaaagggttggcgacgccctccagcagtgaagttaaggtatacattagtaatccctaagtacaatgcatatgaaagtttaataaaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcagga

SEQ ID NO: 32267 - DNA, 211 bp, Oryza sativa
ggcgacgcacgggggatcgggggaattaaaggaaaggggtgggagtcctcactgaatgggacggcggcgaccgtcgacgatgagccacgggaaggacgacgtcggcgggcggacgagctccgagatgccctaagaaaggaaaagagagagattagagggagaggggtggtccacggcgggcggaaaccatggccgaaggcggcggtagaga

SEQ ID NO: 32268 - DNA, 1501 bp, Oryza sativa
ccctccatcccaaaatgtttgacgccgttgacttttttaaaaatatctgaccgttcgtcttatttaaaaaatttaagtaattattaattcttttcctatcatttaatttattgttaaatatacttttatgtatacatatagttttacacattttacaaaagttttttgataaaacgaacggtcaaacatgtttaaaaaagtcaacggcgtcaaatatttaggaaatgagggagtatattatttttaacatttccctaaaatataaaagcaccatattgctgccatattatgatattatcgaataatgtaacatgaatgtagataaaattaaaaaaaaataagtctagtgcacaacgaccggcattgcaatccggtcagaccaaggctgtgtttagttggatccaaagtttatattttggttgaaattagagatgatgtcactgaaaagttgtgtgtgtgtgacaggttgatgtgatggaaaaggactgaagtttggattcaaactttagatctaaacacaacccaattcttccgattcgtaaacccacgagacaaaaaatataaaaacaatttgcgtaatcagggcggcaatgcggcatgccccaaaccataattaaagaaaacaccgactcaattattcaattaactaatggaaaatcagcacaccgacaagagattcatatccagcagttgttcgtacaggattaggttatccactacttccagaaattgaattgcagtccaacattttccaagtttcagctttcagaagtccgtgtttttctgacatgttgcctgagttaatcaacgccatatttaattgccatttgggagaatattcttagtcaggcacacgtatgaagacaaaaacagagcatgaaaaaaaatagttttgctgtgtgttttgtttcctccatttggcaacggatcaacgatgcaacagcatcagggattaaaagaactgcacaaattaattaagagcagaggccatcggaatggataaccttcggatatataagaacaaaatgattattaggatttccatgtgagattagacagtggaagaaaatgatatttaaggataattcaccaggaaggtttcaatcatgaacaggacacgtgtccccatggagagagaccatacccctctgaccctgtagtccaatcccgggactaattgttcgtagtctaaatatgcttaatacggtcatattccaaagctagtgcagtctaatcgctttctttattctcttatcaattgccgcgttcttcaaacatgggcgtgttagtgatttggattgcttcaatggtaggtgaccgtgtggcacgccaaacctgcaaaatgtgggcgaaaaggacgtgggcatttcattccggataacgaagaccttgatgaacattgttgactccctgtctggaacgctgaaatttttgttattttttttcttattcccatgtgaaaattgcacagaacatgtgtagatcacagagctagaattgc

SEQ ID NO: 32269 - DNA, 1262 bp, Oryza sativa
tactccgtaaatcaaggatacaaattagtatatcatacatgggttagtgtcaaaatttggccaaggtatcatacaagttatttactccccccgtcttaatataagtgtaacctaggataaacgtgacatatcgtagtgctacgaatctagtatatgtttcatccaccataggttgcacttatattgagatggagaataaaatttagtaatacactacttcctctgtcccgtaaaggcgatcgttttatactcacaaaatatcctatatagattatcataccagttttgtcggatcatatagtacttgaattattcttgtccacttgtttgaattaaatgcatgtgcgtatttattgttatttctcaaccactcaaaccacctttgatgaaggaggataaattggaaatttacacatgagctaatttatcctataatccttagaacatcaatctttctgggacagggagagtaatagcttatcttacatttcttttctaagagtttgataaaacaaactagctactactgtagtaaccatctcaaaacaagcccacagcattctgctaacagtctatcagatatatatgggtatcccgtacacgtttcgattgtcttctttctgccgcatggtggattgccctgagtgacaagacaaggaacatatcaaatcgtagtatgatgaagctctccatgttggggtagccacaagttgtcgtagggcataactttgttgtcggattcatatttctaaacaactttccaatgtggcgtacaaaatttcatggcgtattttttttccaagttacatggaaatatgtaaaatatgcatgtacaattcattttattttctaaccttttaaatataattttaaaataaactcctcttaagcatatttataaatctgaaccatttgcctactgtaatgttgagatagaataatgttgttgcgtcacttaagagaccaatgatatggcaaatcattgttgtcattccatgccatgaacaatagttctataatattttttttcaattattgatactttttaaaacaagttatttaagagtttagtttttaaaatataaaggaaatactatctccatttttaaataacttgtagctgaactattcatgcttaaactttaatctctcatttttttcttaaaaaatacaaatatttaagaaaatactatattatcgaagtatatgtatattgcatatatcttaaacataggcataaaacttcttccatttattacagt

SEQ ID NO: 32270 - DNA, 528 bp, Oryza sativa
taattcggcttataataaaaataggtttcataacacttttctaatttattgacaccgtattctttctgttgttgaatgttacttgtataagacagcggtggtatttgcggtcttgcggaggcatacgagagaagggcggttagttttgcgggcaaaaactaaccgcagtccctatccacgacaagcgcagaaagcaaaactcaccccccggcccccaccctgagccttgagacgcgagcccacgggccgacgaccgcgcgcaaccacagccaccgcccacaaactccagtacacaccgcccgcatccccccccattcccctcatacccacacccgcgacgcgattcccccgcacaccgtcttcgcaatctcctttggtcggctgcccaatcctcccttcccttcctctcctcaaacccccccaacccaaatgctcccctccgctccccgtccccgcctcccaaaaccctagccctctcgccgcgcgctccccccctgatgccgccccagcctccgccggcggcgtcgg

SEQ ID NO: 32271 - DNA, 1501 bp, Oryza sativa
aaaggtgattggacaagaatattgtcagggttatggataagtcataccctctatccttagggtcatgagacatacggatacggtatatccataagtacacgaaaaggatctgtataaatcaaggaaatagtatttgtgaaatggaaagtaacagagtcctactcggagaggattaggatatagtttggtcgtacggggtccgttgtctccgacttctacttggagactaaggtgatctacggtataaatacaaaccccctaagggatacagggtatcaaatcttagtgcaagacacctgccaccatagacgcaatccggaggacttgaagcctactcgccgatagatctcgttgaacccctctcgacaaggatctcgtcagtaatctcagagttcagtcgttctcttctgtactctctgtggtttcttccataatcttatataaagtggattagcgctattaccttacgaggggtctgaactagtataatcattttcttcttgtatgcttgatgtcgtatcgtttagatcctcgtaccaacgtaccccaataccctccaaatacgatccgcgggtatcccccgtcgacaaatatattttgaagaaactacttattgggtacatagtttctatatatagtgtctatatgataaggtaagtatggaaatcactatatgatttctaggttgggattgcccttaagcactctttccttgtgcatatgaggaagtttaagtctatatgtttcttgattattctctaccactttttgtacaacaggtaagtctttcgttacccagcttggaaaccaagcccaagagacaacataagtgcatacatgaaaagcagacaagagaaccttgctgcactaaaagtgaaaaaaggcccaaaagggcagaaccatagtaaacaactacactggggctatgtcacaccccaaagttctttcccaagcctaaattgaagttataaatggtctcaaaaaaatacttgtgtaaatcaagagaaaaccttaataaattaatgcaaataataatcagaattggcatgtggaatttttcttgagttctacatgtcgaaatacgctaacaagatttttagtggaattttcagagccctagaaataattttaactaattaaaattgagcaagcaatattttaattccagggaaaatccttttcttcctttttctttttctttttcccccttttcttttcgagtgggccgccggcccattccccttcctcctctcccctccgctgggccagccgaaggccaaggcccagctaggccggccgcctccctcctcccacccaggacgccgacaggtgggccccacctgtcgggcccgtctcctacctcgcgcccgcgccgccgcgcccgcaaccgtcgccacgcccacgcctccgcctcctccgggccacgtcggtcacgcccgcgcatgcgccgcacctcccgcgcccactcccctctctctcccgcccgcgcccgcgcccgaga

SEQ ID NO: 32272 - DNA, 1501 bp, Oryza sativa
  unsure (1)..(1501): unsure at all n locations
caagtaatttccaaacttatttgtgcataaaatcctcgtccaggaatcagccgaggtacacaaactgacaatttaatatacagattcatcaaattaactaaaacgataagtacttacttaagaggcacttagtcctcaccaagaagaaaactgcagcggaaaataaaatctagcgcagctccggctccactcccacaggcagctcaactggggtataagccaaacgtcttctccttcgcaacttgtcttcaactgaggttgattgattattacaagaatgagcatatgacatactcaacaagccacacagcaaatatgcaagtgcacaaggataccaaaggatggcataatataggctcatttgcaaaagcagcatttaacaaaacatttaagagaagtaaaacagtggagtaattaatcagaaattttaatcaacactgaacagcacacccatgctgcacaggcccaaccatcctgaacaaccatacccggctgtacagatctaatctccaaaccaggaattatccattccaaaccggagctaagcaaattattaccagttataacatccataattattgtgagaggtgtgagactaatcacgaaaaacattgctcaactcgtccataaccgcgggcacggctattcgaatagttntactctggccagaggtgtaccactgtacccacaagacacagnctcaacatcatgtctaccatgcgtcgcgatactggaaagtacccgaatagaggctgtgacaataccctttgtacaacacaactcaccacagtgcaccattccttgatcataatcaccccctttataaacaagcatggnactcccagcgacccccgtgggcttattcccgcacttctcagtctggtgctccgcaatgaatcatgttatacaaaggtaaagccgttgcccacgctggcttgtggttgcacgattaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataatgagtcataagttatcccaatagtgtgctaatgtttctaagcatggctaagcaatcatagctaatatctagctgaaccaatatataaagctcaactagtcaagttataatatcccaaggtatcaaggaataaagtaatcaagaacaaaagggccataacaaagaataggttaattccacccaatgacattccaaaataaatgcacagttgaaataaatagagaatttaaacataggatcaacatgctcaaaggattgtgtttaggatctgtgtgacttgccttgcaataatcggtcttcaattaatcttcttgaatacttccggcgcactcgcgaaccttcgcaacgatggaaacgactaactatcacgcaaaatgaagaaaaaga

SEQ ID NO: 32273 - DNA, 1501 bp, Oryza sativa
ccttcagcttacttatcgcacgcaaacaatcatctgatgttaacgatccaagatcagctttcctcttctgacagaggagtttacggagatctagcaagtcaatcaagccaccgttggtcgctctggttgctatgcatatgtcaacaatctgaactcctggtgcaatagacacagatgccaagcagaacgtaaatggtccaataataacagaaaattccaggatcaaaacatacaaggtagcttaaattaagtataccaacccaattcatagtagaagtcaccaatccctagaagctctgcccaagctcctttattcgaagccagcgggtctactccaacttttgcacacatctcatggaactgttgtctaaatagtggatttttacggatatcattctgcactagcacaccatgtacacaaagttacttaagagttggaatatgctgtgccatttgagctctattgtgatcacctagaacatcagtgttacattgcaaatgtcaacccagttggaactagatgccatgagacaagtgaaatctatcacaagaaacaagatcaattggcaccttggtaactccaacaccttttctttggtacattttccatctttaactaccgttcctcagttttagtatatgttgagcacttgaccatggactagtatgctacttaggttccctatttcccagttcgatagacaactttaatcaagtgaatagcagtaacttcactgttttcatgtttgttagaacattcatttcatttgcgctgggcagttgaaaaaaaatgtaagaattcagtcagtctgcaagaatgactgatatatcctgatccccaagattaagaagattgtgaaagcatgctatgtgtaattcaatttgtgacatacgaatagcgtcggtaatattttctgtaaaactcaactagaatacaggagtaggaatcaccttatgcttgcgtgcaaattcttcgagctgtgtccgaaacgtcgcaagctgctccttcatgacatcggtcctgaccttggccacattttccccaaccagccggaattggtccttaaattttccaagagcacactcatctcagaatccacagaaaaagaaaaaaaaaacattataagctattcaagcaagatgtccacatacacgagtagccgctgcgttctgcaagcccgcgattcccggtcgcctcctcatgcttcctagtctaaattggctgcagttccataaaaaatccgatggaatcaattagcacatctcgtgaacggcgatcgattcgatgtggccagagttctctgcgtgtgttctaacagtggcggacccaggatttgaacccggggtaggcctagcaaaaaaaaatctaaatgcaatacggtatgattcgataagatatctgataaattataaacgataccgtgatacggtatataactctaaatggttcaatacaagtagaaaataacaaacaagtttgaatcttacctaaaggacaatg

SEQ ID NO: 32274 - DNA, 1501 bp, Oryza sativa
aaaaagatgtttcagaatgggtacctattgctgcagtaatggaaatattgtgatatacccattgctctttgcccaaacatcatttgcctggaaaaacttttcctccgtaaccaaaagggaattttcgggaccccgaaaaatacaagtgtaatatctttaccggtgcaaaatttttcgaagttgccaagcaggccctaagttggagtgtattttttgtccaaagttgctaacatttggcttggagagtggaataaagaggctattggagatgctctaagtctgaaaacctgaatctgttcttcatcacggttctttgttttcatcttcagttaacccaagcattaccagaattctattcctgaatgaatttccatcactctaaaccacaaaaatattatgatccctaaatagcctgatcatgccccgagcagatcatgcatccaggccgaaacgacgactaggacaagcagtttcggaaagaagaaatccagagctcgcgagggaataccttggagagaaacccatccaaggcgagcttgtagttgctatcctcatggtccttgggcaccaccctctcgtccacccagaacacatgccacttgctccaatccaccgaatccaggtacggtggctccgcgagcttcctgcgccaccaccaaccaaaacggcgagagattccttacgcgatccgagaacacccggaggaagaggaagcaacccaagaaacgcgcgatctctggggtccaagcaatcaaaatcacctgatgttcttgatgagggatccgccggagagcacgacggtgaaggcgcccctctcggcggcgagcttcgcggacagctccgccgtgtacttcgccagggacaccgcgaggtcctcctcggcgtcgaagatgagcacctccttcttcttcttcgaccctgccgcggcggcggcggcggcgccgtcggtggccatggcgggggcgcgggtggcgggagagacggcgaggggatgggggccggaggagaacggacgcccgcggcttgtcgccgcgaccctagacgccggcggcgagcggtggcgggcgaggacgagggtacgggaggtggaggcggcggcgacggcggcggagacggacatggcgaagggaaggcgacgcgttataagagggggggaggaggtgggggctaatggtagatgcgacaggtggatggagaggcgtgacacgtttctgtaccgtccagatcgagatggacggcttggatgcggggatctcgagaaagtgtaaatatgccaaagcttccaagaataatataataggcttcttgttcaagaatgaaatgaatatttagcacaacattgttgtggatttttcaactaagtaattgcatttacaattttcgcgggacggcaattttgatccttgaatttcttaaaaaggctttcaatttcaaccatcgtttgaaatacattgattttatataatcttgtagattttttttataagaatcaatttaattc

SEQ ID NO: 32275 - DNA, 1501 bp, Oryza sativa
ggtttgaagacagaatacattaaacacaacacaacaatccgaacagactttatgacaacaaccatacaatttatcacatcaaccaaaaccaaactggaaaagatgttactacctctgccccacaaagacttcatttctggctatgcacctggacaagaactgagaaatgaagtctttttgggacagaggtagtatgaaggtattaattatcctggattcaaatactaagaatggtgtattatattgccatgaagaactatcttctctaactgataatcctaaaccttttcattatgggaaacagtaaggaaggaccctagtccatgaatcggagccgtcccgtagagctacacaaaacatgcacactccatgtggtcacataaccaattaggtgctataggaagtctacgtgtatgtagttgcgacctcaaacttggtcaaagaaacgaaagcttatgaattactagatgcatagaagagattaaaaaactcacactcctagcaggaagggccaaacttcagccctgattcctggttcaatgccctgacacaacagaaaaaaaaggccagtatattaattagactgtacggagtaagatgcagaacatgctttcaatatcactactatatatgtctaaatctttgaacaaacaaaacaataggcaagtattcttgtaaacatatgcaggacatctaaacaaatagataatcaaacttaccccgctgcgaactttcttcagaaacttctttcctcgatcacgaagtttcccattagcagaaaacagaccttcccattgttgacgagaaagtactcgttttcttttccttcgagaccatggagactttattccacccctgaaagaagattaaagaatagttttagaaagtggagcaacaaggaagatatggatcaataaaagataacactgccataccaactgacagactaactaatagtaccatctttaacacactctctaagctacagcatccgaagagggaatgctttgagtcctcataaatccaacttcacatataatttgtatgcacacgaaaaggttggatataaaacaaattcataaaatagacagatattaaggtattaattagtttacgaaacaaacgtgatactgaaaaacttcctcctagttattgtttcaaagtgctgttaagaacataattgtgcagcgtcaaggatacattcgttatgcgcagcatgaactgattcttaatcaagcagtatggtctaccatattttgaactaaccatacaattttatccattatctaaacaaaactacatagctgaataatacatacatcgatcaagaggcataaatcagacaatactatggaatctgtggatgaaacagggtccctaacaccatacgctagtgaaaaaaattgatggtattgaacttggtaattggattaagaaaagatgaccacataaaacgattttctaggcaatgattcatagttatgagttatctgaggacctg

SEQ ID NO: 32276 - DNA, 1501 bp, Oryza sativa
tctttggttaatcgcttgattttcttttccatcatcaggttggttattaactcgaggttagaacatagttcctctgaaatgagaccctaggtctcctttgacagtaaacaattatacacataatcccatatcagcatcttctgaaagagtcctcatagaacttgtttttattacacatttctcccatattacatgaatacgaggcactaccttaaacaaaaagggaaggtgcttaacatcggtacattgtatcctcaacatgaatcatccataaacatagtaaactcactgtttatagacatgaatatatttatttattacatgattgctgcaaactttcgattacacaatgataagtagcgaattgaaaaccacaaacgtggctgctcattttgattctggagagatatagctggcattgttctagtaactgcatcatccttgattggttctgtgatgatgtgataggactgcatattgctatcattcacgggagaaacttccttctgattgctgtttgaagcagataacggtcttctgcttggtatcgccctcctgaggttgattgcccttcgctcagcctagagtaggtcggggagagaaacaacttcttccatcgacgacaattctttgctgaggccgtaggtgcagagaatggttggtgctgaaggtattattgttatgatttattgcagagtcaggtgcagcaggaggagcattggtgctgtggatgatatcgtcgatgttgctgttggagctgactagctgatgagacaatcgtagggttgttcgttggatttctgcggtcttggtcaacaacacactgagttggcaatccgtgggcacatggtttgtaccttcgcacagaaaacatgtgaccttgtgggtgggacattcacctggcggatggtcttcttcaccatgagggcaaagtgtgagacacctgctagcaatgtgtccaattttctccacaacgggtgcatgcctttgattccatctcttcctcgccgagatgtcggggagactcttcttcatcatccgaggagacttgatctgacccttcactatcagatactctgccaccatggcttaggaggtgctgggtcaactatcgtgcacctcggaaggtatttcctctttgacgtctaggaataggtatccctgctggaggccattcggtgttggtaatagtcatcttacgtacttcttcttcagttcgcatcggcgcttttctcttctgattcttactcttcttgcctttggcttgcttagtacgtgaccccacgtggtacgaaaggctaggaggaaagcatttcccgggattccatggattctctccattgggctctctactttgcacactaggctgcaagcttgacttggtgtgaggaggctggtttagcgatgtctgccctgctaaaccaaaggaaggggcttctttggcatatacccatggacaattcagggcatagtgtccttgttctctacaatcgtgacaaaa

SEQ ID NO: 32277 - DNA, 1501 bp, Oryza sativa
gtttttatttatttttatggaacctttaaaaattaaatcttatagtttttaaggtttattatctcattagtttttatttttataatttttataagtcccgtcaaacaacgatacctttgtatactcctctaatgataatacaataatagtgtattgcgagtagagagtatagagaccactgtaaaaggttcccagtgcataaggccaataaccattcacattttagagcttgccacagtaatagtccgccattttcagaagctttctcaccagcgctctggccaaccaattgtcacgcagaaagctgatgaccgcattgctgctctcctgcatgaagccaaccacgtaggctgtcccgatgagctcggcgctcctccaccgccggatcctcgcgtactcacgcagacccgcctcgatcctctcgctctccgcaccgccgccgccgccgccgaggatggcgtcgccgaggcatctcgccagcacgacgccgtcctccagcgccgcgcagccgccctgccccaggtcgggcgtcatcgggtgcagcgcgtcgccggcgacgcacacgttccccttgcggatgctcgccagcagcagcgagagcggcggccggaaacgcagcggcgcggtgagcacgtgcttcgcgtcgctcctctcgatgacctccatcacctcggctgggatctcggcgctcctcagcttggtcagcacgaactgcttcttcttggctagagcatcgtcatctagagcagcaacgcaccgatcaattgctgatcactaatcgattcactgttcgtgacactgtgtcaatgacagagactaaccgtgctcagaaggagaccaggtgaagaaccagtagacatcagtatcgttgcaggggatcacgccgatgttgattaatttcagctgtggcccaatgcaagccgattctctcggagctgaacgggaggatgaattagtctagcaggagtttgttagagatgcaaataagtcgcaaatcagttaatcgtgaccgagtctagcgctggcagtggcgcgggtgtgtgcatggagttcagagaaaagcggatcgtgggatggcgcgattttgcctcggattcctattttttttgcgttgagtataagtagttctcttagctctttattctttttgtaaggtttacattcagttgaatgagaaaaacccagaaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcggagtttttttgctattgccaacaagtggtatcagagcactcaggttgagggctgatctgacaccatggcgttggttccggcgggagcgggagcggatccggcgagggggagctcggggagtgctttctcctacccacaactcacggcaacgaactacaccagctggtgcattcggg

SEQ ID NO: 32278 - DNA, 1501 bp, Oryza sativa
gcttaaaggaaaaaagccaactttggcagtcaaagctatttgcttaccgatgagggcttcgtacagtgagtacaaccccatgaaggtgaggacgacgtcaacttcacgagttcacatttgctttgatcactttgttattaaggccgtgtttagttctatttttttttaaacttccaacttttccatcacatcaaaacttttctacacaaaaactttcaacttttctgtcacatcgtttcaattttaactaaacttttaattttagtgtgaactaaacacagtctaagagagaatggtggtattttaacttgtaagaaagtttcacttatgttcataaaattacaaagtgtgtattgaggttcgtaaacttgttttatcgtattattctagtccaaaacaacttggtttatcgtatcattcttgtccaaaaccttgtttgacctacttagcatgctacgtggataatgacatggcacttttttttttccctttttttctcccctctccctcagggaattttttttatttatacttttttttattaaaatatttacaaaaataatttgttgtttcgaaaatttacaaatctaatcgcctgccgccctttgagagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattagatggagataaactttatataaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaatatcgcccttcttaagggcggcataagggcggcatgcaattagatttgtaaattttcgaaacaaaaaattatttttgtaaatattttaataaaaaaatgtataaataaaaaaaattcctccctcaggagtccggaccggtttgctgcccgccgccggcatgtgggccatatttccttttccatggtagtaggccagtacaggcccattcctaggcagtcccggcccgcaaatttatcggcccaatatgaggggtgtcgggtcctacaagtcagtctccttgctcgttctagcgtgttcggtgttcctcgatagaaaagaggactgggggtttagctgcgcgctctctccctcccccaattttctctttcctcatctagggtttccgcgtcgccgcggccgcgagtcgcca

SEQ ID NO: 32279 - DNA, 1501 bp, Oryza sativa
acacgcataggcgaatcaggttcttcatcgtccaagtcgttggcctcacgattagtaccacgaacaatgacctctccttgtgtattaccctctactacttcttcccctcgaccttgcttagtctgccaaacattttcagcttgtccaccttccaacggagtttcttccaccacggcatgacttgactcccccgatcgatcaacacatgttgtcttctgcaccactattgccaggctatagcctttctcccttactttactaacaaacttcctccaactcccagttgacgcaacctccactactctccactgccatccatgttgacccctcactggccacacggcacttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactatattgccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaatttttttattaaactttcatatgcattgtacttagggattactaatgtataccttaacttcactgctggagggcgtcgccaaccctttcctcccggccggtgcctcctcggcctcctctccggcctgctatcccctcccctcgctccctccggcgctcacggcgacgatgtggcgactcttggcggcagctggcgatgtggtcacaaatcgaactcgcggcctgggtggacggggctttaaaccggcctgtcgaacgcccattgttcgacagggtcggtggagggccctgtcgaacgcccccggttcaacaggcctcgcggcgccgggtggtgggccctgtcgaactccctccgttcgacaggtgagcgtgtcgaacgccagccgttcgacagagctttgtcgactgcccgtcgttcgataggtgccctatcgaattgcacccgttcgacagggacctattttcacgattttccccggttggccactacttttacgattttccataaaaataatattaatttttttctcaaaaaaattccaattcaacgcaccctcgagtcagcactcaccacaacaaagccctcctattctcccgcaccaaccaaacccaagaggcgggggaagccatggcgagcgcgtcgg

SEQ ID NO: 32280 - DNA, 1501 bp, Oryza sativa
  unsure (1)..(1501): unsure at all n locations
acggctttacctttgtataacatgattcattgcggagcaccagactgagaagtgcgggaataagcccacgggggtcgctgggagtnccatgcttgtttataaagggggtgattatgatcaaggaatggtgcactgtggtgagttgtgttgtacaaagggtattgtcacagcctctattcgggtactttccagtatcgcgacgcatggtagacatgatgttgagnctgtgtcttgtgggtacagtggtacacctctggccagagtanaactattcgaatagccgtgcccgcggttatggacgagttgagcaatgtttttcgtgattagtctcacacctctcacaataattatggatgttataactggtaataatttgcttagctccggtttggaatggataattcctggtttggagattagatctgtacagccgggtatggttgttcaggatggttgggcctgtgcagcatgggtgtgctgttcagtgttgattaaaatttctgattaattactccactgttttacttctcttaaatgttttgttaaatgctgcttttgcaaatgagcctatattatgccatcctttggtatccttgtgcacttgcatatttgctgtgtggcttgttgagtatgtcatatgctcattcttgtaataatcaatcaacctcagttgaagacaagttgcgaaggagaagacgtttggcttataccccagttgagctgcctgtgggagtggagccggagctgcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgggcgtgacaagttggtatcagagccatctcgactgtaggataagccaaatggtcaaaccttaaggactaattttccgaaaacatgatttgtgaaagtttctcctttcttccttatctagaattctttgcaaattgtttcattgtctacttccctctctctttcaacttgagtagttctgaaactagttgttgaaacttgaagacgccaatgtggtctacttatggaggttaagtcaagtggatcgatgaataagaaggtgatggtcgatctgaagtgcccagatgtcaagatggaatgaagtttggatcctaccttagaacctatgccgccaatctatccttgaagaatagttagtagggaagagcgtttgttgtttgctttgtttgtaggtatggttgcattcccatcattggagtagttcattgatgagtgtgtaactatactaggttgcttgcttaatcaacttgaacaatataatggtctacgcacaccagatcagtggtaacctggttaaggtcttgtctttagtgtaacctctctccttctatcttctctaatatgcaataga

SEQ ID NO: 32281 - DNA, 270 bp, Oryza sativa
ttcgctcgcgtgtttcgtgccttcgtagacacttgcgaaaagtttcgaccaagcagccggtctttccgtcacctcggtacgtgttcaatatgttgcgcatatttaatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 32282 - DNA, 1501 bp, Oryza sativa
tgtgtaaaaaatattctaatatttgttggtcaaaaccttatcataatgaaatgaaatacaccttatcatgctgaatcctaatctattctagaacaagatgatatcaggtgggtactagacccggtaccctaatggtgccaacgacaacgctttgtgctccaacgccaccatctatgaaactcacaacctcactcatctggatctagctcgtcaactgtggaattgagcggtaggggcgcaggtgggtagacctcatggtgataggccctcaccatccaccgcaagaggcttagcctgcaggagaagagatggctcgtgttcgctagcgaggtggatcgacaactcgtgtttgccatcaggcaaagatggcgtaggtctagtccaagaaggcggtcggcatggagtacatgttttagcttgtgatgcagccaacgtcgacggcggctggtcgctcgccatggcctttgtggtggcacttgaccaaacggcgaggtcgggatggcaacaatgatcaagttgtggaaggggaagggtggcaagggcaccaccgcaagagaggaggttagcaccaacgggactatgtggtgttgtggtcttcgcaacgagaaaacaacgatgatatcgatgatcatggtggggtagcgaacaggaagaggaacagaagcgtgcacgtgggtggtaggcgcgatagcggatgtcggataccgtgcacatgcgttggaagggaaactttctttagcattctcgtataaatatatttggatggagtgagtattgtttgttcctaaggggattttaaaagcaccatgccacactttgatcaaactcttctttggaatggaagagttatgagtgttttcaaggacttgagctaaatgctttgaaaatcctacgccccttatggtttctttgaaatataggaactttacatcacgaactccgtgaaattattctcacacttttctatagaaaaaaagaggattggattaaattttttgtcaaaattatttgctatcattagtagagatatttgtccaaatttatagtattatgatatatcacatcatgtactatgtgtacttattttgaaacagacgaagtagtaacagtttaggacggaggtaatactccataataaattttctctcttaaatttaaaaatcttgattggacacatcccaagatgtctttatttcccatgtgcaattattagtttgaaaaaattattttatccattgcttcactgaatggacattttaaaaccagaccgagcatatagaactcccaagttcctgttattccctatgcaaacacacactgacgcacggcacatatattgtggttggtgatgcacgtacgaccgccacgttgatcacaggtataaattgcaacccatgtgcctagcactctccggtatgtgatcgatcgagatgccctcaagaatttgccggtagaatcaagtagaccatagtgggcactgggcggtacagcggttggttat

SEQ ID NO: 32283 - DNA, 1501 bp, Oryza sativa
gctgccgtgtcgtcgctccgtgcagcgccgtcgcgcgcggcgcgcccgctgcccggcatccggccctcccccaagccccagcccccttggactccggtgagcactgcctctcgccctctccggctctccctctacctcagtccctctcccccttctagtagaccacagtattatccccttcaataatcaatttctttgtatgattgtatctgtgattagccaattagggatatagtaatttgtatagattactacaaaattatgtgcaacaatgaacctcaaatgaaatttttgacttgtattgtaatatcctatttatctaagatgttatgttatgtttgaacaatttacattgtcctttaggtaagattcaaacttgtttgttattttctacttgtattgaaccatttagagttatataccgtatcacggtatcgtttataatttatcagatatcttatcgaatcataccgtattgcatttagatttttttttgctaggcctaccccgggttcaaatcctgggtccgccactgttagaacacacgcagagaactctggccacatcgaatcgatcgccgttcacgagatgtgctaattgattccatcggattttttatggaactgcagccaatttagactaggaagcatgaggaggcgaccgggaatcgcgggcttgcagaacgcagcggctactcgtgtatgtggacatcttgcttgaatagcttataatgttttttttttctttttctgtggattctgagatgagtgtgctcttggaaaatttaaggaccaattccggctggttggggaaaatgtggccaaggtcaggaccgatgtcatgaaggagcagcttgcgacgtttcggacacagctcgaagaatttgcacgcaagcataaggtgattcctactcctgtattctagttgagttttacagaaaatattaccgacgctattcgtatgtcacaaattgaattacacatagcatgctttcacaatcttcttaatcttggggatcaggatatatcagtcattcttgcagactgactgaattcttacattttttttcaactgcccagcgcaaatgaaatgaatgttctaacaaacatgaaaacagtgaagttactgctattcacttgattaaagttgtctatcgaactgggaaatagggaacctaagtagcatactagtccatggtcaagtgctcaacatatactaaaactgaggaacggtagttaaagatggaaaatgtaccaaagaaaaggtgttggagttaccaaggtgccaattgatcttgtttcttgtgatagatttcacttgtctcatggcatctagttccaactgggttgacatttgcaatgtaacactgatgttctaggtgatcacaatagagctcaaatggcacagcatattccaactcttaagtaactttgtgtacatggtgtgctagtgcagaatgatatccgtaaaaatccactatttagacaacagttccatgaga

SEQ ID NO: 32284 - DNA, 1501 bp, Oryza sativa
gcgatcacaaacaattaatgagctaaggggaaatgatttactcctataacatttgcaaattagcagttgtattgggtctaaactctaaagcaaccaggtattggatttgtgtaattgcaccttcggctttcctggccctattgtagaacggcacggccgtgtagactacgcctccaagcaccatctgcaccctgagaaaaatacgagagatatcaatcgcaatggttctcagaacagcagtacaatacggtatttcttcccccaattcctaccaaattggaagcatcggtaacggcgagaacccaagctgtcggtggccggcgtcagcggcagcggcagccaaatccgccggaactatgtcagatttccccagaacaacccatctgaccacacaaaccaaccatcttaatacaagcccttgacctaaaattctccaaaaatcaagcaagagaaagcgctgttcttgctcagagaccacatacccggagtcgatgccgctcgaatctcccgcaccatcgccaggattcttgatcccgctgcatcgagacggagcaaatccaacaaatcactcgatttcacatccaactttggttaaaggtaaaattctttagaaataagcaaccaagggaacgcataccttgggtcttcctggccgggttgcgcggcggctccggtcgccggcagcgtgagggttgccatggggagagatcaattaggggaacaagcggtaggtggacggagggaagaaacgacccatatgttattgccgtgttctatcgtgtttctgatgaagtgattagtcatccgcattaaaaattcgataaaaacgacttggagtagtagaggaggaagaggaacgagtacaatttacgcatgaggattacctgatgatcaatcaatcgctttcgtgacgcagaccttaattacctcccgtttacgtgggcctgatgggccgacttggcacgtactccttcgggacggcccagcaattcttatgctggcccgggtcatattttagtcctcccctcttggtccagtactcccagtcaaacgcagcagtgtcgtttcaaaatcgcaaggagaattcagagaccatcaaatacttggcggtggaaagtttcagaaaaagcttatcgatgatggtgattttgcgattgatctcccactgattgcgttaggatttggattaaatatattgcctaacagagccaacccgattccgtcggacaaaaattaccctaaacagcggcggcgtcacaaagtcgtccactgtcggccacataattaacccgtgcagtcgtcgtcttctccattactcgtagtattaagtagtgacacttcactgtcatggccccaaatagggccactaacgaaatctcgctgcctctctcaccaacgaactgaggccgtcagatgccaaaaccaacggggtagatctcttcaacttgctactgccgttctacagatacgggagaataactccttcagctttcctttcgcc

SEQ ID NO: 32285 - DNA, 1501 bp, Oryza sativa
gaagtttcgcaaattaactagctagaccttgcactttacagtgctgaaaaagttgtaaaactcgcagcggcttcacaattcagttaggaaaaatgaaaccggatatataggggctgttcagattgatactattttcaaacattctatttttttttgttaaagttgcaaaaaaatgtctacatctagtttgttttcaaatttgataaatacatatgaattccagccaaaattttgacaatattgacatattcggtattgccaaaaattagtaagatttatttggctacaatctaaacagatcttattttttggcccatgttatcaaaccggcccattccatttccgaagtagtatcacgtcatttctctcttaatatacaacaattgtgctttttctgcagctccgtcacctccctgtcactgaagttccaaagtaggaggctaggtgcagataacttgtgtcttgcaagtgtcatagatattgtcatatattcaaacaaaataattttcagttcacattttctcagtgctgcaaaaaatgtaaaactcgcagcggcttcacaattcagttaggaaaaatgaaacagaatatatagaggctgttcagattgatgccattttcaaacataccatttttttaaaagttgtaaaaaaatatctacatctaatttgttgccaaatttaataaatacatatgaattccagtcaaaattttgataatatcgacatcttcggtattgccaaaatttggtaaggtttatttgctacgatctgaacagaccttattttttggcctatgttatcaaaccggcccattccatttccgaaatagtatcacgtcatttctctcttaatatacaacaattgtgctttgtctgcagctccgtcactgaagttccaaagtaggagcagagaacttgtgtcttgcaagtgtcatagatattgtcatatactcgaacaaaataattttcagttcacatttttttgtggctgaaatctcaacggatgaattcccagaaattcggacaataacacaccattgtcccctgcaaacttctaagcaaagctctatgacttgacagttcgtgaaactcgtcctaaaatccaaaaccggccggaaattccaaagggggatttgacaggagtgataggcctacatgagcccaaatgcaaaaaggccccacaaataaattcagcctaagcccactaaaattctgtggataaaatcgcatctccgccgtgtgacactgacaccctgacccaccagtggggcccactagccagcggcaacgacctcctcccccctcttcggcttcaccgaccaaaccaacacaatcgcgcggatcaacagactcgagtaggggagagagagagagagagagagagagagagagagagaaggcgacgcggcaatcgatctgcccgcctcacctccggccaccgaccaccgccgcctccgcgtccctctgcctcacctcgacgccggctagcatcgccggcga

SEQ ID NO: 32286 - DNA, 1501 bp, Oryza sativa
cacgaatgatatagatataaagttctggctataaattagttttcgtgttgcttgacttgcttgctttgttcatatttctacactttatcagtcgtaactcagatgatcagagccatactaaccccttcaaacatatatcttgagtgaattttatattataaagtacctgaattttcctcttccattagtacacatgttgagccgcccatatagagtaaaaaaaatcatgagcatataagggatgaggaaagactcaaaaaatatcgaaggttcgtcaagtcaaggactggggtccaaaccgtttaatcctctttttttttttgggagactgctatacagcagaatcccgtttaggtgagacaataccggttaggtatcatgttctggtattagtaccagattctagatgttaatacttgttgatatcacctgatacttgttgatatcatagcgatacctaccagatataaggagtcaagcaccgaagcgtcatcgccggtggccgtatcttctgcgttgaccagatccttcactgtcacgccttacgccggagctcgtcaccggcggccctactattcacaccccacgtcggagctcattgccagcggccgcgtcctcctttcactgagcaggtcctcttccccgacacacgacggaggtcctcacaagcggccacctcctcctcgctgctcagcttgtcgggacaaggggatcccgtctcgccgaagctcgtcgccgatggccatgtcctcctcccgctgagcaagccctcttccttggcccgcgttgaaagtcttcgcaggcggccaccttctcctcgctgctcagctcgtcgggacaaggggatctcgtcccgataggatcccggcatgtagcatttccaagtgctaattttttcccttatatttacctgaattaaattgattcttataaaaaaaatctacaagattatataaaatcaatgtatttcaaacgatggttgaaattgaaagcctttttaagaaattcaaggatcaaaattgccgtcccgcgaaaattgtaaatgcaattacttagttgaaaaatccacaacaatgttgtgctaaatattcatttcattcttgaacaagaagcctattatattattcttggaagctttggcatatttacactttctcgagatccccgcatccaagccgtccatctcgatctggacggtacagaaacgtgtcacgcctctccatccacctgtcgcatctaccattagcccccacctcctccccccctcttataacgcgtcgccttcccttcgccatgtccgtctccgccgccgtcgccgccgcctccacctcccgtaccctcgtcctcgcccgccaccgctcgccgccggcgtctagggtcgcggcgacaagccgcgggcgtccgttctcctccggcccccatcccctcgccgtctctcccgccacccgcgcccccgccatggccaccgacggcgccgccgccgccgccgcggcagggtcga

SEQ ID NO: 32287 - DNA, 1501 bp, Oryza sativa
caaatagtggtgtgatcagtactctccatggcaggcgaactggcggaggctgggctcgccatgccgctctcaccttggctgactgcgctacggctagattcagccaaactgcacactgcttcgcgagttcgcgtgacggcccgggctgccacgagaacacactccgcggcgtggatttctacgggtctctgccgattttctgcagagtcgtggcgctagctagatcactgcctcactggcaagcaaagcaacaacacagtggtatgtgcatggctccaaataaccaaccgctgtaccgcccagtgcccactatggtctacttgattctaccggcaaattcttgagggcatctcgatcgatcacataccggagagtgctaggcacatgggttgcaatttatacctgtgatcaacgtggcggtcgtacgtgcatcaccaaccacaatatatgtgccgtgcgtcagtgtgtgtttgcatagggaataacaggaacttgggagttctatatgctcggtctggttttaaaatgtccattcagtgaagcaatggataaaataattttttcaaactaataattgcacatgggaaataaagacatcttgggatgtgtccaatcaagatttttaaatttaagagagaaaatttattatggagtattacctccgtcctaaactgttactacttcgtctgtttcaaaataagtacacatagtacatgatgtgatatatcataatactataaatttggacaaatatctctactaatgatagcaaataattttgacaaaaaatttaatccaatcctctttttttctatagaaaagtgtgagaataatttcacggagttcgtgatgtaaagttcctatatttcaaagaaaccataaggggcgtaggattttcaaagcatttagctcaagtccttgaaaacactcataactcttccattccaaagaagagtttgatcaaagtgtggcatggtgcttttaaaatccccttaggaacaaacaatactcactccatccaaatatatttatacgagaatgctaaagaaagtttcccttccaacgcatgtgcacggtatccgacatccgctatcgcgcctaccacccacgtgcacgcttctgttcctcttcctgttcgctaccccaccatgatcatcgatatcatcgttgttttctcgttgcgaagaccacaacaccacatagtcccgttggtgctaacctcctctcttgcggtggtgcccttgccacccttccccttccacaacttgatcattgttgccatcccgacctcgccgtttggtcaagtgccaccacaaaggccatggcgagcgaccagccgccgtcgacgttggctgcatcacaagctaaaacatgtactccatgccgaccgccttcttggactagacctacgccatctttgcctgatggcaaacacgagttgtcgatccacctcgctagcgaacacgagccatctcttctcctgcaggctaagcctcttgcg

SEQ ID NO: 32288 - DNA, 1501 bp, Oryza sativa
ccgttgacaaggtgaggatttccatgagctaaacgtgtcaggtcacaagtcaatcagtgttgatcacgcccatgccattttatagttcacacgtacattgacctacctgaaattagtgcaggattaggttagaaaaaaaagttaattagtggttgggattttcatgggcttcttctcctggataaaaccgtgtggatttggtccactctgaatggttcattcaaaatttagcattgcaagtacacaccttttagacaaacatttagacctattataagcctaccaaatctcgcatgaattgagttaaaatacactcaagtagatgcatataaaaaaatcagaaaaacaaacacgctattaaagtatgaacaaattttcaggtcaaccaacccagtctccttttgtccttacaacctaagcttagttattcagacaaacataaaattgccaaagaaagagttcaagaatgtatccccactttgaatatttttttaaaaaattaaaaaaaaaatcaaagaactaaccgaattcaaaccaaaggtacatcggttctattcgtaccaaaaattcctttgaaactactagtatatgattctcatcctctacttgttttgtttataagctgcaactaatatcgaaacgtaaccttagagttgatttaagatttttttcttttattctactaaagctattatccagtcttaataacctctataatataatttttactatacagacataaaaagttttacctaaactaataacctaataacatgttctttttccaatggtttatcaaccgacaagagcccaagatttaccaaaccgtttggattgggactactatcaccttatgatataacgattatcacgaaaaccacgtggttaccacgaagtatatcgtggttaaaaaactgaaaatgttatttcacacgataactgcacggttttatagacatttcgggagcccaaaagtttcagaacagatccacaaatgtggtgggcccacaccgccagcctctcccactgacacctaggccccacaagaaggacagggccggtgggtcccacgtggcaggccggaacaaagacccgtttaaacgcgcacggcacccacccactcctctctccctcttcttgtgtgtgtgtgggtgtggctttattggcgtcacatgcgccctcttttcctctctctgtttttcttctttttctctctctatctcttcgcttacgagcttaaagagacaacgagttaaagccgaggaagaaaaaaaaaaccaaccgatttttttttaattaaccggcgcctcctccttgcgcggcgtgcgttcgccggcggcgagatcctgcggcggcggaggaggaggaggaggaggaggaggagggggatggagtggtgggggccgggggagtggtggcgctggtagtggcggggacggggagtggttggttgggtttggggagtttggtgggtgagagagggggagagggagaggggaca

SEQ ID NO: 32289 - DNA, 1501 bp, Oryza sativa
cgtccagccccaccgtgcggatgtaccacacgtggtgcacatccccgccgccgccccccgcctcctcatccccgtcgccgaacccgtcgtcgccggggagcggcgcggtcgcggcccggcgccggcggcgcaggacgacgcggcggcggtagagcaggatcgtggagacagagagcgagatgaacaggaaggcggagaggagtgagacggtgaggaggaggcgtacggggaggtggtggtcgtcgacggccacgtcgacgcgcgggaccaccggcgacggcggcgggggctcggcgatctcgtagcagctgccgcctgggcagaccgggtggcagtcgagcgggtaggccgagcagtcgacggtggccgtcccgttgacgcggctcggccgctccgggtacaacatggcggcgcggaacacctagcgacgatccggcggtggcagctcggcggcggcgacggcggcgcgcatcggtgtgagtaccccgcggcggcggcggcggcggtggtggtggaattggggtggagacgtggagtggattggtcgttgttgttgggtttggtaaaggtttgggggggaatgcgtggaggtggagctggagagcacacacgctacgagtgccaaaaaattaaagcacagaatgacctaatcttttgtatgcagtcactgatactgtgggtccagattgccaagacacaaattggggcccactactcagtgacaagcaatcggttttgctgtaacgtatggtcgtgcacatagcagcaggcggcgacctcggtttacggaaagtcaaaggcgataatcctaattttgaatggaaacactgcaggcgaaaggaaagctgaaggagttattctcccgtatctgtagaacggcagtagcaagttgaagagatctaccccgttggttttggcatctgacggcctcagttcgttggtgagagaggcagcgagatttcgttagtggccctatttggggccatgacagtgaagtgtcactacttaatactacgagtaatggagaagacgacgactgcacgggttaattatgtggccgacagtggacgactttgtgacgccgccgctgtttagggtaatttttgtccgacggaatcgggttggctctgttaggcaatatatttaatccaaatcctaacgcaatcagtgggagatcaatcgcaaaatcaccatcatcgataagctttttctgaaactttccaccgccaagtatttgatggtctctgaattctccttgcgattttgaaacgacactgctgcgtttgactgggagtactggaccaagaggggaggactaaaatatgacccgggccagcataagaattgctgggccgtcccgaaggagtacgtgccaagtcggcccatcaggcccacgtaaacgggaggtaattaaggtctgcgtcacgaaagcgattgattgatcatcaggtaatcctcatgcgtaaattgtactcgttcctcttcctcctctactactcca

SEQ ID NO: 32290 - DNA, 1501 bp, Oryza sativa
ccgcccttatgtttgcagtcacccgtcagccgctcgtccgtctccgcccccgacaactccggcttgacgcccccacccatctgcaaactcctcatccatctccacccctaccgaatcaacaacatcctcaagatgctcaattcagcaacaggcaaagaaatcgtcaacaaagaacgtgtgtacagatggacgctcggcgcagacgtaagtgccttcttcaggagtttaggttgttaggggctgagctagaggagctctgctgctcgctgcttcatgggctccatagcagaaaaaccaaatcgagaagaaacagagaccaaacgaggacgaacacgaagcaagagtgagagggagaaacagatgcaaatgcagatgagatggatgaaaatacatgttagtggagagaggagagaggaggaagaagaagggtagtgagagagaatatgacatgtggggcctacatgtcagtggaccctacacttttttttaatgacaaatgggcccgcatattttttttattttaatgccacataaaccctacgtcaatgccacgtgggacaaagagtaaatcaacactgccatgtgtgcgccacgtcagcaaaaccgccctccaaaaccactaagggagtcaaattgcaccggttttttaagtttagaggttaaaatttctagtattacagttgagggatacaatttagattcagttgtcagttgagggagtcaaagtgatcttattccttcggcgctcgtttgcaggtttcctgggcttttcagaccgtgcggtgacccggcccgctcgtagctgcgaagacatccagtccgtccgacggcgcgctgtcattgatcggccttcttggacttttgagagcctttgcgcgcgccgcggcgaaggcctccggcccatcgacgaagcctccagcactccaagcagccgggccgtagctcgtgcaagattgcaagtcatgcggcacacgctcgcgtcgcggcttgccttggacctcggagagccgcgcgcgcgcgcgctcgattctacgccccagtttgcagttggtaatcatcgtggctgcctgctctctctcgccgccgcacgcatcggacaaccgagccggctgcgccgtgtttcgaggagaagcgtgcagtgacacactacaacgacgtgcaaagcttcaagacgagaggtggtgagtcacgcgtagcaaccggtcgtatttgctatctcacatatttttctccacgggcaacagtacatcgcctgtcttctcttcgcattggaagatatcgcatcttcgcgccatgtacatcagtacatgcagacgcaaacgttgaaaacacgacccacccttgcgtgtttttctacccgatcgaccttctgattttggctataaaacggccggtgcacactaaaccatgcaaccctcctgcagaactaatcttttagacactctgatcttgtactccagtttccagatacaccctgaattgattacgatgacgacgacga

SEQ ID NO: 32291 - DNA, 1501 bp, Oryza sativa
gcccttcctgcagagataaagaaaattacaggatgtgtaaagcatgcatatattatatatatatgtagcagaaaatgctttgcgagatacattattggcgcgtatttcttcgatctgatgcatcactttcgccaagtgaacggaggatttgtatgagttgacaagtgtgtcgattgcttgggtagtggtcatcgtcttcccgtccagacctacctcaatgtcctgatgaatgcatcgtatagaagggagtaatttatttaggacatttagtcactttctttttgagaaaaaggatatttattcactgattcagtgcattggctagcttgctctcccatgatttgcttctcaccttgtcgaagtccttgttgatggtcctcagaaaatggtcagaagggttcatcagagacggacaagggaatccgctcagagcggagaactaataaacagtgaaatatagtcaataaaaaaaattaggaagtgcttagctagcaaccggaataaattctcatgatattagtcaatacaaaatagcatgtacagtcaatactcaattcaagtttgttaagtgcttcacattcagatcaaaatctcacaatatatatctctgtttcatttttaagaaaaacaatatatatcttggaccctcccgagatttttttttcgaattggatgaaaatttctgatccattcaaatttctttaaatctagttgaattttttgtttaaagtggttcagattcagaaaaaaaaacattgcatatgtattccttttcttttgtttaaagtggcggggatgctgttttgttcaacaaaaataagcggcatagaaaattttgctatacttgttcaacactgttttgattttgttccacaaatgctgttttgttcaaccctattttgattttgacagatcacagatttgctagggaggagaaatatgctttccatcacgaaactagtgtgacatctcacggtctaggttactccaaattagggatgaaaacggttcagaaagtttctgatttccggatgtattttcgaaaacagaaagtgtcggaattttttcggtaagtttcagaaatggaaacgaattcggattttttttcttgaaaatgaaaatggatacgataaggctactatccgtcagaaaccaggatcgatcgagaacttttcataaacaaattcggatttttttcctcagaatcagaaatgaagtacttctcacatacaactaatttgctctaaccttttctactctaaatgtttagatttatactgagtacactgagatggttaattagttgaatggagatattgttttctagttcagtactttagatctgtttttcttttttcctaattactatttttgttttactaggccatgccaaacaaaggttgtcaatttcagtttaaaatttcagtaatttcgccacccccactggcaagtaaatatgtcagccagaatttttgttttttcccatttttttgtgattttg

SEQ ID NO: 32292 - DNA, 1501 bp, Oryza sativa
cctaaacggctaggtgtcgctcttgagccaccattttacatgtggttggctgggagaagcttgtgcaggttagatctcacctccgaaagagaagtgttttgtgcaacctcttgaagaaagggttagctaaggccggctctttgtgagcccctcaacagagagtagaattctctcaagaattcgaactccaggaataacttcgtgtgtaacatctttggtgatatcactttctccctctcctctagctttgcttgattgtgccactataaatctagttgttgtttgtgctagcattttcctgtggtaggctgttagatctagaatctactttgattcacgcctgctctgttattttcagaaattccgaaaaccatttacgaaaattccgaaaatccctgcttccatgtttacttaagttttttaattagcctattcgaccctccccctaaaaaaaactctagacctaattgaccctttcagtccattttatttataatgaaatacactaccaacccttgggagtaaaaactataatttgatcaggttgaacacatcaagatgatatataatcgtgcttacttcaaaaatcactcctgcgccccttttgagtgccatcaccaccaattacataaacctggacaacgcacaaacttgtaatcaacgctgattgtaagatgtttcgattaggtagaagaatcttcatactatccgtaaattgattcttaaaacagtgtccgaaaagtaataaaattgcattcatttcctttacctgatttataccacgatcctggatgctgtcaacaatcttcatggtatcatggcctccacgtgatgtcccaagaacagttccaccccttgaatgtcgtttacactctttggagtctaattcaatggtgttagggccccgaatcgcaggaatgcctatgttttctcattcctacgattcaaagtgtaaaacagaggattgcaaaatacagaaaaaacaggattggtcgtttgattggaccgcagaaaaaacacaggaattagaggagagataaagactcaaaggaaagtttccaagaggttttacctcatgttagaattcctccaaaacatgcatggcattagccaatccataggaattttataggattctataagatctattcctttgattcaaaggactatataggaaaaaatcctataggaatgaaatcctctaaaattcttatgaattttctttgaatcaaaggggcctaaacctctatacccaatattagaggaagacagtgctccaatattacattttaattttcttagcttttgtaatgtcattgatcattattttccatacgacccttaatcgcacatacaaaaaatattgcagcacacaagcgattttaaagttaaagaattagtttcggtagtattcaggatgttatattgagtatagagattggtgcaaaacaaattgcccattgttcatatgttctcttcaataagaattcattgccagatg

SEQ ID NO: 32293 - DNA, 1501 bp, Oryza sativa
tttggctatgagctatatggccgaaattaatcaaggattttcttcatcaactatgataagcgggaacgggttcaacaatactattacacaatacattaggaccgaccacggcgtcgtgagaggaaacgccccgctacctcaagttgtagtttcaccaaaaggtaacctccgattcgcccaacccatactttgctattcaaaaggttaatgatcgttgtgtagatgcatatgctacttctagttttgcttctatacaatatgcttataatgctatgggggtcaatgggtgtttatatggccaattacacaggaatcggctatatgcaaaatctagctaacggtatgactggtcatggcaccggtctaaccgcatcctatgccggtcagaccgtgcccaccatggccggtcagaccgtgtgctacgccggtcagaccgtgcctaccatagccggtcagaccgtgctctatcctggccagatcgcgcctcctgtggccggtctgaccgcaccactgactaccggtcagaccgggctatctatagccggtcagaccggttccctgggaatttctctaggttttcataccacgactagcagtactgattttaattattattcatcacctgttaatactgctagtcatgctattccacatatccctaatgcctacaatgatattaataggggatatcctcccgatactaggtatggccaatataacaatattgtgccgcaacaaccaccttctaggccaccaagtccaccaccagatccaccaaggcctaaaactgtggaggattggtttagaaatactatcagggagaatttcgcaaagctaaggaatcttgctagggagtaccaaaaggcgtatcctgattattatgacattatcccatatcctcgtggttataaaattcctgaatttaccaagtttagtggtgaggatagtaggaccacatgggagcatgtagatcaatttttagcgcaatgtggtgaggctaattgggatacatgtaaattgcgcttgttttctttatctttgtccggtactgcttttacatggtttacttctttaccggtaaattctatttctacttgggctcaattagaacaaaaaattcatgattattttcacactaatgaaactgagcttaggttgtctgatttaacatcggttaggcataaatacaatgaatctgttgctgattatatcaagagatttagggatgttaaaaaccgatgttttagtttgaaaataactgacaaagatttggccgacattgcatatgatggattgcttgattctattaaagagaaattgaatggccagatatttcttgatgttgatcatgtgttgcatgaagctctggctcaggaaagccgagtggatgacaatagcttacgtgctagtatagatgaaagtgcaatatcatgtatagccgaaccaagcaatggttcggattgtgttaataatttgtgcaatgatgccataacaattatag

SEQ ID NO: 32294 - DNA, 1501 bp, Oryza sativa
tacaagtaagcagatacctgtgtgatcacggatctgattcccacttgacgagtagattggaaaactgcagcatcggtattgatcattactgttccttccggcggtggaatccaccttggaatggaggaggggagatttggagcaatgttgcattatcatatcgacataaccaaacaccttctgagccacgcgccgaggatgcagggcgctaatcccatttcttgcattgttccttgcttccctgatatgccaaaaagttactataaggacagtgtgttgaaagcttgaattctgttccaggaagtcaaaaatccaatttctcaagtgcatgatcccccttctcttcaatttgatatcatatatctgtttaatttcctgccaaacagagctagcaaaggggcatgaaagaaagacatgttccaacgtatcatccctattacagaaaacgtagccgtcattagaatcaatgtgacgccttctcagctggaagccagtgggcaaacaatcttggactgcacgccagaggtttatcttcatcttcccaggtgcattgatcttccacagagctttccagcttttctgactctccagtagagaagaaggaagtcctctcccattgttacactgtgaagcaaggaaagtgttagaccgtgccaagttataagccgagcgcactgtgtaggtgccatgtttgtcgtgtggccaggacgtgaagtcctcgtcaccaaaacgattgatagggatttgaagtatctcattggcaattaaccccttcctcaaacagtgccttgacagtatcactatcctaggcatttgcttcatcattcatcaggactgcaccttggtatcttcaggaattgggattagagttttcagatgtcccgcaacaacgccgggatccaattgtcagtgaggatattaattgaactcccattgccaacaccccaccaaaagcccttcttcaccaagtcccaagctgagttagcactgttgattcgggttaaattgtcacattggacaaaaccacctgctatactaccatgagacacatattgcaccggtttcaacagttgagggacagggacccattgtatccggtatttcggtgcaggaacgaaatcaaacttgttttcaagttaaggatctataaatgaacttatttatggaactgaagggaaacaaggcccaacatcttattgggcgtagaagacaactagcacatcaggtttatggcgtgaaatagtgggcccataactactctaccgcgcgtctccagcccacacggagcccggcccaactaattcacctcgacgacctcctcctcctcgcccagccgcctttcctcctcctccccaccccgcatcactcgccgccgctcctaaacccctcgaagagaaccccctcctcccctcgcgccaccgccgcccgcatccgcgccgtcaccgggagggagagcagcagcggcggaagcaggagcagctcgcgcgagagagggaggaag

SEQ ID NO: 32295 - DNA, 1501 bp, Oryza sativa
acaacattataaaaagaaaaaatataccatttctaaaccatttaagtctgtttgtttttaatgttcaattcctccagattgctcattgttggaacttttcttgtctaggcttcagacttcttacatacccctgagtataaagctctcgatgactgccttgcagaaataaaaaaccttattggccctgcctagagttattaaggtgggtttgagctatcttaattttcatttccttaatgaagttttgactgtggtactgaaattcgatagtaactgctctagagacaatagtgaatgtctaatttctgtgaacctctggaagtaattatttctctctgtagattgggtagcagtccagcgagcagaattatgtttaattactgtaaataccttttcttcccattgacatattttgttagaaacatggaaaggtattcattagaaatcacaattaggtagtccccggcttacctagtcaagttattgctgccatgagcttattttatgactcgcttagtctggtggtgttgcctaccatcagtatttgccatcactgcatatctgtcgtgtgatataaatatgctccaggaaaaatgctcagcttagagcaagtctaatagtgtagtaagctattagctccaaaaatgaccatgtcaggaaaatatttggctttaagatggtttatacaatagttgggctttagcttgtctatattcacgaattcaattttttaatcagaccataactgcaccattcactcatcctcctgctgtattggctgcatgccagtgaaaattaatgttgcatcttgtagcgcgcgaggagctaggtcactcttgctctctcgttcttctaatctcttttccaggtcaccagcaaaactgagatggcactcctatcgtgggctgacgtccttctttagcccagtccatgattcagttcctgtttccttgtagatctcgtcgtgaatcaagatcacctcgtcagaatattcctgagttcccattgaagaaatgacgacaagcatcatcacgggagacggttcttaacacatgcaacttaaaagttatactcctgtgccaggaaaccatggtggaagagtacctgttgtaatcttaatatgtaattttagcagcatatgtggtcatatgaggaagaaggtctgcgcaattttgttatagctatgttttaactgccagtacttgttatctgaatagttgcactctgaagtctgaacaccctttttcttttgcatcagccatctgatatgctgggaacatttattttactaccctggtttcgaagtcaagctaagcgacatcaaattcaaacaacctatggccatctgatgactcatactggtgtctcccttgcagcatgccttatggtgtccactgtggcatactctgatacccaagccctgtcttgtttttctgtcaccttggtctgcctactttgagtttgagaaagataaccgagggcacgtagcatagaaaccaga

SEQ ID NO: 32296 - DNA, 1501 bp, Oryza sativa
attaaccaaatgaccaagcttctccactccgcctgccttctcatctgcatttcaggcgccatcgggttggccgcggctgctgccggacacccaggctgccagacgaggtgcggggacgtcgacatcccgttccccttcggcatcggcgatcactgcgcgattcacgagggttttcggctcgagtgcgacaacgccacgaaaggcaccagcaatcagaagcctttctggggggacttcgaggtgatcaagatctccatggaagacggcaaggtctgggtgaaggcgtacatgtccaggcagtgctacgaccaatccacgggcggtatgtcatacagcgacgcatcggcgaatttgagtggttcatctttctggttatcggacacggataacaaaattaccgtgatcggatgcaagactctcgcctacatgacgaccgattctgtaagtactatttcagtataatttagtaaatctgattttcacaaagttgtaaaaatgagtcacccttatttttattttacttttttagaaactagaaaaaaaatacccgtgtgttgcaacgggtgaaaactattttaatcatattattgttagatttttttaaacaatatatgggatttttattttgatagtattgatatctaatttggaacttttattagaatgatggctatatcctacgttgctattttttatgctttagcaagaattctaaagcaattagaagtccaactctcgtcccaagttaatatgcgagttttttaaaaagatttttatacgactctttatgtacttttaaaagtgaatgaacttagagcatcaccaacagtctatctatctgattttcaaaactgatttggagggattttaataaaaaaaatagctccaacagatcccctactcacctacccaagttttggagttctcttctcccgattcctcgctccgtttatatgcggatgcgtgttctcgcaaaagtcgctcccaatctcgcactcccgcatctctcctcccgttcccgcgtgtgggagatagcgatctttttgcgatggaagaaaaaatagaattttttgttagtagtttaacaaaagggtccattttaagttttagggatttaatttaggctatctgttagagggaggagttttttcacttcctattttcagtttaggaaacccaaaaacaatttttggagggaagattatagataatctgttggtgatgctcttaaaaactgactcaaatacgaacaatgcaccaaaatgtcaacaaaaatattttcaatttttataatagtagagatagagatttatagatgtccataaggggtggaccaaggtttctcataagacctggaccagcttatgggcatgtttgggggagtttctagctgttgcagcttctcctagaatcagaagctccccccaaacagtccagcttttggtccagattttgagaagctgtagttgtagaatctataaaatgaactagaagccagctt

SEQ ID NO: 32297 - DNA, 1501 bp, Oryza sativa
agcaggtatcatccatcttccagagatggccccagtaatactcaccacaggaattaccgtagacaaggaagataggtccaagtaagcaaagctaagctttcgacaagatagagaagctgctcatggcagtgcagctgctgctagagctatacttatttagtagcgtcgagttaccattggtgcattggtggtgctcccccgatgcagaatcctcccaaaaggatttctggcttttgtgggcgttgcaattttttccggccctgtggttgcgcacattttaccttgggatgccatgtcatgtgatgtgacattgtagttcgtttaccccggatacataccgatagaaatccaaagaaagagatgttaacttgcatggtggtgcgttgcgttgcagcctggtgcggttcgtatgagtttcagttttactgctggtgtcttcagagttctgatgtcgctttggccgttggttgattgagatgttgcaattgcgagtcaaaaatttcgttgacaagcactatagagcattgcgtgcgtaatctgaaagaatatagtttcttttagtgccgtactaccaaacacaaaaggtgctgaatatatatatttttgatttgtgcgacacgtgccatgtagcaccacataacttggttcgatgaacgcgcagcaaagaagggcgagttttgtgctccaaaccgtacacgatagtgcacattactttacatgatgcttttctttatctccctatgtacatcaaatttttagctgttttttactccctccgtctaaaaaaaaactagtattagatgagatgttttctagtataatgaatgtggataggagtatgtccagattcgttgtattagaaaatatcacatccagtactaggttgagtttttttggacggagggaatatgtggtactacacatcactgtgttgcacgtcttaaaacggtcactttttataatcaaagttttctttggactaccttttctcaatctttacgctttcaaacaagtaattgtgttttcttttttatggtttaccaccctaactatatagtgtggctggggtaagatagttgacgtgggtgtgccgatgtgtgcttgagaatatagggttgggtggttcaaaatgtaaaaagcaaaattacttaattcaaagtaacaagattaataaaaatctggtaataaaaaatgactcaaattacgattcgctttaaaattattttcgtcattgatgtgtgcacatctgagtgcactttggtgattaggtacgcaactctcttgtcaactgagaccgcaggagcctggagggcaatctgtacacattttatacggtagtttgtggaccatacgcacttggcagtggagtttatacaacttaggactcttttgattaaaagaaaattcatagaatttttttcctatatagctctttgaatcaatggaatggatcctataaaatcctatgaaattcctatggattgtcttttcccatgcaagt

SEQ ID NO: 32298 - DNA, 1501 bp, Oryza sativa
taagtgtttaatgtaggcttcaaagaaaggctgttgtttttgcaattgattttatttgaactcttttctgaaacaactaagtgagtgcttctcaaacgacacggatgagacagtgcgtctcgtccggtcggagtatgtgcaatgtatcagtcttttgaattgatcaagattggcacccggccaacagctttcaaacggccacccgggcctggctgatcccatcagccgcagattttccaaacatcaaacccatcccacaacagcaaatttcataaggcagtagtcaaacaaaactacgctaggaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaagggtcccagaccaacaccagattaggtcccagaccatattgtgccaggaagcccaggggtcctccccgacaccaccccggcgaatccacatgtctcttagcatcatggctctcccgataagctagttactcagccaggggtgtcccattccacccatgtggtcgtacttgtcttatgttcggatgaaattccaaggaaacagtccttaggtgcaagagcgggaaaccgtacacccggtacgttccccggtccgcggttttggaaattcatttagttcgcaagcaccgacccaggtgtcggattttccaagtcttttgtaaaacgcaagttttacccaagatgtttctcagattttaagtttgaaggcgaccgtcgatacccgtgcagagtgcacgattaccgaggcgcaactaggtgggtacaagggaacatggtataacaattacaatggaatggtcaaatgcaacaaattaggtaggtccgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacagctcagcaaacggcaaaaataaagccctattattgacctctaagcgtgccattcgatagatctcgagatttgaggaattttggaagttgaacggagtcaaacggacttacggttgggaagatattgaatttctaagattattggatttttggtctaaaggaaaaggatttatttaaatcctttttgaaaaagaaaagaaggagggagggaaattagacttccctcgggcggctagggcgcggcccgagagaaaggggcggctcggccgagcttaatgggccggccggcccaagaaggcggcccaaggcgcgcg

SEQ ID NO: 32299 - DNA, 942 bp, Oryza sativa
tgctatacaaaaggtaaagccgttgcccacgctggattgtggttggcacggttaatgtttcacaaccgaaactcgtgaaccggtccttaattttcatgagcacgactctcaaaaccatgtgctcacaacccaccattatcaagttttagttggcaagtaattaattaaccaatcacgattgaccatcgtgaactatcattaagccaacattaaataatagtgagtcataagttatcccaataatgtgctaatgtttctaagcatggctaagcaatcatatctaatatctagctgaaccaatatatatagtccaactagtcaagttataataacccaaggtatcaaggaataaagtaatcaagaacaaaagggctataacaaacaataggttaattccacccaatgacattcgaaaataaatgcaatagttgaatagaaacaatagctttaaacaggatcaacatgctcaaagggttgtttgggatctgtgtgacttgccttgctggccttggaactcttcaaattcttctcctgtaaaaacggactctccggaaacgtcggaatctaaacagaaaggtgcaaaatcaccaaaacagcacataaaaaagcatgaacagtacatgtggatatttttaacatgtagatctcaattttagaaaaatttagagacttgaaccaactaaatccgagctaagatgaattagttatgaattttcaaagattaaatgggattaaatcatttatttagattttaattgaattatgacgcaataatgaattatttttgaaaaggaaaaggtaattattgcgtcagcggttagggttcgcggtgaaccgggtgcacggcggcggctcacgaaaacgaacgaccgagatctttccatccaaaacgaatggccgagatcgaccggtccacggccggcccacgggagacgatgacga

SEQ ID NO: 32300 - DNA, 1501 bp, Oryza sativa
cacattgagagatactgactgctcaatcgctttctaacatggtgagctagctagctgccatgtactccctccgtactcgtaaaggaagtcgtttagaacaatatttaagtcaaaccttggaaatataaatcataaataactctcaagttgttaagtttgaaaatgtaaaaattatatgaatagatttgtcttgaaaaatacttttataaaagtatacatatatcacttttcaataaatatttttatagaaataagaagttaaagttgtgttttaaagaccgtgtcgctatactaaacgacaacaacttcaacgagtacggatggagtacgcatatacccatgtggccatgcctacctgacatggttacggcgcagcgactagcgagccaagtcgtctagactcgagaggagcaattattgggccaagttccttctcactgtgacccagtttactgattaggccgagttctctgcctcattggccatttggcctgtgtgccaatgaaaacattgagttggatatcaaccaagtagaactacacgggagtggcactgatgcacgcctcttatgtaggagtagctacttaactgcaaacgatctatataatgtctacatcagagatatatttttctctttcaaataaacaggccaccactgaattttctggtatactctattatcaccaaaattgtcctccatccattttcacaccaatcttatcattttccatatgcatgaatgtgatggatgagaaaaaatgtttgtccagaatgtctgatttgaccaatttgaggtaacaggtcatgcattttcttggcaaggcattttcattttcatagtactcctataaattttgacaagattttgggaagcttgatatggtggtggagtcatatgtgcatgactctatctgtcatggtagaaatggtgatatccactaatattacacacataagtacgttttaataggaatttagtgggatcatggatataccacctatttccatctctttgagagtggggacgaactcatgtggtgatgagcgtgcatgtgtgtcatctatgtaaatgaaaaaaaaagattttaattggattatgaagttaaaagttgggctcaaccccaagctggctcatcgttatcttggccccacgagtgaattttcacctatgtatttttggtcaagaaaagaaaaacgtgcaaaattgtgataaaatgggctgaagtggtatacacagagatatgataagtcgttttgattttttcctaaatcagaaatctataagttaaacctaatttatggagaaatgtagcactcttgtaacaccaaattagtctaattaatcctaatatgtttgttgatattaaaaatgtttgctctgtttttctataaacttaattacacttaaacagtttgactaaaaaaaatatcagaacgtcttaagatatgaaacaaagggagtagaatgttagtgctaccaaagttaccaagatattttcag

SEQ ID NO: 32301 - DNA, 159 bp, Oryza sativa
  unsure (1)..(159): unsure at all n locations
tccttactcgtctcataggttttttctatgtggacgagatttatatttaccgctcgtgtcgcgtgttntnttgttgttatttttataattctttnnnantaaccnnnccnnnccnccccaggggttttgattgcagatccnatgctcgccgcctgcagg

SEQ ID NO: 32302 - DNA, 1501 bp, Oryza sativa
catcgtcgacgtaggggatatacgattttgtttttgtatgtgtcactggtttgtggaatgtatcatttttgtatccacaaatggcaaaagggagaagagatacaaggtagaccacagcgtggcacgtgtgaaaacagtaatactaatagcagcataagtaaaaaagaatcagatatgttcagtatttcaagtgaacacacgaaaataatgattttgtttggctatcatgcaccatataggcatatatatagtcgttttgtttttctatctgtcactagtgtgatgggtcattgttctcacaaacggtgaaagtgagaagtggtctaacgacagtgaaaacctagctggcacttgtggaaacagtagtactaatagcggcataaataaacaaaatgtcaaataagttcagtatttcaagtggacccatggaggttttggctgtcattgtgtgatgtgtcgtactgtcattgtttcacaaatggcaaaagtgagaacaggtctaacggcgaattagtggcaattgtggaaacagtcacaaattaaaagtgacatcagtaaacaataagtcatcaaatacacagtatttcaagtgggcacaccaaaatagtacgagaagattcgtatctcagaaggcacatctgcaataatttaattccatttatttcttatacaaatcaacccaaattacgtttcaaggtactccctccatactcataagtcacaaagaaagtcgtttagaacaatatttaagtcaaaccttaggaatataaatcatgaataactcttaagttgttgagtttgaaatgtaaaaattatatgtatagatttgtcttgaaaaaatactttcataaaagtatacatatatcacttttcaataaatatttttatagaaataagaagtcaaaattgtgttttggataccgtgtcgctgttctaaacaacttccttggatggagaactgtataaacattctctctttttttttactggactggaatataaacaatgtctttgactggagggggagcaataactgtgcgttcccacgagggtcaaaatattgagaaagttcccacgcttcagtgcgtcagttttttcttgcttgtggccttcaataaattagtcaactctcaaatggaacaaaacaactgacaggcaccggttttttgcgtcgccgagaggtgtaaacagcacgtacatgcatctttcttctgccttggccggcggcagtacgagacccgattcagtggtaaaaatgctgaatccaagcttcacagcctctgggttttctatccattctcattgcctcctcgttattcaagtttctgcatagaattttctaacatccattcatgtctccgtaacaggtttctaactttcaagcacgagttctgcatggacttgatggatacgtcacaatgataatgcattcatggtcagacagttcagtccgtggtagcgacaagacgtacagccacaagcatttagtcaagaggatgtg

SEQ ID NO: 32303 - DNA, 1501 bp, Oryza sativa
aaaataaactacgatgaaaaaacatctaaaattaactccaaatctaagattaaaaagtcaaatttaagtataagaaaaagatgaggctggaagctcctcaaaattgtagaaaatctttctcacatgttttctatctcaaaaattgttttatatatttttgcgtgattattggggttgcctattatgaatatgggtgaattactaaacgtttggtcggacctaattttagtttttgaagcttagataaagaaactatttatataatattcaagtgaaaaacttttaaaagtaactatttatataataatcataatgtaattgtattgtaaatatattataattacaatataagttctacaaaactctcatattattaaacaaaaaccaaaccatgcgtagccggttggctagcgaggcacatttttacctatgaggttgctggtttgacactcttagcctcacaagtgacatgggaatttttcttcccttccctccatgaatctcaacacgatccaatgatttaaagaaaatttacaagtcgaaactttaaaaaaaatcataccgtcaattgtatagccatgtgaccgttttcctttttgatgatgataaacgttgaaagattatagtaccagcggtgttgtaatattcgagtactaatatgtggacttcatcaaatttcacggccgattatgaaatattctagtacgaataggtggaccttttcaaatttcatgaggggcaaacagtgcgcatgttttatagtagtatgcatgatcttgatccaacacttgttttagtggaaagcctgaatgattattttcataccaacaaatctttatactgataatatcgggaaaaacattcatgagactaaccaggcttgacaaattgctggcacgactgctactgctcgcagataacataaaacagtcaaggtttgcttagtttatgatggcaccatcccagctaagattagttgcctaacgaaatcctttgaaaggacatgattggcttggaaactaatcaatgaagccccatgttgcatgcattctctaatttttatttgatgaatctgtagatgattgattgttattgcccttctctcaaaataatttggttcttcgagagaacaaaatgatgcacaaaacacaccgacatatactcctacaagatttcaaaagaaggaattgagtatcttgctagtaccaaacttatttcccaataatgtactttcctaaccaagttgacacatgcaccttgattggtttacaagttcttctattctcatttgtgttcaccaagattttaaaaagttccttttccccttatgaagaatgtgttcttacaacagtggtactacaagattagttttttaatagaacttcaaatctttaccaattataattgattttttctttatatatattcttgtatgttgtacgggaggagtgttgttatacaattattttcatgcatttgtaaccaactcctaaataatgat

SEQ ID NO: 32304 - DNA, 629 bp, Oryza sativa
caggttttaattatcaaataattatcataacacgattaaccatcgtgagctaccattaaatctaaccataagtaataatgtaatatgattcatcccattaatgagctaatgtttctaagcatggctaagcaattatgtatatagcatttagctgaaccaaaccaatatataaggttcaagctaatcaatttattacccataggaaaataaagtcatcttcagccattaattaattaggaaaggctcaccacccaatgacattcaaaattaatgcataagttgaaataaaacattagctttaaaaaggttcaacatgctcaaaaggttgtttgggatctatgtgacttgccttgagcttcttcaaacgcttctgaaccttcctcaacgtaaacgctctcctccggaacgtcggaaactatagcaaatgaacaaaatcaacaaaatagtacaaaaacaagcataaacagtacatgtggatatttttaacatgtagatctcgatttaagatgaatttagcaacttgaaccacttgaatccaagttacgatgatttagttatgaatttccgaagtttaatcacattttcatccaatacagaaaattagtacgatttatataaaagatttatga

SEQ ID NO: 32305 - DNA, 1501 bp, Oryza sativa
tggtcgatccaaaactacgggtaccaatttaacatgtttctaaggtgtctaactgaaagaatgcccaggagagtccatcgtggccatggaagctcgatcggacggcgcttgtgaacccaattgtgtcttcctccctcccccaccaactcaccatggccgccgccatgtgtcccctaaccgacaccgcgaacggcgaacacccgccggttcgatgaatgaccacctccatgtcttcccttgtcatcgatcgcatcccgtgagaccggcagccagagctcctgccggtcaatttgacaaggcgtgcggcaccggtcggaggccggagatacgcagagtcgtcctctgacgaagacatcgaagtacatccatcgtcagcggaagtacaccgttcgccatggccaccgccccccttacgtcggcgaggttgacggggatcagaaattcagaaccctgtgttacacattgtcctttcgaacccgtacatcttggcgaaagtttcgccgtctccgataagagcgtcagcgagcagccattgctgatgtacatactacacacagatcacaagaatcttggtaacaagtatatctgtactaggggttgcagtggttgcagctgcaccggtgtccgtagagctcgggagtccttatctagcgtcgctgctgtgagccggccgtgatgtcatgtacctgcacccggtggcgttccggcgtgtttgtcctctgcaccactcacccgccggtcagcgcattaggtgaaaccgcgaaagtgaaacagtgctggactactgctagtatgctcgatatccgatcgatcgagctgcccccgtccgcccgtccgtcctgcagagagacacatcaccgtgtgtggaacattcagagagctgcggcaaagctaaccgtagacatcacctaacccatccatggctttgtttgatcgtatctctggcgctttggtatcagttccctgaacagccagcaaagcgtcgttcagctgcgtaacatctccttttcagttttcatttgccgatccgtggatacatggattgcttgtccaaaagcttatttgcagctagaaaaatgtggtatatgttcctatcatggaaaaaataatgcgacgggggtgtgactctgcgtgtactgcacagagggagggaatgctaccagctactgaaacaactctgcacctcctggaagctttgagttgcaccaaaggcattccaattacttttttttttcacatctgagcaaatttatagtggtttttagaaagaatccgatcggaaaaggggattgacaattcgacattggccaactctttatctgtactttgtcacttgacttattctctggccgtgcgtataaatagaccctgcctacaacctccgggcaaatgtgcagcagcaacagtatagctgagattggtcatctgacatccttatctccctctccctccaagtgcctaacccaactcttcccgagcctttttctgatcattggacaaa

SEQ ID NO: 32306 - DNA, 1205 bp, Oryza sativa
aggtctctaatcgtgacggttctgccgggcttgaatgatccgggttaagtaatgtcgtgtgggtaaaagtgaccctcctctgcagaggttattaaactgttcgaacagccgtgcccacggtcatgggcggatgtgaggtgattcctagcgtagttttgtttgactactgctttgtgaaatttgctgaggtggtttgggattgatgtttggaaaatctgcggctgatgggatcagcaaggcccgggtggccgtttaaaagccgttgcccgggtgccaaccttgatcaattcaaaagactgataccttgcacatactccgaccggacgagatgcactgtctcatccgtatcgtttgagaagcactcacttagttgtttcagaaaagagtttaaataaaatcaattgcaaaaacaacagcctttccttgaagcctgcattaaacacttatttcccatggtttgctgagtactcccgtactcacccttgctctatataaataatcctccccagttgctgaagaagatgaagcggatcccgctgacgaggagttcttccaggagcaagccggctacgatgagttttacggttttcggcctagttcccaagtcgcgcctgtgatgtttggtccaagtcttggcttccgcttcccttttgtaatgcagttgtgagctcgggatctgtccgcagcccaacatgactgtagtcctactctataataaagagacctctgttgctttgatattctgtcttcctgtgaaaccagcactgtttcctgagactggtatcgataaacaggttaatttggagcgtcacgggctagttccgctcgagactagttcggggcgtcacagaacgccccaatccgagcacgtatgcgacctgggcacccattttagtgcagactggtactggactccgaattgcacccgaggtcgaattggtttgggcctccaccttgacttcgacatcctcgatgatcctctatggctctaagtccctctccaagtgtctcctcgtcccctctattgttcctaatccacaatataatcattaggtaacaatccattctcgaattcatacaaaaaatgaacataggagcgagctcgcctctaattttaattgccgcgcacgagctcttgttatcggtccttgaatgaccgttgaagcattgttgtgtgtatccgaggtagtgatgtccgcatcaga

SEQ ID NO: 32307 - DNA, 246 bp, Oryza sativa
tagcgtagcccgactttttttgttgttcttggcaagttggcaacaccagtcatgccgaacaactgttttggcttgatgacgtggtttacctagttagtttaatcctgtttaggacttaagatgctcaaagtgctttcaccaggttaaattatcacgggcaccacctaaccaccaggttttgttgggttaaatttgcttatcaggtttttgacgaatttatataaaaagatgtcctgttcttgcagg

SEQ ID NO: 32308 - DNA, 1501 bp, Oryza sativa
tgttacagttcctttccaaggtaccgtggtggcattgaggcgcatggagacatgttttggagctgtgtcttgtgggtacagtggtacatctctggccagagtataactattcgaatagccatgcccgcggttatgggcgggtctaacaatgtttttcatgattagtctcacattactcattattggtgataacctgtgataattaaattgactcctggtttggaacggtatattcctggtatggaggtttggtttgtacaaccggggttggttgttcagatgaggttgggcctatgcaacacgggtgtgttgtatagtgtttatttaatatttcttaaatacttaattgttttactattctctcaaatgcttattaaatgttgtttatacaaatgagctttgttatgccatctttgctatcctgtgcacttgtatatttgctgtgtagcttgttgagtatgtcatatgctcattcttgcaatattcattcatcagaggaggagtacttcagtgaaggtgatgatcaggtggattaggctttgttcgggtcaagttgcttgtggagtggagtcgccattaatttttccgctgcgtagaattttattcttttgagaggaactatccacctctataataatttattattttgtgaatattaattagtagtttgatagtactcttttatcaatttattattgtgtgcctcggctgattcctggacgaggatttaacgcacatataaacgtttggaattttggatagaaattccgggcgtgacaagttggtatcagagccatgttgaccttaggacaagccaaatggtaaaccttaagtagccttcaaaatattttgaaaaattaattaagttggcagcacatgcaagggtatgtacaaaattttctaaatcctactttaccaaaacagaaagctgttcttttcttttttaaaaaaaactttactgttcagtgtattaaatagtttgattttatgaatttcattggttagtcagcactgtacatctattatggtattgatgcaatcaagatagcaccagtactactcatccctgttaatggtgacactgtaccgtgcttatgatagatcctaagtattttagttttattttattcatttgtctaaagcaatttgtctctgtccaaagttgatttcattttccaaacaaaaactttgtttagttctgttcccacgagtactgtacaggaagaaaatatatttgcttctttttgtttacttttgaagtctatgcccctgtataaattaaaattttcgaaaaaaaatttctgaaaaaaaaacgaattggtttctgaaaatttatgtttcggtcagaaaagaaaaaatcgaaatttaattaaacaagaaaaaaattagttatgtttgctccttttcttttatttttctttttgggtcaaattaattaagtctagtttgtgcagctaacttaaatatatgcattaattcctcctttctgtgctgctttaga

SEQ ID NO: 32309 - DNA, 1501 bp, Oryza sativa
ttgtaggagtatatgtcggtgtgttttgtgcatcattttgttctctcgaagaaccaaattattttgagagaagggcaataacaatcaatcatctacagattcatcaaataaaaattagagaatgcatgcaacatggggcttcattgattagtttccaagccaatcatgtcctttcaaaggatttcgttaggcaactaatcttagctgggatggtgccatcataaactaagcaaaccttgactgttttatgttatctgcgagcagtagcagtcgtgccagcaatttgtcaagcctggttagtctcatgaatgtttttcccgatattatcagtataaagatttgttggtatgaaaataatcattcaggctttccactaaaacaagtgttggatcaagatcatgcatactactataaaacatgcgcactgtttgcccctcatgaaatttgaaaaggtccacctattcgtactagaatatttcataatcggccgtgaaatttgatgaagtccacatattagtactcgaatattacaacaccgctggtactataatctttcaacgtttatcatcatcaaaaaggaaaacggtcacatggctatacaattgacggtatgattttttttaaagtttcgacttgtaaattttctttaaatcattggatcgtgttgagattcatggagggaagggaagaaaaattcccatgtcacttgtgaggctaagagtgtcaaaccagcaacctcataggtaaaaatgtgcctcgctagccaaccggctacgcatggtttggtttttgtttaataatatgagagttttgtagaacttatattgtaattataatatatttacaatacaattacattatgattattatataaatagttacttttaaaagtttttcacttgaatattatataaatagtttctttatctaagcttcaaaaactaaaattaggtccgaccaaacgtttagtaattcacccatattcataataggcaaccccaataatcacgcaaaaatatataaaacaatttttgagatagaaaacatgtgagaaagattttctacaattttgaggagcttccagcctcatctttttcttatacttaaatttgactttttaatcttagatttggagttaattttagatgttttttcatcgtagtttattttttaaactttgttttttgtttttagatcgctaaaaacagtatataaaagttttatatacaaattattttttatttgtaaatatactgtttggcttatacccccaataatcccaacgatggggccgtaacacacttgggatgattcggatgaagcttcctgtctccaggaaaagaaaggtttaaaagcttgcaaaatccaaaccgacaatctgcaacaaaactgcatctcgaccgtcaaattccgatccaacggagagtgttggaaaattagcactaaaccccctgataatacctgtatttttcatgtagtaaaccacatctcctacagttct

SEQ ID NO: 32310 - DNA, 1501 bp, Oryza sativa
ttgatgcaatcaagatagcaccagtactactcatccctgttaatggtgacactgtaccgtgcttatgatagatcctaagtattttagttttattttattcatttgtctaaagcaatttgtctctgtccaaagttgatttcattttccaaacaaaaactttgtttagttctgttcccacgagtactgtacaggaagaaaatatatttgcttctttttgtttacttttgaagtctatgcccctgtataaattaaaattttcgaaaaaaaatttctgaaaaaaaaacgaattggtttctgaaaatttatgtttcggtcagaaaagaaaaaatcgaaatttaattaaacaagaaaaaaattagttatgtttgctccttttcttttatttttctttttgggtcaaattaattaagtctagtttgtgcagctaacttaaatatatgcattaattcctcctttctgtgctgctttagatgtcgccccatccgccggaaagattgatcgatgtggtaggattcgtcagggggctgagaatgatggcatttgaagtaggctacgacgttgcccctgagtatcgtcagattccccatgaccccaacgaggagcaatgtcgtgttcgcgtgacgttgactagtgatcgtgaagaccttccgtcaataaagtttgaagctgggggaaaaaagtatagtcatgcttgtcaggaggcagccttggtggccattggagagctacgtcatcgctttgatgaggagttagagtcatcagctttttagtatcatccacacaagccacatggtcaagactatggagttcacaactaccctgaagatgaagatagcaccactctgaagcatgcggtgtatatgcttagcgccatggatgcaataggcgtggagcgggagaaagcagctcatgataaggaaaactagaaccatggcaagatttacaagctggagagcaaggtgtaccgtctgcagaaggaactggccgagcttaagggagaagcacaaccgccagcacccaagcttcgcctcaccgcaaggaagagaacccgtcctccacgtcatatccagttggcttcgaagactcgtgtggtgggagatgctgtgcctgatcatgctgaacctgtcatccatgtcttaagtgatgatgaagaggaggaagacctagaagaaagagagctagctactccagaggaagaagatccatctcttcgttccgacgcaaggcgggattagttgcctagttagaccgttgccatagttcgatgtgttagtttgcttgcttaagttcgctcatgcgtgtgtgggtttagcgtgtttcttacatcattggtgggatgtaactacaggagtttagttcttttgcttatcagagagtaagttagctggtgagatagtgttaaatcaacttaaatgtaacatactcagttaagagcaatatataatttaaattaattaaaggtctttgttctaatggtatctctctgtcgttctttcctttt

SEQ ID NO: 32311 - DNA, 1501 bp, Oryza sativa
attatatctatcggattttaatccaaagattaaaaatccgtgtgatacgatcataaaaatctttcgaaagatgtataggtacttcctaaaaatatttgtttcttttcatgtctcactggtgggcttacaaaggctagcgttcatacaactatacaaggcctttcttttgggctttaatactatattaggtccatttatttcttttattgcgctcgcagtaatcgtacaaggatctggcatatcagcgtatggatatggttgcatttgctacgagtttttcatacctgaacctacgactaatgatcaataacctgactagacactactttccttttccctttgcaaacctgaatgaagattcatgcttacagttcgtagttgatcagaattaatgcttctgaattgaagttctgttccgtcccctgtaacttgacgtcacgttctatcttagccctatcttttgagagagttggcgatgcaagcgtttgccagatgacgaaaagcacaagagttctctgaggcaatctagggcaaattgggaaaagcaggagccttttgcagacagcattagagacttctaatataaccacgcgtatgcatccaacagaccggttcccctttcatcgttcatgccctcgatttttctttttgtctgtgattctacttttgccccaaatgagccgcccaaattattctcacctgagaaaaaaaattatttcttctatctgcaaaacgcttatgtcactcgacatatataggcattctttttcttactcgacatagagaattttaagcttgtgtgtctatatagtaagtattcctttcattcacagaagttacacctattacttttgtcatcaagaccaagaagaaattaatcttagatgttataaaatcaagaagtaaatacaaacatacaaccaatgagtatttagatgactccttgggttctaatcaaacatttaatttatctcttcatttaagttttgaatatataaagactaccaataggaacaatttatttcaaaaactcaaatgtgaaacatgtctaacttttatggatggagggaataggttgtaaggcttgtaacctatcgattttcattttttcaaattaggatttgctatttgacaaattgatagtgttgtaggccagtacgacactaatctaccgttcaaatcctacatatatacccctgcttttggcacaagtgggtgtcttcgacatttgatttttttagttcaaaagtttatctttatattagccaccatgtgtgttgagcctatgagggactacatatgcatgcgcagaacatggaattttactgtgcatgtacatcttctatctaattgaatacagtttgctctttctgaatcactttgatgttatttagcataggaaagcatctacacactacactgcctgacaaaagttatatatttactgcaataaatcccagtaaaatggatactacgcccctcatgcagatcccccccccca

SEQ ID NO: 32312 - DNA, 1501 bp, Oryza sativa
aagggaaatatttattcttaaggccttatacgtttattctcataagaaagggattatatagaattgcaggggatttagtgtggaattaactaatccccttgaaacccccttaatctagttgggtgactgaggattacacaaacaaggcctaacaaggaatttttttttagaaaatgaattaaaaatctggcttctacattcacttggatgtatacacccaacagggattcaactgctggaacaagtatagagagcaaaggctaaagttgaggggtcaagctgtgattacaaaggtcaagtaattaaacttcggtatagttatacaaccacgactataccattaccaccagcatgtttttaacatgcttggttttatttatacccaccataagaaatttcaccaacacaaaccatggcatgcataaccagagcccccagacacgacgatacaccagtggcacaagcaaatttagaatcaccacaacaaactaaggtgattactacatacgagttgcacggtgaccaaatcacacgagaaacgagaagaaacacggtcagcttcattgcacgagtcaccaacgtgcaacggccgatcgacaagaacctgcatggcttccacgcactgtctctaccctggctcgcatgcaccgcggccatcagaacagcgcgagcttgatcagggcccccgctgccgcggcggcgacagcgctcgccgccgccggcgaagaggcggcagagtacgacgggtcaccgttgacgttcacggcgagcttcatgccgctgctgcagtggccggggatggtgcagatgaagtagtgcatgcccgggtaggagagcctgatggtggtcgatcccccgttgtcgttgctcagcgggctgttgccgttgcagctgtcgaagttggtctggctcacctccgtcaccgtgtgcgccctcgcctggtagttgaacactgcaccaacacatgtgttttcccagcacgtaggtgtgtgtgagactgtgagtatatgtgcaagcgactactccctctgtcccataaaaaattaagctagtactgaatgtgacacttactagtactatgaatctagacatacatatatctagattcgtaatactaaaatatgtcatatttgattctagattcgttttttatgggatagatggagtatgtattagtgatgagagaaagctgagctttgctcaccgagttcgtctccttgtctgaaaaacttgccgttggcccagttgttgtagttgacgccggtcgtccagccctcgccgtcgccgacggtgtacctcgtggctgcggccaccgcggcgcaactcacgacgagtagcccaacgagaacggctgaagagacggccatttgtccaatgatcagaaaaaggctcgggaagagttgggttaggcacttggagggagagggagataaggatgtcagatgaccaatctcagctatactgttgctgctgcacatttgcccggaggttgtaggcaggg

SEQ ID NO: 32313 - DNA, 1501 bp, Oryza sativa
caagcagcggaaataggtttccctgaacacccccttttttgtggctagcctcaaaggatccatcaacattgatcactttcatccaaaggatccatcaatattcactttcatccatccaatgtaaagctaggatttggtaaatctttttatctcgactagtaaaaaatctaacatatttccgtcgtctcatatgacttcatagttcctcgcacgatatcagttacaccccacacgtctgactgcacacgtttgcgacataccttagtacctcagagagcccgacactttctactctacttagtctctttgctcttcagtggagcacttgactccgtttgcatcattgcatggactcctaccgtgtaggttgtcactgcatcactattttcccttcctttttctttttggaaaattttattacatgacacccaaagtttgtgtaattttctatcagacatagaaaagtgtgctatggctgcatgataccctcaaattttgataatttcctgaagaacactttcggctcgattggaaaaattctttaaatagactagaatgcttttggggccacaagcttctaagttagtgttggattttaaaaaataaaaattatgcaactctaaatcttccatcagccgaagtatattgctagcatatatcatattccatcaacactccaattctaggttagaagtttttggctataggggtattctcgtttttaaaaattctctttgattgggttaaaagtgccctatagcaaattatgagttttttggtgtcctccaaccgtgacacgcttttgcgatgtctagtagaaaattacacaaactttgagtgtcatgtgacaaaatttgactttctttttcccaattcatgagaaatattaaaagtctatgatatggtgtgtatgtggtagaaaagtttataagcggtgaattattccccacgcttgacatcctttgtttctgttcactaatattttccattgatttattgatttttctgttgcaacacacatgtcctttgctagtaaagaaaaaccccagagccaagaatacgaatataaagataggcaattatcacaacaaagagaaactaggagagcaaacaagacgatgcagccaattgcctttgcctttacatcaaaatttgcatctgcatatgtataattatggtgattcacagccccgaccctgaaagactgacaagccatacatcctgtacttaaataattaaatataatttctttcaattcccaagatacagcaaggcatatatgataccatacgtgcttcaacctatgatacactataacatttatgacacaatataacaaacttctatttaacggcctgattctagacactgaagttcactattgatgctgaaatttcctgtattctcaaccgttgagttgttgatctcgtaagaagagtccccaagtaagctctccatctcttcaggattttgttgtgcccatggatgttgcattaccttc

SEQ ID NO: 32314 - DNA, 1501 bp, Oryza sativa
ttcggttgtgaaacattaaccgtgccaaccacaagccagcgtgggcaacggctttaccttttgtatagcatggttcattacggagcaccagactgagaagtggcggagataagcccacgggggtcactggggagtccatgccttgtttataagggggtgattatgatccaggaaaggtgcgctgtggtggattgtgttgtgcgaggggtactgtcacagctcctttccgaggtaccgtggtggtattgaggcacatgtcgacatgttgtggggctgtgtcttgtgggtacagtggtacacctctggccagagtaaaactattcgaatagccatgcccgtggttatgggcgggtctaacaatgtctttcgtgattagtttcacacttctcatcataataaaagatgttataactggtaataatttgattagctcctggtttggaatggtatattcctggtttggagatagatccgtacagccgggtatggttgttcgggatggttgggcctgagcagcatgggtgtgctgtttagtgttgattaaaattgatgattaattactctaatgttttataatcctcaaatgtttgctaaatgctgcttttgcaaatgagccctatattatgccattctttgatatccttgtgcacttgcatatttgctgcgtggcttgctgagtatgtcatatactcaccttgcaatcattcatcagaggaagagttctacagtgatgctgatggtgtggaggattaggtgtagccctggtcaagctgcctatggagtggagtcgtctgcgccatttatcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatagcacatgcacttcataatctcttttagtggttctcattcaaaatttattccagtgttgttagtactgtacatctaatactgtactaatggctcatttaccagcaaatgttttacaacattgttttattttgctgcaatgaaataaatttagcatgttgattttataactttcttttatttcttttggaacctgttgttcaaaagtacaaaatttgtgaccttgtttccaactgtttcaacttatcttgcaagcttggtttactttatttgcttaccttttactttgattttctaactttattcaaattaatccaaaaacttgtgctattaattggataaatgtcttaactccctcctttcacttgtctttaga

SEQ ID NO: 32315 - DNA, 1501 bp, Oryza sativa
aactgtggttgtactacattgccatctggtccaagatcttcaacttgtaccccctgaaaactgtcacctttatctcccgagccctctagaatgcctttactacctgattcagctgtagcagccggaacttgttgtaattctccatcgatccttagaagaacctgttccaggaacatcagcaactaattttaccttatacttctgaacaactgttcccttacgggtctccatgaaagaattcaagaactggtgttgtgtttgctgcatcatcagatcgagctccttcttttgttccggtgttaatttgtctgtagtgacgggaacaatgtttccctcatgaacttcaaacccactaggctttgggctattagtcttgggagggacctccgtgagagaacgttgttgcaactcggtcccactgggcatgccaaaagagtgttgatgtaaaaacacgagggctgggagatctgcttagctccagtgcaggtccaaaagcttgcctttaggttcgtaagagtgccagttgatttgatcctgcaatcaacaagaaataaagacaacgaaaccattgttaaatccataaatgatagccgatcggctagttgccgatgacatatcatttatcttttagccgatgtcatgtttgaatcgattggcatatataaataagtaagaagggactaaatctactcaatcggctgtagatattgataatatataatctctatgtcgatatatgtcacaccctaaaaatcctaaatatataaattgttgtttaattggaattattagaatttattttaaaagtctagaaaagaagatctaattttaaataataaattccaatataaaatggggccagataaaatttcattaaatactttgcttaattctataattcctagatttttctgggatttatttgagctaaggaagtatttttaataaatggaattgcatttcctgaataatttaaattgaaaaaggtttttaaaatcctcttttggctttgggccgaaagtcggcccaaaaccttctctctctctctccgtcggcccagtcggcccagtcagcccgcagctgcccgtgcgagcgccctcggccgctgacaggtgggtcccacctgtcggactcgtcgtcctcctcgcgccgtcgcccggccggaaccctagccgagccgcgccgccgtctccttccaaattcgctcgcgcctttccttctccggtgtaatcaattgaggggaaatgtttcccgagatctcctctaccttttctcttttggaatcgtcggctaaatcgtttggaaatccgtggattcgagttcgattcggatcgatctctctcctccgaaccctaaacattccttcgcgtcgcaggtcgccgggggccttcgccgccgcctccttgcccctataaaaggacccccaagcccgccggtacctgccgacacccccgccttcgcctctcgccgcccgtagcgccctagccccgtgtagcctagc

SEQ ID NO: 32316 - DNA, 1501 bp, Oryza sativa
caattcatttgtgcatgagcctaagtgtaggattatggatatcattcgttataggtttcttgcaaattggagcaccaaaaatgtcttcccaaaacctatttttctcgaacccagaaattcctttctagagatcgattttacaggaatcgtgaaaaccaagaagtgtacttgtcacgtgtgagcattctccggagagtattctcgcgtgtgagcatactcccggtcgctcagcatgtagtaggcttgtctctcccgatcactgacaaggttgagttcggtgtcgttcagaagtcgtcgcggagcttcggcgtcttccatcaagacatctgctgatgaatgagtactagactcgtcatgatgacttgatgaagagccggaccccttgaacagacgagacagtcgcctcctcattctgcacaatggagcaagatcggactaactcggcaggagttagcaatgacaagaatttaacccgccggttagtttcaccaaagcaacttgtatatatgcaactaagtgttttgaatttcagggaaactatcaaagcttgaatgaacttgagagcaaactttggagagggaatgaaaatgtgttgaaatggggtggaattccctctctcggccggctgtcttttatagggtacccacaatggtcagaaatgacatgtgggacgcactagccgttaccctgccaaaagtggcagggaaccattgcctggccggttcggccaaacccatggtgggcccagtcggccccactttcggccgttgggttccaacagtcaatgtggtcgtggcatagcgaattttcgttgaaatttttattttggtttgctctaaaaaaattcaattgaagaatttcctcaaaattcaaaaatcctaaatgcaactttgaaattcaaacatgtgatgatgcaaaaattcaaattgttgaaagcaaatatgcggatacataccaatttttctgttgccgaaggtcgcgtcatttaaagtccgacgtgcaagattgtacctccatccagttcaatttgcggattttctacccgtctccggaggtgatggagcgggcctctttggtttctccctccacggcttcttctgagctggctgctctagtttcttggtcggtatgggtggttgttgatgtaaaaacccgaggcctgagagatttgcttaactccagtgcaggtccaaatgctttcctttaggttcgtgagcatgccagttgatttgatcctgcaatcaccaagaaataaagacaaagaaaccgtggttaaatccataaaggatagccgatcggctagttaccgatgacatcatttatctctgagccgatgtcatgtttgaatcgatcggtagatataaacaagtaagaagagactaaatctactcgatcggctatagatattgacaatatattatctctatgtcggtatatacttaagtcaagtgattgggatagatcggacgccatgccgagacaatataaatcacttagatcg

SEQ ID NO: 32317 - DNA, 1501 bp, Oryza sativa
taaaattgaatcacgacaacgatatggttaactctttttggaaatataataccaacacagtcgcttacaacatacacactttcacctatattaaagtacacacgtattctatccattcatctatatgagcacctgaatgactgaattttttttattaatctttactaaataaaaaaacaaatattcatatttacaaagcagtgagtagaggtcgtcactcatcagcccggctgctcctgccatttgttttgattatcagtgtcaactgtcaagtgttccgcaaatggatatccctatcgaatcgagctgacgagactgaacggtgtcgtgttctcattgaaagcgttcacggttgggtggtcaaatgtctggttaccttcattttcactttaattaacgtggacttgttcttcgtttgagatcgctttcgaggctgtgggggagaatgcagcctacgtactcggacataagttctccaattgattaatttgtttcagcttactaatcctcctttgaatgccccaaccacgtcaaaatttagcacttttttctcctataatttatagattattatggccagtctaaacggttaaacattataattattaaaaaactttatacaacttttaaactttacaatagttaattcattcatttctatcctcaaatattatcacaaaatcatacacaaatatagtataatctatcctcccttcatcatattataaggtcacgtttagttgttaaaaatttttaccctgcatgtcacatcggatatatagacacacatttgaagtattaaatatagtctaataataaaacaaattatagattccgctagaaaattacgagacgaacttattaagcctaattaatctatcattagcatatgtttactgtagcaccacattgtcaaatcatggcgcaattaatcttaaaagatttgtctcgcattttcctggcaaactgtgtaattatttttttttctacatttaatactccatacatgtgtccaatcattcgatgtgataacacgaaaaattctgtttgggaattaaacatgcctaacataaaattttgttaagaaatcaaatcaaacatagttacatagatttggtagtgtccaaatcaaaatcataccgggtaatttctcactgtggaaccaaagcagtgagtagaggcagacaagccattaaacaaagtgcaaatgattgactaataagagcccaattaggcacctaaattacagcgtccctgtaacaaacagcagcttgagctcactgcgctgctcaccccgtactcgtcgtaatactttttttaatctcttctcgaacaaactccccctttttatcacacacacactctctctcctctctttctcgcccgtttccccaccaccaccaccaccaccacctcccctctcccattcgaccaaatcggcgaggggaatagcccccccgcgcgccgcgcctcctctcgtcgccggcgatggccgacggcg

SEQ ID NO: 32318 - DNA, 1501 bp, Oryza sativa
tatatatggaggaataccctccctaggggattaacttaggattatataccggcgcggaggaatacccttactgagctgtcactataagcggcccacctctcatccacaatatataaccccaaataatgatttcccgtaatctagacaccacgtctaaactaccagatactactctaatatcatcatcatgacatagagtaattgcataagcaaacactatacccacaccaaagcatcttccagataagctagccgtatattcagtataacatgaatataatgtaaagtatgtactcctataatcggaaagtatttcaatacataaatgtatttagaagagtattctaataaaagtacaaggcttacaaaagagaagagaaaagctaccagagacatacccgatctcttccgaaggcttccggattcctgatttctactttattcctattccatcagctagatactactaaactaaacttgagagaaatgagagagctattgcttgaggtgtgtgagtgaagtgagaagaggaactccttttatagctgaactatgatggttgtgaccgttggaatggtcggtaataccctccaaccgtcattggggcttcatctcaaccatccagccaagacatggatccaacggaggcgagggaggctcggtgtcacatcctgattttcgctttaggatttaataaattatttttagaatttatattaaatatttattaatttacaagtgaagttaaatgtgggaaatcaaatttcctaaatataaagtatggctggatttaatttttattaaattcgccatagttaattataccctctggaattttctttgatttttcggagctcaatttgtaattttaataatacaaacaacatttcagtaattattcacatattaaattaatcaataaatggtctacttataattttgttaaatatttatagtgttcaagtactttcaggatttttcttgatattatttgagcaatagaagtattgttaacaattcaaggatcatttcagtgattaatttaattggaaaagtaattaaatcctctttttcatttcgggccgaaacaggaaaagtcctctctctttctctgcccaatctctctctgggcctgcagcccctctccctctctttgtcgaagtctgctatttgtccctctttcaatcaggccttggaagaagaagcccagccggaagtttgttattctccctctcgctacagtggcatcttcaacctccagccagccgtccagagcccctgttcttcccgatccggcgccgttttctctctccaactccggccgccatcttcagccgccttttcccgtcacgccggccgttctcgatcagtgacgccacctccctccgctccgcaaggttgatctctaccatggccgccagttcttttgcgccaaatcccgccggaaggttgccgtcaccgtgaacccgttggttgttgccttggtttgatctctagccgt

SEQ ID NO: 32319 - DNA, 1501 bp, Oryza sativa
acgactagtcgacggcgttatctgtgagcgtgagctgtgattgttgggccttttaaaagcccaactccagccgaagctccatattccgacgtcgattcctcttctcgatattactctatacacatccatgacttttcatcttctacatttcctttctcaccctaaaccctcattctaatccccttcgtctcctatccataccaatcagttaagattaatcagaatttttttttgcggcaaccgcaacagagtattcaggttgaagctaacagaaggtattttaggctctgattttctaggccccatgaacaattctattaatcttttatctcaattcgtttttcaacatctcttgtttttccatgcttgcaaacatatacatggccatatttgatttttcaactgattttggtcataaatatggaaattgaagccatggtgccttgtttttctatcaagtctggtcaatcattttttcttgcatgttatggtttttttaagaggacttgcatgttatggctgtgaaaatatattggtttcatatcctgaaggcctaaactaatctaacatctggagtgaatccttttaatagcaacctaagctatatcgatacatgtctcagccggactagcctctggcctcagtgtatagaaagcacagtacgcaagcaaacaacaacgaggctcagcgacgcgtagtcatatctgacgctgtcattgctcgttttttctgccgtttcagtcgtacatgcgtcggacacatgagttggacgtatagcaaagttgataaactttaggccatgaccaacgcaggaagcacccccaccattggtgagtgaagctaatgcctacgaaaggtgaaaaatccattcgactttggacgctagatcagacgtcgattcagtcgtttttcagtgccgggagtacagtcagtcgtcgtactcgcgctagttcgttcggttgttactggactcaacgcaaagaacggccgcgcctcttcgtactgtcttgcacatgagcatgcaaacgcacgtcacgttaaccctggtcacctcctaaccgcaccaccaccccctctctacctaacccgagcgcccccctctcctctcctctcctctctcttggtctctctcgcctttattaatacacacagggtacagcgcgccgtcttgcgaaaacagaaaggaaaccgagaaagagagagagagagagagaggtagggagggaagaagagtcactccacactccacactctcatcccctggtccctttcttggatcatgagaaaccgcgcaacaaaattgcaattctaggcagcatttggaccggggacttggctacgtggtgtttggccatggatcgcagcgtggaattaagaccggcgaggactcagcgacggaggcacccgcgtcattcctacgcttctgtgcccgtcgtcttctcgcagtgagagagagagagagatcgaccaggcgttcactgaattttactagaactcggca

SEQ ID NO: 32320 - DNA, 1265 bp, Oryza sativa
  unsure (1)..(1265): unsure at all n locations
gttggttaaatgctagtgtcaccgacaatagttgttccaattttaaaagaaaaatggccccctcaagttaatctgtaatgaaattaaaagtctacgccttgatgaatagagaaattttttgcctgtgtacaaacgttatttttattccaatcttaaagtaaagttggcactcgagtaatattaatggcatatatacccggcgtttgtttaaattaggttatactattaacccagaaggcttacaaaaaaaaaaaagatgctattaaaacattgccggaatctcgtaaacagtgatggactataaaacaaattgactggatgttattntgaatcaaaggagcaatttagttctctttaggaaaggtagaaatttgagtatcaaaatagtttctttgaaggtatgtagcgatgtgagaatgattagaaaggtttgtaagagaaaaattgttataaagagtgataggatttgggttgatggtgaagggtggnttttgggttgggtttagggtttgggtgggtgggnnnnnnnnngnnnnttngnccgaaccctggccatacccaatcagcccacaattcggtaggtgaattcctcgtttgccccttaagtcagaacagggaattttgggcttatttgatcatgtcatatttgagttctcagcccatctatccacaagtctgatacttgacaatgtctgtttgattgatcgattgttttactatcgattctcctccattttgatagcttctcctacatggttagttttccaagcatatagtggaatagaatattttatttatggaataatgcattgcaagcatagttagtctttattaattgggtaatattgacggtcaaaactggtcgataacgatcatcaatagaagttaggtcccgatcctctgataggtattgataaacagtcgatttgggcggattcgcgacacaactcaatccggcttctgaacgaacacactacttagccccgcaatcgcagcaccacatcctctctgtttatcaaccgtgccgaaacccagttgacctcacctagaaggctaatccatgcatacgaatcgaagaacacaagcaagaataagatagattaaaacacaattgcatatgaatgattaagcactcgaatatggggttctacaaaccgatctagcggcgaaattgttcttaacaaaataatctaagcaaaactcgactctaaatgatgacggctactgattaagtatgattagggacgtcctatggttgccctagg

SEQ ID NO: 32321 - DNA, 1501 bp, Oryza sativa
gaccgagatctttccatccaaaacgaacggccgagatcgaccggtccacggccggaccacgggagacgatgacgatgacgtcagcggtgacgtcaccaccggcgggggctcgggcgtgcatgctcgccggcgaacgacggcacgacagcgcgaacggagagcacctacgggtagcggacggcacggcaaactcaccggtgaccaaagcggcggcgaaagatcaccggacggcgacagcgatgaggaaagaagcggcggcaaccttcggcttgacgacgacggcggtgctccgatggtctacagcagcgatggaggggcgtacgaggacggcgacgcgacggcgaccacgacggtgactttcccgagcgacgacgacaacgggatcgccgccggcgcatggctggacgaacggcgacgacggcggcgctaggctacacggggctagggcgctacgggcggcgagaggcgaaggcgggggtgtcggcaggtaccggcgggcttgggggtccttttataggggcaaggaggcggcggcgaaggcccccggcgacctgcgacgcgaaggaatgtttagggttcggaggagagagatcgatccgaatcgaactcgaatccacggatttccaaacgatttagccgacgattccaaaagagaaaaggtagaggagatctcgggaaacatttcccctcaattgattacaccggagaaggaaaggcgcgagcgaatttggaaggagacggcggcgcggctcggctagggttccggccgggcgacggcgcgaggaggacgacgagtccgacaggtgggacccacctgtcagcggccgagggcgctcgcacgggcagctgcgggctgactgggccgactgggccgacggagagagagagagaaggttttgggccgactttcggcccaaagccaaaagaggattttaaaaacctttttcaatttaaattattcaggaaatgcaattccatttattaaaaatacttccttagctcaaataaatcccagaaaaatctaggaattatagaattaagcaaagtatttaatgaaattttatctggccccattttatattggaatttattatttaaaattagatcttcttttctagacttttaaaataaattctaataattccaattaaacaacaatttatatatttaggatttttagggtgtgacatatatcgacatagagattatatattatcaatatctacagccgattgagtagatttagtcccttcttacttatttatatatgccaatcgattcaaacatgacatcggctaaaagataaatgatatgtcatcggcaactagccgatcggctatcatttatggatttaacaatggtttcgttgtctttatttcttgttgattgcaggatcaaatcaactggcactcttacgaacctaaaggcaagcttttggacctgcactggagctaagcagatctcccagccctcgtgtttttacatcaacactcttttggca

SEQ ID NO: 32322 - DNA, 1501 bp, Oryza sativa
tgcattcgggttgagctgcatcggtttcgatcttcaactagaggtaaaacttgttatggcggcttgcgttcttgggattagtgcttccatctttatgatactctaatcttgtttatgtaattcgtagagttatcatatattctgtataatcttcgacaatgtcgttatctaaccttcaatcggctaacatctatcattggaaggcagccgattaggttaaatatctatgttggcttagattgtataggatatccaccactctatgaaacatccaacggcttgattgtctagattttgttcttcttttcatacttatagctgcatcagttgagtttgaccttataagtcgtgattagaatttcaatctctagcctgcttttggttgtcgattagggtagtatcggggtttcagccgatcttacctaatttagccctattatctcatgcgcttaattgacatgctagatctaccctttatattaagatcttattacaacaaagtatattaggcttctgtttgatatattttacttgctttaatatcttaatatagagtggtatcggagtattagtcgatacgtgctagatctatctgataggcaatgctataaacatctataatcttgttgtgaatatatacttcgatctaagtgatttatattgtctcggcatggcgtccgatctatcccaatcacttgacttaagtatataccgacatagagataatatattgtcaatatctatagccgatcgagtagatttagtctcttcttacttgtttatatctaccgatcgattcaaacatgacatcggctcagagataaatgatgtcatcggtaactagccgatcggctatcctttatggatttaaccacggtttctttgtctttatttcttggtgattgcaggatcaaatcaactggcatgctcacgaacctaaaggaaagcatttggacctgcactggagttaagcaaatctctcaggcctcgggtttttacatcaacaaccacccataccgaccaagaaactagagcagccagctcagaagaagccgtggagggagaaaccaaagaggcccgctccatcacctccggagacgggtagaaaatccgcaaattgaactggatggaggtacaatcttgcacgtcggactttaaatgacgcgaccttcggcaacagaaaaattggtatgtatccgcatatttgctttcaacaatttgaatttttgcatcatcacatgtttgaatttcaaagttgcatttaggatttttgaattttgaggaaattcttcaattgaatttttttagagcaaaccaaaataaaaatttcaacgaaaattcgctatgccacgaccacattgactgttggaacccaacggccgaaagtggggccgactgggcccaccatgggtttggccgaaccggccaggcaatggttccctgccacttttggcagggtaacggctagtgcgtcccacatgtcatttctgaccattgtggg

SEQ ID NO: 32323 - DNA, 1501 bp, Oryza sativa
tatccacgcgtttacagattgctcaccagtctgctgaagcattggcctaccttcactcatgggcatcgcctccaatcctccacggggacgtcaagtcatccaacattctccttgatggtgacttcacagcgaaggtctctgactttggagcctccatcttatcgccaaccgatgatgcacagttcgtcacgtttgtgcagggaactcgtgggtaccttgacccagagtacatgcaaacatggaaattaacggataagagtgatgtatacagttttggggttgttgtcctagagctactcacgagaaagaaaccattaaattttgacgggctagaggatgagaaaagcctatctgtgaggttcctttctgctgtcaaggagaacaagcttgaggaaatcttggatgatcaaattaagagcgaggagaatatggagattcttgaagagattgctgagttggccagacgatgcttggaaatgtgtggtgagaataggccatcaatgaaggaagttgcagaaaagcttgatagcttgagaaaggttttgcaccatccttgggcactgcacaatcttgaagaggcggagagcttactaggagagtcatcaattgttagctcggaggttgtcagtacgggaaatttcagcattgagaagaaatctttaataggcctagaatcaggaagataatcgctaataaccttgttgtatatcatatcccaggaaattatataggtatactccaaaagtattacatgtataggtaatcgtcatcatatatggaatgattcatacatgttttatatgtgtagctcaaggttgcatcattgttaagatccaaaggtgaggttgttgtttcaattgctattgtagctttacctttcaaaaatctatgtacaatagtaattgatttgatatttgacacacattttctttttatagtttgatcaattctcatactgctaacaaatcacgacaacatgtacttttcaagaggttaggatccatatgctttgcaagtttatttattctcagaaatagcttatcagtaaccattcacctgcacatatattgaacaccaaggcctgccgacatactataattagatctcctcataagaaactaccgttcattataatcttgcatactccaataatcaagagagtggcataatatactttgcttgtaagccaaccgcttaaacattctattacccataggtcaatctccatcagaccaattgaaaaaaaaatagttttattacccataggtcaatctccatcagaccaattgaaccaaagaaaaaaaatagagcaactatgtgtatgtaaattgtttcatagcaaaacaacattacctcacaatggcatcagtcctacagtggctggtaatggcatccgtattgggagcatatactcctgaaatcaaactatttgtcccacccttccttgagaatcgttgtctgctcctgtaagaagtatacataaatataaatcagcatctta

SEQ ID NO: 32324 - DNA, 1501 bp, Oryza sativa
gggtgtggacaagtcacagagctacgccgagcttgactgtacgcacaccacctacgagaaccagactaccaaacaacacccacatcaaacacacgcacgcactatctcgccatgactccaaaagagttggcggcggaacaaaagggcctaacacacggacagctgctgaagactgcctcctctactcctcgtctgcctggctgcctcttgtagtcggctcctcagtcgaagaaacgtcgatcggctagcgcgaagggaccggcggaacctgtcgagggccggcagcagtacgggccgctggcggtgggggagctgggtagtcgaagcggaacacggtggaagaaccaacaacatgcttccgcacagtgcggataaagcgtgggccacggcgggaggaagcaactggggtgtgtccgggggtgtaggaggggctaactgggtgtgggtagggggagtacactggtgagtacggcgcacgcgagctgggggagcgcgggccactgggagtgcaggaagagccgcgagagctgtgggaggacaggtggctggcgtggcagaggcggcctgagtcccaagagacagtgtcaactgaggtgacaccctcctcggccagacgggcctccagagcggcgtagcggcgggcaagggagcggtaagcctcgaggagtaggtcgtgctgagtggcctaagcctccgaaagctccaccatgcgagtcagcactggctgagactcgctgtacggacaagggtacctggcgtctgcgtggccagaaggaaggcgtgggagctgccagaaggcagagcccccgagacggtggctgtagtcatgggccaagcgtcgaagcgcagtccaggagaggtcctggtacgcgatctggagagtgggcctggccacagtgaagtggtgtgggcaaaggccagctccgtgtatacctccacgagggtaaaggtacacagagctcacagcgagggggaacacggtccacggagtaccccgtgtactcgggacacgagaagccaaggaagcgggcgaggtcacgaagctgagcgacgtggtgaccctcgccaaaaccgtgggaactgaagctggcgttcactgccatctacaattttgaaagagggagaaaagatcaataaccattttagcaacaaactattgaaaataaagaaaccaaaaggagccttagcttttcgcaagtagttttgaacttagcatccttagggtcgtcctaaacgtcgggtttcgccctagggccaagcctgtgctctgataccatctcttgccacgccccggactagtcccgagcagaactagcccgtgacgctccaaattaacctgttaatcgataccagtcccaggaaacagtgctagtatcacaggaagacagaatatcacagcaacagaggtctctttattatagagtaggagcccagtcatgttgggctgcggacagatcccgagctcacaactgcattacaaaaggaaagcggaagccaagac

SEQ ID NO: 32325 - DNA, 1501 bp, Oryza sativa
aacctaaatgaatttccaaaatcgcggaccggggaacgtaccgggtgtacggtttcccgctcttgcacttaaggaccgtttccttggaatttcatccgaacataagacaagtacgaccacatgggtggaatgggacacccctggctaagtaactagctaatcgggggagccatgatgccaagagacatgtggattcaacggggtggtgtcggggaggacccccgggtttcttggcacagtatggtctgggacctcatctagtgttggtctgggacccctctcgttggcatatggtgaacctgtgtcggctttccaaatgccttgtcatgaaagccttaaggtctctagtcgtggccgttctgcacgggctggatgatctgggttagtaatgtcgtgtgggtaaagtgtaccccctctgcagaggttattaaactgttcgaacagccgtgcccacggtcatgggcggatgtgaggtgattcctagcgtagttttgtttgactactgctttgtgaaatttgctgatgtggtttgggattgatgtttggaaaatctgcggctgatgggatcatccaggcccaggtggccgtttaaaagccgttggccgggtgccaaccttgatcaattcaaaagactgataccttgcacatacttcgaccagacgagacgcactgtctcatctgtatcgtttgagaagcactcacttagttgtttcagaaaagagtttaaataaaatcaattgcaaaaacaacagcctttccttgaagcctgcattaaacacttatttcccatggcttgctgagtactcccgtactcacccttgctgtatataaataatcccccccagttgttgaagaagatgaagcggatcccgctgacgaggagttcttccaggagcaagccggctacgatgagttttagggttttcggcctagttcccaagtcgcgcctgtgatgtttggtccaagtcttggcttccgctttccttttgtaatgcagttgtgagctcgggatctgtccgcagcccaacatgactgggctcctactctataataaagagacctctgttgctgtgatattctgtcttcctgtgatactagcactgtttcctgggactggtatcgattaacaggttaatttggagcgtcacgggctagttctgctcgggactagtccggggcgtggcaagagatggtatcagagcacaggcttggccctagggcgaaacccgacgtttaggacgaccctaaggatgctaagttcaaaactacttgcgaaaagctaaggctccttttggtttctttattttcaatagtttgttgctaaaatggttattgatcttttctccctctttcaaaattgtagatggcagtgaacgccagcttcagttcccacggttttggcgagggtcaccacgtcgctcagcttcgtgacctcgcccgcttccttggcttctcgtgtcccgagtacacggggtactccgtggaccgtgttccccctcgc

SEQ ID NO: 32326 - DNA, 313 bp, Oryza sativa
caaccggcaaaaataaagccctattattgacctctaagcgtgccattatatagatctcgagatttgaggaattttggaagttgaacagagtcaaacggacttacggttgggaagatattgaatttctaagattattggatttttggtctaaaggaaaaggatttatttaaatcctttttgaaaaagaaaagaaaagaaaagaaggagggagggaaattagactttccttaggcggctagggcgcggcccgagagaaaggggcggctcggccgaacttaacgggccggccggcccgagaaggcggcccaaaaca

SEQ ID NO: 32327 - DNA, 1501 bp, Oryza sativa
cccgtggccagccgaacggagcccggccgggggacgccaatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcaaggagcgccggccttctttctgtcgctcgcaggcctcccctttcgggtggccagcgaaacgccctcgacggcgaggacatgaccctcgtcgtcggaatgggccgacctcttcttcctcctcctgtcccgccgccctgtctgagcagcggatccgggggcggccgaagctgccactccggaaccggaggggttccaggtccatgcctcctccttacgagccactcggtccgcaagctaaaaaagctccgcggtagtctggggctctttagaggcaatcttttcgagcatgcggttgtgccgcacaccccccctgaacacgtagatcaccgcgtgtgcagggatgcatggtatggtgttgcggacttgacagaaccgctgaatgtatgagcgaagtgactcatcatcccttcgctggactgcatgtaagtccgcttctttacctgggcgcggatatgtgccttgaaagttcatggtgaactgttggcacagatcctcccaagagtggacggacgcgggtggcaagttcattagccaaccccgtgcctgtcccttcagggccatgggaaagaaattcgccatgaccctgtcgtcacccccggcggcctcgatcccgatcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaaccgccgccgctcgccgcgccctccgccttgatgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagtttggagcgcgccctgggcgtgctgccatcgccgtagacgaggaggcgacgctccccatctcgccgcccttccccatcacccgtggatgtcgaagtcgcggatccttcgaccctctcgagcg

SEQ ID NO: 32328 - DNA, 1501 bp, Oryza sativa
gattgtttaggagttttcttacaaaagaaaaggatagttgatgaattcattagtcccattatcataccttgtaagtattctgatccgtttcaaaaccatactaaggctgtgttcggatgcgccttttcccaacccctctctctcgttttctacgcgcacgtttttcaaagtgttaaacggtgtgtttttttgcaaaaaagtttttatacgaaagttgcttaaaaatcaaattaatccatttttgaaaaaaatagcaaatacttaattaatcacgcgctaatggattgctccgttttccgtgatcactgttccggatgggaacttgttatagcgaacacagcctaattgtcttgttgaaaaatactaagacttgaatatatgttaattgagttttttcccatgctgttgttaaacctatataaattggaaacctttttataagaaaattcccatgttaaaatatatctagcagttgactattagttaggtggatatatgattctagatctattgaaaattattgttaaaaatatacagtcgaaaataacatgaactctttaacttttactttgtctctgaactgaataaaacatgatcaatatcgtggatccttccgttgatttttttttcaaaaaattagaatcaataaatcaagctgcacctagagttttccagcacaaaaagctttatatcgcatcatctttcagagcaaagatcgaagaggccagaacttgtgttgcaacaggcgcaaagcacctcttacttatgctgccatagtattttactacatccgtcccaaattagatgtcattttgatattatactttcgtcttatttaaaagattagtgcaaatataaaaaaaataagtcataccgaaagtacttttgataataaagtaagttacaataaaaaataaataataatttcatagtcttgtaaataagacgaatggtcaaacgttaaaaaagaaaacttaaagcagcaagtattgtatttacttcttgtacagttttttcttaattgtacaagtaactttttactcctactttttccaatgaaattggcacgtttgttgccggtttaaaaaaaagttgcacctaagttggactctcagttattgttttattaatttattttaaaatttaaaatggatatttagtaagtcgtaactaatagatcatagaatccttatttggctataactctggaacatagccaacatatttattgtatgattaaaattatagtatttatactatcaataataatagcatgtataaaatcaggttgacaagatttattcaatctattatacgaatttacgtatcatgactattggataagaagttgcttatccatgttcattactagtcatctctaccacttctcttcacatttaattagatacacatcatgagttatcttaactcatttgttcaagttagtataaaattaccaaccattggatcaatgagtttcttgttcttatttattaatcct

SEQ ID NO: 32329 - DNA, 1501 bp, Oryza sativa
ctacttgcgaaaagctaaggctccttttggtttctttattttcaatagtttgttgctaaaatggttattgatcttttctccctctttcaaaattgtagatggcagtgaacgccagcttcagttcccacggttttggcgagggtcaccacgtcgctcagcttcgtgacctcgcccgcttccttggcttctcgtgtcccgagtacacggggtactccgtggaccgtgttccccctcgctgtgagctctgtgtacctttaccctcgtggaggtatacacggagctggcctttgcccacaccacttcactgtggccaggcccactctccagatcgcgtaccaggacctctcctggactgcgcttcgacgcttggcccatgactacagccaccgtctcgggggctctgccttctggcagctcccacgccttccttctggccacgcagacgccaggtacccttgtccgtacagcgagtctcagccagtgctgactcgcatggtggagctttcggaggcttaggccactcagcacgacctactcctcgaggcttaccgctcctttgcccgccgatacgccgctctggaggcccgtctggccgaggagggtgtcacctcagttgacactgtctcttgggactcagcccgcctatgccacgccagccacctgtcctcccacagctctcgcggctcttcctgcactcccagtggcccgcgctcccccagctcgcgtgcgccgtactcaccagtgtactccccctacccacacccagttagcccctcctacacccccggacacaccccagttgcttcctcccgccgtggcccacgctttatccgcactgtgcggaagcatgttgttggttcttccaccgtgttccgcttcgactacccagctcccccaccgccagcggcccgtactgctgccggccctcgacaggttccgccggtcccttcgcgctagccgatcgacgtttcttcgactgaggagccgactacaagaggcagccaggcagacgaggagtagaggaggcagtcttcagcagctgtccgtgtgttaggcccttttgttccgccgccaactcttttggagtcatggcgagatagtgcgtgcgtgtgtttgatgtgggtgttgtttggtagtctggttctcgtaggtggtgtgcgtacagtcaagctcggcgtagctctgtgacttgtccacacccgttgtatcaggtgtttttatgatttgaaaaatccagtttatgcctagtgcgtgctatctgagttgttatttactttgctccttgccctcctaagtgcttatctgattcttacctcgccctcttcggtttagatggctagccgcccccgccgtgctgctcatgcatcagcctgcttcggttttgaggaaggtagagttgagccagaagcaaatcatgagtcagctaatgagcaatctcaccacagcaaccgttcgcaccgtactgcttcccgcaatgcagaagttgagcaaccccgccgca

SEQ ID NO: 32330 - DNA, 1501 bp, Oryza sativa
gtgagctcaagctgctgtttgttacagggacgctgtaatttaggtgcctaattgggctcttattagtcaatcatttgcactttgtttaatggcttgtctgcctctactcactgctttggttccacagtgagaaattacccggtatgattttgatttggacactaccaaatctatgtaactatgtttgatttgatttcttaacaaaattttatgttaggcatgtttaattcccaaacagaatttttcgtgttatcacatcgaatgattggacacatgtatggagtattaaatgtagaaaaaaaaataattacacagtttgccaggaaaatgcgagacaaatcttttaagattaattgcgccatgatttgacaatgtggtgctacagtaaacatatgctaatgatagattaattaggcttaataagttcgtctcgtaattttctagcggaatctataatttgttttattattagactatatttaatacttcaaatgtgtgtctatatatccgatgtgacatgcagggtaaaaatttttaacaactaaacgtgaccttataatatgatgaagggaggatagattatactatatttgtgtatgattttgtgataatatttgaggatagaaatgaatgaattaactattgtaaagtttaaaagttgtataaagttttttaataattataatgtttaaccgtttagactggccataataatctataaattataggagaaaaaagtgctaaattttgacgtggttggggcattcaaaggaggattagtaagctgaaacaaattaatcaattggagaacttatgtccgagtacgtaggctgcattctcccccacagcctcgaaagcgatctcaaacgaagaacaagtccacgttaattaaagtgaaaatgaaggtaaccagacatttgaccacccaaccgtgaacgctttcaatgagaacacgacaccgttcagtctcgtcagctcgattcgatagggatatccatttgcggaacacttgacagttgacactgataatcaaaacaaatggcaggagcagccgggctgatgagtgacgacctctactcactgctttgtaaatatgaatatttgtttttttatttagtaaagattaataaaaaaaattcagtcattcaggtgctcatatagatgaatggatagaatacgtgtgtactttaatataggtgaaagtgtgtatgttgtaagcgactgtgttggtattatatttccaaaaagagttaaccatatcgttgtcgtgattcaattttaaattctaagcatttaattggctaaaaatactttgatttcagtgtataaagaaacttatattagagcaagtttaatagtatagccaactactaactccaaatcatatatatctaatataatagcacattcatacaatagttaactatagaaatatattacatcattaatatccggttatacctctcatacacaaataatattttagagtccgtgttgcagc

SEQ ID NO: 32331 - DNA, 1501 bp, Oryza sativa
gtgatgtagatcgagtgcatctcattttagtggcttctgatccgagtggttatcctcatagagtgtacctcagtagatgtaaaaattaaatcctgactcttacaaatactcagatgatagccctcgtgggaaataacgaatagttcactcgttgagcataagaaattgactcatgatcatgaatttatgttgcatgcatctggaacaagtccaaattgaaggtatgatcatcgcgcttgagttcatgagccccctaagcatgtaacatgtacttctgttgtagttttagttgtccattgatggtagcttatgtagtcggcatggaaacgagatgactaacaaggggatgacatcgcccatcaaaggtgacaaagatattggtggtggtaaagacagtggcaccaatcaaaggtgatgaagtcgcacagccgtggaggcgaagaaaccagtcagcagtaatatggtctgtcattagtgaagatgaaggcgcccagcgatagcgacacagttgtgtagccatggtggcgaaataatcagtcggtgacaaatgaggcagaagatgaagatgcccattagcggtgacataataagctagcggtgaaggcgaagataccaatcggtggcgacgtaatcaagacgacgatgaagaagatcttatgatgtggagttgcagtatgacatggattttggggacgaccatatggaggccgacagcatggcgattcctcaaccccaatcgatgaagaagagcagaaaggcgcactcttctcctcagagaattactctcgataaacctacttcaagggggagaggaagaggaggaaaggtgcaggcctcatttttggctccgaagaagctagatctgggcaaggggcatgaagagactaaggggaaggaggtccagaagaagtacgtcgctccacaagagttccaactaggtatgccattgattggagacgacgtgctagccacaatgggcacctcttgcaaggaccttcacgtatactaaatggagaaatctaacgccaggagacagaatatagctagcaatatccttggagaccacgatcgaaagccattccttggtccaacaaattatatcgtggtcaactttaaggatctattcgacctcgacaggctccgagcggtggacacaaacctacttaagtgctactccttgtaagtattgtcgctcaactcaatttagtaataacaatccatttaacccgcttataagatcgtttttcttgcgtataggttaagttggcagtggtgtcaggagaatgcaccggaacttgccttctttgatccacaagtggtcactgtcacaaatctcgagaataaccattaaggattggtcaactacatctacgacaccttttggtcctaccaagacaaggagtacattatgtgtgcctataataaatagtaagtgtgttccctaaacatacacaattgcatgacacgtatagctttagtatatatcacttgttataaaagt

SEQ ID NO: 32332 - DNA, 1501 bp, Oryza sativa
aattagccatcgtgacgagcgatgggctgcctccgccgccgccggcaccgccgggtcgcttcatgccgagttctagtaaaattcagtgaacgcctggtcgatctctctctctctctcactgcgagaagacgacgggcacagaagcgtaggaatgacgcgggtgcctccgtcgctgagtcctcgccggtcttaattccacgctgcgatccatggccaaacaccacgtagccaagtccccggtccaaatgctgcctagaattgcaattttgttgcgcggtttctcatgatccaagaaagggaccaggggatgagagtgtggagtgtggagtgactcttcttccctccctacctctctctctctctctctctttctcggtttcctttctgttttcgcaagacggcgcgctgtaccctgtgtgtattaataaaggcgagagagaccaagagagaggagaggagaggagaggggggcgctcgggttaggtagagagggggtggtggtgcggttaggaggtgaccagggttaacgtgacgtgcgtttgcatgctcatgtgcaagacagtacgaagaggcgcggccgttctttgcgttgagtccagtaacaaccgaacgaactagcgcgagtacgacgactgactgtactcccggcactgaaaaacgactgaatcgacgtctgatctagcgtccaaagtcgaatggatttttcacctttcgtaggcattagcttcactcaccaatggtgggggtgcttcctgcgttggtcatggcctaaagtttatcaactttgctatacgtccaactcatgtgtccgacgcatgtacgactgaaacggcagaaaaaacgagcaatgacagcgtcagatatgactacgcgtcgctgagcctcgttgttgtttgcttgcgtactgtgctttctatacactgaggccagaggctagtccggctgagacatgtatcgatatagcttaggttgctattaaaaggattcactccagatgttagattagtttaggccttcaggatatgaaaccaatatattttcacagccataacatgcaagtcctcttaaaaaaaccataacatgcaagaaaaaatgattgaccagacttgatagaaaaacaaggcaccatggcttcaatttccatatttatgaccaaaatcagttgaaaaatcaaatatggccatgtatatgtttgcaagcatggaaaaacaagagatgttgaaaaacgaattgagataaaagattaatagaattgttcatggggcctagaaaatcagagcctaaaataccttctgttagcttcaacctgaatactctgttgcggttgccgcaaaaaaaaattctgattaatcttaactgattggtatggataggagacgaaggggattagaatgagggtttagggtgagaaaggaaatgtagaagatgaaaagtcatggatgtgtatagagtaatatcgagaagaggaatcgacgtcggaatatggagcttcggctggagt

SEQ ID NO: 32333 - DNA, 1501 bp, Oryza sativa
gcctgttccacctccaccgtgcatccgtgatttcatacgtttgaaaagatcaaaagggatgcacctcacctcctccaaaagatcaggcagcaggaaaaagcaacgctcgagtagtctcaccggcaatggcatcgccttacgcatcatgccattcgttatgcccgactgcccataatttcatacatcgggaaaatggcaatgctggcctttcttttgtatgcgcgcgtgtaattttgaaacagacagcaacatgttagagtaggggtcaaatatagcagtcctattaagagctggacttataattgaaataggtataggataaagttagagtcggacactatcttatactctctcttaaatatagagtgggacaacacgatataatcattatgactacaatatagcgtatacaagtagggatacgatggcgactaggccatgtactcatagcggctagatgctatgttgattggggaggagcgcctataatcaaaagcccgaagatatattcttgtgctaaacttcattaacaaatgtcatgtgttcgtatgttgtcatctaacatatcttggtaatcaattactaaagtgatcgagaagactacttgtcgttccgttatatcaaacaacttttataacaagtgatatatactaaagctatacgtgtcatgcaattgtgtatgtttagggaacacacttactatttattataggcacacataatgtactccttgtcttggtaggaccaaaaggtgtcgtagatgtagttgaccaatccttaatggttattctcgagatttgtgacagtgaccacttgtggatcaaagaaggcaagttccggtgcattctcctgacaccactgccaacttaacctatacgcaagaaaaacgatcttataagcgggttaaatggattgttattactaaattgagttgagcgacaatacttacaaggagtagcacttaagtaggtttgtgtccaccgctcggagcctgtcgaggtcgaatagatccttaaagttgaccacgatataatttgttggaccaaggaatggctttcgatcgtggtctccaaggatattgctagctatattctgtctcctggcgttagatttctccatttagtatacgtgaaggtccttgcaagaggtgcccattgtggctagcacgtcgtctccaatcaatggcatacctagttggaactcttgtggagcgacgtacttcttctggacctccttccccttagtctcttcatgccccttgcccagatctagcttcttcggagccaaaaatgaggcctgcacctttcctcctcttcctctcccccttgaagtaggtttatcgagagtaattctctgaggagaagagtgcgcctttctgctcttcttcatcgattggggttgaggaatcgccatgctgtcggcctccatatggtcgtccccaaaatccatgtcatactgcaactccacatcataagatcttcttcatcgtcgtcttgattac

SEQ ID NO: 32334 - DNA, 1501 bp, Oryza sativa
tatcactccgtctttggatcggacttttttcgtccggtttttttttctcggtttttttcgtctgatatttttgacgaactatagaagcccctcttatttttttaagtaagtagcgatagtgatacgaagaagagagactagagggaggcagctgatcgcgcgcgtgcacggccgcgctactagctgcgcatcagcgccccccgacttgagcgacatgtgagaagcttgtacagttatacgtgagttctcgtggccgtgcacctaccgtatacgtatacttatatgtatgccggatggttttccatgggtttaattaaagcagcggcaagctgggactaacaccgaagctgcatatatgggccggcggcctgttgtaggtcgttgccatttggcgagaaatcctggccgcgtacgcgtacaggcgtggatatccggccgcatatacacgatgagcgtgaagcgcaactacaggccgccggcccacagtatatccgcagcaatggcgcccggaggcttcggagcaaaccaacgcgtggccgcggcggcgccgaggagtgcgcggccggtgctggttagggttactcctgtgcctataaaaaggaggccatcgacaggcgccattccacacagatcatccactgccattcctttcatctcctcacactacacatagccatttcacatacactccacagcacaagtgcacaaccacaacatccacctccgattcagaatcatccacaccttcatcgatattcagctacagcccatctacacctcgcgacagcacagccatcgatatatcgtcctggtgacaaggcgctgcacgccggtggccggacagaacgcgtggacagcggctgcgcagaacacggaggggagcgcgtacgtagtcagccatcgccatggatatatatagcttcttgagtcttcttcttgttttctttctctttcagttcagttcatcatgcgtgcacgagatggcgacgagacgagttgccggtgctgcctgccggagatcgtgttggtccctctcgtcggagacgccggccaccagtgacacatgtacctgctgccgcgacgtcctcgcctcgccggccgcaatctctacctcacgacgtctctagctgggcgatgtgatatgtcatcgagacgctggacgtcgtcaacttgccggtcgcagcctcctcttcgcgacaccaccaacgtctgcttgccctcgtcggctttgccattttcctcacactcatcgtcgagccgctcgaggagaacatcagccggagcgccaacactcacgcccgcacggtgtcatctactccatccgtgccatcaaccgtttcgttgagtcgccgaagcgctgccaagcagtgctcgcctttgtcgactaatcgccatcgtgacgccaccactactggagaaaccatcttttggtcggtcgaccaaattctacaatagtccaggctccattaaaaatcgggacaaaaaacaatttttagtcctg

SEQ ID NO: 32335 - DNA, 1501 bp, Oryza sativa
gttgctcacatcatattttgcaaagcagtcggtatatcactcggatcatgttgatcggggattcacaccgcatatactatatattaatattaagtcacttggttggctacaattatcgaaatcactcggttgtttggtgttgacggtccttaaatcataatatctgaccatcaatacctgcatataacgaaataaaacatggtatccaacgtagtggtaggtattattactaatcatttccactagtgttggtgaaatatgtgtatgcgagtattttgagaagaaaacacatccgtcaagcgacaaactgcacctccgcgcattcaggacacatttacacggattggaggccccataagtcaattaaacaactccaaatgggcccaactatcatgccaatgggctgagggcctcaaaattagtgtccacaacgaaaaatgggccgaatggagccgtcccgggttcggccgaacctccagtttggccgaacgattttggtagccgttgatcgccaaatttcacgtggacggtcctgatcacatcctaatggcggttctggggtagtttggtcatttcgcataggttgtaaccgtcatacctgcctataaaagaagcagctcactctcatttccaacacacaactttgacctgaattacaagaggctttattgtatcttttgtacattagaataaggtagagagtaaggggaagttctggaggagtgcccggaagtttggcgctcatccgacttctacctcaaggagtgtagcttcctaggaggaattctggaggagtaccggagccgtcggtacactctgcttcgggttcggagaacttcttctataaagtaagcattcgtgtttctttcttatgttatttaattactttgtctaagtaagatagatatccatctttgcgggttcattgtttagtatttatactaagtgctctagtactaggactccagatagagaaggaagctcttgcgcaagtattagagtagtaattaataacttagacgtggtgtctagtttagagattacctttgttagttgtgtatcccacggatttgttagaggtagttggcaggtggtgatagccctgaatcccgtcctagtaatcctccacgttcggatacatcatagagctatagccggaaccacgctggcagacaagcaggggtcggtgcctgaagcaacagatagggaattacctttacttagcttaaataattaaaaatacatagagagtcctctctagcctgcctaccatcagttgctgtccttggatagtctcagccttaggtagattacacacattccctgagttcgatatctttttggggtcacctgaaggtgaagtgctacaacggtattccgtgcgcttgcggatttatctgtggtcgtaagaaataccaacaagcatttttggcgctgttgccggggaacggttgctaatttatccgagtctaggtcatcctcatatctttatttttacttc

SEQ ID NO: 32336 - DNA, 1501 bp, Oryza sativa
ttgaaggatatacattctggtatttgtggcaatcacgctgctgcacggaccattgtcggcaaggcttatcggcaaggttttttctggcctacagctgtgtccgatgctgataagattgtgcggacatgtggaggttgtcaatttttcgccagataaactcatctgccagcccaagatttgcaaaccatcccgttgtcctggccgtttgcggtttgggggcttgaaggttacactcatctctttgtggctgtcgacaaattctccaagtggattgaagctaaaccggtcatcaaaatcacggcagacaaagctagagattttttcatcaacaatgtgcatcggtttggagtacctaatcggatcatcactgataacggcacacaattcactagcagagtatttaaagacttctgtgaagactttggcgtttaaatatgccacgcccacgtagcgcatcctatgagcaatggacaagtcaaacgagccaacggcatgggtctacaaggaataaaggcacgagttttctaccgactgaatccctatgccggcaaatgggtggaacagctgccatctgtactttggtccttgcgcaccacccccagtcgggctacgggctagtcgccattcttcctagtttatggagccaaagcaatgttgcctagcaaggtggaatttgaatctctgcattttcgtaactttcgcgaggagcgctacaaagaagaccgagtggatgatctacaccgactggaagaggcccgcgaagcaaccttaattcagtcggcccgatacttgcaagggttgcgtcgctatcataatcgtaacattcgatcatgaaccttcttagtcggcgacctggttctaagaaaaattcaaactacacgatatcggcacaagttatcccccttatgggaagggccatttataatcttagaagtcacttggccaggttcctatcgactcaagcgtgaagacggtacacctatcgacaactcctggaatatcgaacatcttcatcgtttttatgcttaagttttacttttgtatttccctattttgactgctaacatcaagctcccccttgaagttatcagtcgggggctattataataataatggagtgtgatctttatcaattcaatttgcttacttgatttatcattgccttgcttgatttttcggattagtccatgaggactgaaagctttttaatagcttttgcgggttttaggttcaataaggtttgacaaaagcttttaagaaatcagaagctaggtttgaaatactgagcacagcataaattcatcagtattgtacaaattgtgcctccatcatcatcatcagaatcattgttgtcaaattacatcaattagtatcagtcttttcatcatcagagttatcaggaccagtcggtcgaagatcggtgtcctgcaatctctcaactacatcaaccgctaccttatcgatggctttttgtgcgtcattgatgaggtcaagagcagct

SEQ ID NO: 32337 - DNA, 1501 bp, Oryza sativa
agttcgggcttcaacacctatattcttacttactatcgatccacagtttgagaaattttaacccttaaatacccttatctatcacccaccaatataacttttatagtaattaatggaattctggtcctttattttgaaatagagggatacatgtgtttaagagtgctcaacctgctgggcgcattactaaaaatgatttttttcttagatgcctcatttatttttacaaacaggctataatggatacagtatccagtaacgacatattaggaaaatcaattttcacatatggtcctgctaagaagccagagactgcattcgtatgtggccacaaatccatctcttcctctccttttctctcatgttcttccccttttttctcacagtctcctttattttcctctccttagtctctccttcctcatctcctctcatttcgtctcctccctttatctcaccactcctcgacaaccagccaccagaggcctcaggaggaacatgtggtaggagagggcggtgataggaccggcgctggctgcttgacgagtggatccgccatcgttggatccccgatgtgatgatccggcagtggcagctccacgatggctcgatctaatggcagtggaggcatcggatctagcgctacgagaagatgtgatgacaatggcgacaactaggatgacaacgatatcctcaagagcggcggatccggcattgctgccctagggaggggtggtttgccaccggaactgcggggacgacgacggcggccttgagtaagcagcagtttcaagaatggcatatcagccgccgtgttcctccagctcggaagtggtggatccgcggccgctcggaaagggagtgaccactaacgaccatggcagcctttggagcggtggtgatcacgtgctccgagcactaccgtagaaacaacgacggttcctaggcacgggagcgaagacggcggtggataagagttagagtttctatttttggatttcttgatttatatgtggatattatggataccccatacccacacggcatgtatattcgacttagtatgggggtactatgtatagatagaatatctttaaaaggtttcgggttaaatgtctaaacttgtatatcaaggaagcacccgggattctagtaggttacgattgtatcttatctgtaactacctattccgttagagatatgggttgtactttgtaatacggaccccttcccctatataaggaggggtccgggtgcctcttgggacacgatttttctcccagatcatacgatcaataatacactcggcggatcaatccccggacaggagtagggtattacatcttattaagaaggcctgaacctgtataaaattctttgtctctaaacccatccacttttccatcttgatagccacccccttttagtattgccgaaatcttgtttcgacagttggcgcaccaggtaggggtagcgtcaagttcatcgctgactagtgcga

SEQ ID NO: 32338 - DNA, 1501 bp, Oryza sativa
aaaaatcacaaatataatgtcgaaacaagatttcagcaatactaaaaaggtggctatcaagctgaaaaagtagatgggtttacagacaagaaattttatacaggttcagaccttcataataagaaataataccctactcctgtccggggattgatccgtcgagtgtattattgatcgtatgatctgggagaaaaatcgtgttctaagaggcacccggacccctctttatataggggaaggggtccgtattacaaagtacaacccatatctctaacggaataggtagttacagataagatacaatcgtaacctactataatcccaggtgcttccttgatatacaagtttagacatttaacccaaaaacttttaaagatattctatctatacatggtacccccatacccagtcggatatacattccgtgtgggtatggggtatccataatctccacagtagcccctaagacctttatggtcaacgaaatagtcctttctcgtaattcaaaacgataatacaagtgattcagcttcttctgccttggtgtcccgagtactgaagtcaaagactgtgaagggctgaaaataaaaagaaaatcaggtgcatcgaccagatgcacctaattaggtgtagcccccgactatgtgatccatccgagtggttcaaggtacattacaaccaccgaatcactttgggaattaaatatttaatcttaagcagcacgtgataaaatatccaaccgactgctttaaccataatacacccagaaaaggcataacgagacccgagtgaaaagcactctaaaagtctataaaccaacatatatgacaagaatctgagtaaaaaactcttaaaggattcatcaactgttgtataaagaatgacaaatgacaagtcaatatggcctaagctgtgacttatgtcaatatcaaaataagcatataacatgctgaggggatagctatctgaaattagccatctcaacaaaacccaagcagctttgcaacctaaaaaggtcaacaaaattagtattacacttttctaccgggcaccttctttatttcgcattacagtaattccaaagaattatctaactgcatcgaaaaggatttcaacggcattgggctatcctgttgtgagcaatttttaccaaggcaaaaatatatgctgaaatccctaaggaacacaaccagccacgccaatattgaagttgggctgaaagcactgtataggcctaggcccattagcacctcccgataccctaacaaaaaacgctaaacaagtgccgcttcgtcttccctgccgagacctccgccactttccccattctccgctacagtacagcgaccactccggcgagaactagggctagcaaatccacaccaatccactcctctcgaagcttcgtaaattcgcaaaaatcttttgcgcaaccaccgcaccaatctccccttcattcatcgccatccttgcttcaaatcccatcatccattctcgcatc

SEQ ID NO: 32339 - DNA, 1501 bp, Oryza sativa
cgatgttgacgaagaaatctctagccttgtccgctgtgattgtgacgactggcttggcttctatccacttggagaacttgtcaacagctacaaatagatgagtgaaaccaccggtagcccttttgaaagggccaaccatgtcgagcccccaaaccgcgaacggccaggataatgggatagtttgcaactcctgagctggtaaatgagtttgtcgggcaaaaaattgacaaccttcgcatgttcgcacaattttatcggcgtctgatacagcagtgggctagaaaaaaccctgccgataagccttgccgacaatggttgtggggacacccgatatagtcatggtgccccacgaatatgtaactgcccaggatgttcagttaagcatgaaatgatataaaagtataaacttcgattatacaatactcaagtcacttagttcacaacacaacataaatacaaaccattacatatatggcctataaagccttatttctacaaacagataaactgctagactccaccacaggaaatgcctgagcgtagggtgacctagaaaccatagctgtcccactctaacgggtcaacaggatcttcacaagcatcctcctcctcatgatctgaacccatttatgagtacaaaaggtactcagcaagacatgcttatgataataaatacaataattgcaatataaaacatgcagtatcgagagctgcaaggtttaaaccctaaccttaacagttatttcatagagcctaacttaataaacatttgatataaacaacactattgaacatttaatttaaacaataataacgagcataaaaatataaatgttacttataattaacatgaatagaacattaagtaataaataagttaaccatattaattaatagccatttagtttaacttgtgcccataatctggaatcacccatagacacatctccattaaccgggagcacggcgtattcgaatactcaacgactctgcagcgtatgcccagctttacccgcacgatacccacagctggccgggctgaaaagtaacaaggtgtaatattgctccatatatctttcccttctgcctagtaagttaaaggatgcttgggatgttgctcggagtgatccggtccgaggtgtgtaccaacctacgtccgcatccacttaccattgttcgttactcgatgggcagccgagaacttcatgggccaatagggcagttctgaactctcggggcccatcgagcccacatatataaatcatataaacatgaaccatgtcactttgcttcacacacttgaaagctaatggcgagtacactgaaaggcctgcagaagtttaatcaattggagcaatatacggccaggttcgacaaatcgatcgtgtggatgggcgaaactatgtcattcttattgacacaagggggtttattattatatcaattttaaataagaaataaccataaatatatccatatatccatcacgaccataaacagg

SEQ ID NO: 32340 - DNA, 1501 bp, Oryza sativa
gaatccctaaagatactgtcgaaacaagatttcggcaatactaaaaatggggaggctatcaagctagaaaagtggatgggtttgaagacaaggaattttacataggttcaggccttcttaatcaagaagtaataccctactcctgtccggggattgatccgccgagtgtattattgatcgtatgatctaggagaaaattgtgtccctagagggacccggacccctccttatataggggaaggggtccatattacaaaatatagcccatatccctaacggaatatgtgattacagataaaatacaatcgtaaccgactaggatcctgggtatttcctagacatacaagtttagaaaactaacctgagtcctcctaaagatattctatctatatctggtaccccgtacccaaccaaactatacatgccgtatagatatggggtatctataatctccacagtagcccccgagacctttacagtcgacgaaataaccttctcttggagcataaagcaataatccgtgtgcttcaatttcttctgctctggcctcccgagtactaaaatcaaagactgtgaagtgcgaaaaaagaaaataaaaactgggtgcatcgagtagatgcacctaattaggtgtagcccccgactatgtggttagttaaaaatctaaacatgtagtcaagaaccgagagattttacaaccaaacatcatatagcaaagcatacgtggcattcaataaaacacccagccgactgcttcttggctttaatatatcgagaatagagatatgaaaaggcccgagtgataaacactcaaaaggtccataaatagacatatttgacaagaatccgagtaaaaactcttaagatgatccaccaaatatgataaaaatcatggtaattaacaagtctaatagcctaggctatgaccctcaccataaccaaaacaagcatatgacatgctaagagaatgactattagtaaactagtcatctcgaatcaacccaaacagcttttggagcctaaaaaagcttacaaaaatagtataacacttttctgtcgggcacctttttatttgcatcgtagtaattccaaggaattatctaaccgcgtcaaaaaggattttaacagcatcgggtcacaccattgtgagcacaaattgccaaagcaaaaaatgcctaagtccctagggatcacaacgggccacgctgataataatattgggctgaagtactgtataggcctaggcccattagcactcccgataccctagtgaaataaacactgaagtccaagcgacgtttcgtcttccccgccgagactctcgccattttccccatttctcgctacagtgcaaaaccgcgccgacgaagctagggttcaccaatccgctccaatccatcctcaaaaactccgtgaaatccttctgcacgaccaccgcaccgattccccatccccttcgagccacatctcggaccaaatcaaaccatccagttcacatcca

SEQ ID NO: 32341 - DNA, 1501 bp, Oryza sativa
aaattcctatttgcaatatcagattgcttttatcttgttcttgcttgtttcttcaatttgcttgcaggaatagggttgatctgcaccggcaagatcaacaatccacggagaggtgtatcgatcgctaaggcgcaacacaatgtctcgtatggttgtagtcggatcgtcaacgtttctcccaaatcgtagttatcataactcaccgaaagatcgggccaacaacagccttgagtgtcgagaggaactcaaggttcatcaggtggtatcagagctttcattgctcggtgagttttaatctacccataactagaaaattgccatgaaaaaattgtgccattgcattgtttttatcagtttttgctttgttgagttttgtgttacatcgtcgagtcgagttgctggtgttagcgtctagttcgtttacagatacagtcgtcgtcacctccgtgtatctgttgtcgtcgggacctacgaaaacggaatcggctcgctgccacgattctatttttgtagttttcaaaagtttttaccggttggtttttgcagttgttgagttgcatcttgggtttgctgaccgccgtgcttctgttttggccgtgcctgtgtcgtgcacgagaggaggaaggtgaattaccatatctgattttggaagtagtcaagtttgttttggaaagatatagtagattggattgattaaaaatcagtttcctttttatcccatacaccaaattcggctgccatccactccacctcctggccgactcccactcgcccctttggccgagtccgactccctccctccctttcacagttccgagttttgtgaaacaccttggtgaatttttatttggtgtcggtttcgagatctatttggaaaaacagaaccggcataaattcagcattccatttttgtataattttaattttgggtttagacttttacatttgtgtccctataatttttatatttacgtttgagtccctgtagcgttacattgacgtccttgaatctgtttttgtaaaaaaaatcaaaaaaaaagaaagaaaaaaaaaggcagaaaggtgcaaaaaaaaaaagcaaagaaaagccgcaccctaaaaaaaagaaaagaaaaggaaaggaaaaaaagaaagaagaaagaaagaaaagagaaaatattgttatgtttgagctgaacttcatatatgagagttgtgcatgagttgttcctagtgctatcttatcgtattgtttgtgtctaggctcgcgtctctagtacgttctagcctaggaccagcacgatacttgactttgaaccattattcaactttgcattctctgatttgaaccattgctttcctttgctacatattttaagcctacccagagctctacagatttgattgtagccgtacagcaagtgcttgccaaggcatcgatacatccaacctccattggggtgcttggttgagtcggtgtatgtcaccttttcgcttgcattggtaagaacttgtaagagct

SEQ ID NO: 32342 - DNA, 1501 bp, Oryza sativa
tttcatcattatttggaccagcagggggaaggtcttcttcagggggaaaaggaaaaagtacgaattacccccctgaactattgggtgagtatgaattacccccctaaacatgaaaaccggacgtttttcaccaccgaggacaaggtcaatcgaaacgaagaacgaggaacatcaaccactaatcgaaacggagaacggctaaaatgagaggaaaagtgcactggtgaaccaaaacggctccaaacttcatcgcggatggaatcctccggggagaaatcccatccagtaggcggcgccggcatgaccatcttctagagagagtcgccatggatgtcgccagagaagagagtcgccatctttctagagggttcaaactattttgatgacgtggctaaacatagtgcctttacatctctaatttttgaaaaaaaaattaatgaatgagatttctaatttttgaaatctcattcattaaaacctcacagtttgagcaatcatcatcattaggaataagagattttaatctagcaatttcagaattaagagattcaatgataaactcctgttttctatagatcttctcacacttattattttttgcactcaaaatattaatagctttcccgaggacgaggacggcgacgcgacggcgaccacgacggtgactttctcgagcgacgacgacgacgggatcggcggcggcgcacggctggacgaacggcgacgacggcggcgctaggctacacggggctagggcgctacgggtggcgagaggcgaaggcgagggtggcggcaggtagcggcgggcttgggggtccttttataggggcaaggaggcggcggcgaaggcccacggtgaccggcgacgcgaaggaaattttagggttcggaggagagagatcgatccgaatcgaactcgaatccacggatttccaaacgatttagccgacgattccaagagagaaaaggtagaggagatctcaggaaacatttcccctcaattgatttcaccggagaaggaaaggcgcgagcgaatttggaaggagatggcggcgtggctcggctagggttccggccgggcgatggcgcgaggaggacgacgagtccgataggtgggacccacctgtcagcggccgagggcgctcgcgcgggcggctgtgggctgactgggccgactgggccgagggagagagagagagaaggttttgggccgactttcggcccaaagccaaaagaggattttaaaaacctttttcaatttaaattattcatgaaatgcaattctatttattaaaaatacttccttagctcaaataaatcccagaaaaatctaggaattatagaattaagtaaagtatttaatgaaattttatctagccctattttatattggaatttattatttaaaattagatcttcttttctagacttttaaaataaattttaataattccagttaaacaacaatttatatatttaggatttttagggtgtgacatgc

SEQ ID NO: 32343 - DNA, 1501 bp, Oryza sativa
tgaatagattaaatactaagttcatgctagatcataagaattgtgctcctccggattgtgatctttcttgtgttctttgtcaatcggcagctgttgaagacctcatgcatctgttctttttatgcccatttgcccaaaattgttggagtcttctaggcattacatgggatactaatctatctttggaagcaatgtttataagggccaaattggattatcaggggagctgtttcatggagaaattcctttatgctacttggcatatatggaagcaaagaaatgggttcatttttgagcaaaagatcctctctttcatcacttggaggcaactcttaaagggtgacctctttcttctgttgtttagaatttctgcgagatatcacaatgtaatcataagttagattaatgggttgtaactttgttcttgttttcttaataaagtttttttaacagcgggggcctcccctgctgtgttctcttcaaaaaaaaatcagagatggtaatgctgcccatgatttcaaaaatagatcttctctagctcttaattttgctttgcacccaggcactttggatgagttgtttttaactaaaaagttgttgcaaaaatatcaaattgcttttcatgctagtttgatgtttaacatgatttgtgctaaaaagttaaaacaaccacatgatgttttggattgctcaacatgtactttgagtaagatgaaactaaaagatgctttaggtcgtgttgagtacatggaagatgttgtgaaaaacaatgaagtgctttcttgccccaagtgtcgtaaaagcaaaggtgtcatggtagattgtgaaaattgtgctaatttggaaaaagaggtttcttatttaaaaaattccttgcaaagattttctgatgctaaaaagaacctcaacatgattttggatcaatctaaggttagcacacataaccgtggtttaggttttaatccttatgctcatcatactagacatcctcctgttgtgttaggtgttggtgctagaagtggtgagattttggttaaacctaatactaataaaactgtgtttaaatctgctggtatcatgtctaccttgagtgcaccttctttaaaatccaatgttgtgcatgcaaaacctcctattgttacttgtgttgctaaatcatctgattctactaatgtgtctaaacatcgtgaaaaatatacttgttcttgttgtggcaaagatggacatattgttggtttttgtttcagattagctcataaacaaaaaaggagagagagagattgcttttgcaaaatcaaagtggcaaaaatctggtttttcctcgaggaaactggtcagaccggctactgagcagcggtcagaccgggcaccggtcagaccggcccccggtcagaccgtcagtaccacctcggtcaaatcggcctcggagaaatttttcagaaaattctcaaatcgtttttgcacgtagatatatgcctattggatcttctggtcgtgtgtc

SEQ ID NO: 32344 - DNA, 1501 bp, Oryza sativa
cattgttcagcaggtttcgcacacagatccaggttttgaagaccctgctaaatgcatttgttttaagctgaaagtgttaaggaaaaggcttcttgcatggaggaaaaatctgtcaaagctgttgttacttttgactaactataacaaagtgatagattttttggatctggtagaagaaacaagatgtctttcaatctttgaatggaatttcagggaaattgtgaaaatgcaaatcctcaagttattggaattcagaaagatatattggaaaaaggggtgtactaatagatggatgttacttggtgaggaaaatacaaatttttctagtctattgcaacagagagatatagaatcaacacaacgtctcaggttcttgatcaaaatgggcagtttgtgcatttacatgagcaaaaggcctctctttttcttcagtgttttaagaatagaatgggagttgcaagggaccctaaaatggtttttgacttgagtacactcttcccaagacatacagacctagaatgtttggtggacatattttccacacaggaaattgacagtcttgtttctgttatcccgacagataaagcccctggtacagatggttttaatggtttttttatgaaaaaatgttggcatataatagctcaggactattacagactagcagcatattttcatgcagagtgcactaacttgaaaatcttgaatagctcttatataaccttggttccaaagaagaattcaccagagactgtcaatgattatagacctatatctctaatggggctttctctgaagttcttaactaagctattggcagacagacttcaaggcataatccttaagctagtaagtgagaatcagtatggttttatcaaaggaaagacaatactagattgccttgcttggtcttttgagtacatccatcaatgtcagcaatctaagagggaaattgttctttttgaaactggattttcagaaagcttttgatactattgagcactcagctattcttgcagttcttcaacacatgggctttcctgaaaaatggatagaatgggtgaaaatggtgttctcttctgcttcttctgctgtcttgctaaatagtgttccaggaaaatcttttaaatgcaagagggggggtaagacaaggagatcctctctcaccacttctttttgttcttggagctgagctgttacaaagagttgtgaataaagctttttagttgggtttgatctctaagccaataaatgagaatgatggtagtgggttcccaataattcaatatgctgatgacacactcattctgcttaaagcctctcaaaaggaagtcttatgtttgaaagccatcataaatatgtttgctcagtccacatgcctaaaggtaaattttagcaagtcaagtttatatcctttgaatctatctcaggacaaagcatcattattggctggtattttgggatgccccattggttccctgccttttacttatttgggatt

SEQ ID NO: 32345 - DNA, 1501 bp, Oryza sativa
tagcctaggctcaactctagctcaagtaggcacccgacaacactaagagctagatatgaatcattgcacaactctacactctgaaaacatactcaaaggatgaatattttatctttttctttcttggtgcggccttttttaagcacctttctgccttttcttcttttttttggtgtggctttttctttctttttctttgcacctttctgccttttcttttttatattattttactattttttccaacaagaactaaccaccgacctcgagcagggactcaaatgtaaatatgaatattacagggacttaaatgcaaagtgcaaaactaaaattagatcatctcaaaaatgaaatgctcacatcgcgtaggtttcgtttttataaaaatatctcaaatccgctacttaacaattatatgatatagagaaaactacggactcgatacccgctacccggaagtggagaggtcagtatggtcgtgatgaggtggagggtggtaacagcctcggtcaagtttgagagaggtgggcttgtgtagtggctggtcaaggtggagatggactcttctatgtgccttgatgtgaaacgtacagtggccaaaaaaaaacaaaccgatctaatttgttgttctctctcacgtgcgcgaacaatcacgacgctactcacaagaacggcaggtgttgacggtcattatcgatcagtttcgaccgttaatattaccaaaatagaggagaactagtgatgcttgcaatgcataaatatgttagaataataatatttcactaatattaggtctactaaccttttgtagagaataacaataaagtggaggagaatcgacatcaactcagacgataaatcaatcggacgatatcgagaaccagacttatgtatgaatgggccaagaactcagaattgacatgacaaactgggccaaaattcactgtctgcggagaagaacaacagaggaggccgccagccaaagcatgggctagttgggccggccccaggttcagccgaactagggggttcggccgaaactccctcgcctccgttggatccaggtcttggctggacggttgagatgaagccccaatgacggttggagggtattaccgaccattccagccatcacaaccgtcatagttcagctataaaaggagttcctcttctcacttcactcacacacctcaagcaatagctctctcatttctctcaagtttagtttagtagtatctagctggtggaataggaatagagtagaaatcaggagtacggaagcctttggaagagttcgggtatggctatagtagcttttctcttctcttttgtaagccttgtatttttattagaatactcttctaaatacatttatggtattgaaatactttccgagtatatgagtacttactttacattatgttcatgttatactgaatatacggctagcttatctaggagatgctttggtgcgggtatagtgtttgcttatgcaattact

SEQ ID NO: 32346 - DNA, 1292 bp, Oryza sativa
tgtgtcatgagtatagtcttgtggaaaaattgtgttgagttgtgtgagtcatatgattataatagttgtgccatgaagccagcaagagtatgcttatgatgatatgatgttatctatgatgatatgatgttaattatgatgaactcacaaatttgttttgttaattgaatcaactcctttacaaaagatttgtgaaccaaaactgctttatgctgaaattaaactatatattgccctcctttgaatatatgccttacatgtagtatgttaggattgatttttggcttgccagtacattaatgtactgactcttgctactggaataaccttttgcttgcatgttagacttagtcttcttgagtggtgcgggtttcggttgctctctctaggacttgaacttaatggggtaaacccctagtcggtgtgcttgtggttgggtagtcaagcttctgctgttctctgttatctatctatatttcgtcggtcggcctatgtaactataaagtagttgtaaatttgaatcgctttcatcttatttgtatttgctatgcataaccatgcttaagatgaaagtgtgaatctagtacacatcctgggaactagattcacatgagtatgagttaaggatatttgagatatcgtagatctttagccattttgtcaagtctcctgaatgtgtgatacatctggtcgccgccttcgtgtggtttgacgggcacatctcaggctgaagttgactggcaggctaaaggcccatcaatgtctctaatatccttctctcgaggcgtcggatgtttcattatgtttgtttgatggcttgaattattcacttcatccctcaaatataatgagaggtccggagagcctacgacaccaacggacaaaacctttcaggattaatctagtcctatcatcgaagggtacggggttatccccagagtgccaattcagcacaacaaaattcttaatttccacaagttcgaagtctatgagttcaaactccacgtcggccatcccatagaaaagttcttcttcaatgtgcaagaaccggagttctcgacatcaagcttgggaaaatggtgttttttgtccagatctcacgataaaaaaactctttgatggaaccccattcccaaattcgagacaattgtggaagtgttggctgtctctccttttgagtcccctgaatccctcctcgaagatgatttccactgcatttgttgagaaagaggacgatcttggagaggtgattgagttacccaaaaccgatccgtattcacgacctctatagt

SEQ ID NO: 32347 - DNA, 1501 bp, Oryza sativa
agtactagacattccagtgaagtcaccaacacatataccgattgatctcatcaacccatgcgtctgtcggttcatctcatgttccgatcacctaagaactcatatacaacataatagatctcatccactacatccgcatatcaattatatgcaatgatctagatcataagctatacaaggcggctctgataccactgttgggatacgcgtaggctacgatagcataaatcaaaattttctatcgcgtaaaccaggaaccatgcaagtattagatcatagatcgttaccactcgatgcgttgtgcaacggaagaagacgctgagaagtcgaaggaactctcgcgaagtaacgcgcgtcgatgtagaggaagtaatcgatcgcacctactcgaccttctcctcctcgtgcattctcctcgctgtactcccacgctgattagcaccgcaaaccagcggcgcctttaccggtatccacacgtacagagacagaacgccacaacagatattctagcacccgcgcgcggctagggttttgctcgggagggaagtgacggctagggtttctcacgtgatgcaatgcctccgccggtcacacccctcacgaatatataggatccatcactcgggcctccaaggcccgtaggactcctattcggatccctatccgaattaagctcatattggatctctatcaaatccccttattctggcccattaagcgtgtgaccctgtagattcatatatactcgaccgtaacccgaaaactccttttcggtccacgcgtaaacagcggcccctagcagaacgtattgacccaccgggcatacataaagatcatatcggctgaacctctagtgtatacttgtatgaacccttttgcctcacgatatcgattaagctcaatgctagatatatgccatcctctaatagctcaatcattcactcgaacctgttgatagattatataacttgtgattgactcctcaatcacctttggcatggtcatgcccttccataatctacaacatcgaggggcccaaagatatctctccatcttgattattcatatcccactacatgtttcataacatacccgaaaactacttttatagctacccatttacggagtagcgtttagcggtccctaagtaagctactacatatgttgagaaccatgataatctcaagtctaaggattcaacaccaacactaaatgagattactgatgacacaacacatatagctcttgcagtgtctcgtgttgcgtctatccaacaacatgtgcaccaacatgtgtccacattattaatttgatatctctataccatgatccatgagacatgatcatcaattaatacatatgctgatcagataaacatatttgttccacatatgatatttgatcagggatcctttagaaatagtaacaaacaacataaagagtctcatgaaaggatcacatattcattaaccaataaggagttatctatttcaaggaacaa

SEQ ID NO: 32348 - DNA, 1501 bp, Oryza sativa
attctctacaaaaggttagtagacctaatattagtgaaatattattattctaacatatttatgcattgcaagcatcactagttctcctctattttggtaatattaacggtcgaaactgatcgataatgaccgtcaacacctgccgttcttgtgagtagcgtcgtgattgttcgcgcacgtgagagagaacaacaaattagatcggtttgtttttttttggccactgtacgtttcacatcaaggcacatagaagagtccatctccaccttgaccagccactacacaagcccacctctctcaaacttgaccgaggctgttaccaccctccacctcatcacgaccatactgacctctccacttccgggtagcgggtatcgagtccgtagttttctctatatcatataattgttaagtagcggatttgagatatttttataaaaacgaaacctacgcgatgtgagcatttcatttttgagatgatctaattttagttttgcactttgcatttaagtccctgtaatattcatatttacatttgagtccctgctcgaggtcggtggttagttcttgttggaaaaaatagtaaaataatataaaaaagaaaaggcagaaaggtgcaaagaaaaagaaagaaaaagccacaccaaaaaaaagaagaaaaggcagaaaggtgcttaaaaaaggccgcaccaagaaagaaaaagataaaatattcatcctttgagtatgttttcagagtgtagagttgtgcaatgattcatatctagctcttagtgttgtcgggtgcctacttgagctagagttgagcctaggctaggccagcacattgactagtactttgaactattattcaactttgcattttctgattagcacaattgcgttcctttgctactatatattatgcctcccaagctccacatatatacttctggtcagcaccactttgatccttgcaatcgccacatcacgtccttgaaggtgtcacgaactagccaccggttgtaccgtccttagcattgctgataagacacttgtaagagcttgataaagtgctccattttcctgagttgttgagagacaccactacaccgtgtagctgattattagtgataaccttcactgtttgttgctgtttttgtgtttgcaatgacaggtatgggtggcgctcaaaatcagcgataccaacaaggtaacaataatcgcgtgcccgatgatccttgtgctaaggttatgtttaaaataccatctttttcgggttattatgatgctgagaaatattttgattgggagatgatagtagagcaaaaatttagtacccaccttgtgcctgagcaacatcgagttcgacaagctacttgtgagtttaaagattatgcttatatttggttggctgggttagttgcagagggagctttacctactagttgggaagaactgaatgtatctatgcgcaatagatttgttccaccatcttatcttagagaattaagcaagaaac

SEQ ID NO: 32349 - DNA, 1501 bp, Oryza sativa
tttctgccttgtttttttcttttttaggtgcggctttttctttcttttttctttgcacctttcttccttttctttctttctttagtttttttttacttttttttcaacaagagctgaccactaacctcgaacagggactcatatgtaaatataaatattgcagggactcaaacacaaagtgcaaaactaaaattggataacctcaaaaatgtattgctcatatcatgtaggtttcgtttttacaaaaatatctcaaatccgcataaatatttgatatatggatgactacgaactcatacccaggttcggaggtggaaggtgggagtcgctcggttttctttctcacagcacacgcgcacatacgccacacatgaaaacctaacaaccaggcaactccaaaaccgctcgattaaaacttctccaaaccacaaaaacggaaacctgacaatgattagattcgatttttcaaggtcccggcaacaaccgacaatttacaaaattggacacaaaattgacgtacaactcacaccttgataaaccctagacccaaagtgttgaacagatgcattactcaaaactaaaaattaaatctaaaactaaaccatcactcgatacgacgatgcaatctagaattcaacaatgcaaaatctaatagaacaatgcaacaactaaaattgtctaggtaaagaataaatatttttgtgttgcaattttctggttatgggaagacaaattacctaataggcaaccgcgctctgataccaactgatgagaaagttaggtcccgatcttctgataagtattgataaacaatcaatttgggtggattcgctggacaactcgatccggcttctaaacgaacacgctactgagccccgcaatcgcagcaccacgtctcctctggttatcaaccatgccgaaacccggttgacctcaccgagaaggctaatccctgcatgcgaatcgaagaacacaagcaagaacaagatagattgcaacacaattgcatatgaatgattaagcactcgaatttggggttctacaaaccgatttagcagcaaaactgttcttaacagaataatctaagcaaaacccgactctaaacgatgacggctactgattaagtatgattagggatgtcctagggttaccctaagcctataagctttccaaatccatcttaaagtagactccataagctttccaacaagtactcatgggccccgaaattctttctagatcagcggctaggttcgtttgaagttgatgctatcaggaggcccaaatccgaattcaaaacgtgtagaactttatgtcttgtcttctatggaccaaaagtgacgtggtgagatggaagtgaacttggagaaggttttggtttggtccccaatcaacttctttaattatccatgaattccttacgctcgcctcttttctttcacccaagcaagtacctctgcaaacgaaaacacacaaaactcattgtgtagcaacgtttgtt

SEQ ID NO: 32350 - DNA, 1501 bp, Oryza sativa
agattttcaagttagtgcactctgcatgaaaatatgctgctagtctgtaatagtcctgagctattatatgccaacattttttcataaaaaaaccattaaaaccatctgtaccaggggctttatctgtcgggataacagaaacaagactgtcaatttcctgtgtggaaaatatgtccaccaaacattctaggtctgtatgtcttgggaagagtgtactcaagtcaaaaaccattttagggtcccttgcaactcccattctattcttaaaacactgaagaaaaagagaggccttttgctcatgtaaatgcacaaactgcccattttgatcaagaacctgagacgttgtgttgattctatatctctctgttgcaatagactagaaaaatttgtattttcctcaccaagtaacatccatctattagtacacccctttttccaatatatctttctgaattccaataacttgaggatttgcattttcacaatttccctgaaattccattcaaagattgaaagacatcttgtttcttctaccagatccaaaaaatctatcactttgttatagttagtcaaaagtaacaacagctttgacagatttttcctccatgcaagaagccttttccttaacactttcagcttaaaacaaatgcatttagcagggtcttcaaaacctggatctgtgtgcgaaacctgctgaacaatgtcaaaaaatccctccatctccacccaatagttttcaaatctaaaaataggggactttggaatttttgtgtcaatcttcactacacagggcacttgatcagaaatatttctagtaagggggacaactgttgtgtttggaaaatccaaagtccaaggagctgatgtaaagacccaatccaaccttccaaggaggggattatgctgcatgttgctccatgtgaactttctacctttaagtgggatatcaagcaagccaagagagctaataatgtcattaaaaatgaagatatcattcatgtcagcaccagctttgtttctatcatgcacatacctataaaaattgaaatcacccaggaaaagccaattttgttgatcaccaatcactaaattctgaaccaattgacaaaatcagatcgctctgggccacttgagggccataaacacaagtaagggaccaagtttgagcagtatgtctggaagtgaaatcaacagtcacagagagcaaatttacttgaaccacagttccaacaaacattcttaaggaccagaccaccagaattcctcctgatgcaccactagagggtgcaaaagcaaacgaatcaaaccgttttgggacaaacttcttgatatcagagatatcaaaatgttccttttttgtctcctgaatacagaaaacctaacatgcacagttatcaattttttgtcttaaggagagcaatttttgctctgcattcattcccctaatattccagtgcacattccaagacttgtaattactcatgaataaaataggattgaa

SEQ ID NO: 32351 - DNA, 1501 bp, Oryza sativa
tcgggataacagaaacaagactgtcaatttcctgtgtggaaaatatgtccaccaaacattctaggtctgtatgtcttgggaagagtgtactcaagtcaaaaaccattttagggtcccttgcaactcccattctattcttaaaacactgaagaaaaagagaggccttttgctcatgtaaatgcacaaactgcccattttgatcaagaacctgagacgttgtgttgattctatatctctctgttgcaatagactagaaaaatttgtattttcctcaccaagtaacatccatctattagtacacccctttttccaatatatctttctgaattccaataacttgaggatttgcattttcacaatttccctgaaattccattcaaagattgaaagacatcttgtttcttctaccagatccaaaaaatctatcactttgttatagttagtcaaaagtaacaacagctttgacagatttttcctccatgcaagaagccttttccttaacactttcagcttaaaacaaatgcatttagcagggtcttcaaaacctggatctgtgtgcgaaacctgctgaacaatgtcaaaaaatccctccatctccacccaatagttttcaaatctaaaaataggggactttggaatttttgtgtcaatcttcactacacagggcacttgatcagaaatatttctagtaagggggacaactgttgtgtttggaaaatccaaagtccaaggagctgatgtaaagacccaatccaaccttccaaggaggggattatgctgcatgttgctccatgtgaactttctacctttaagtgggatatcaagcaagccaagagagctaataatgtcattaaaaatgaagatatcattcatgtcagcaccagctttgtttctatcatgcacatacctataaaaattgaaatcacccaggaaaagccaattttgttgatcaccaatcactaaattctgaaccaattgacaaaatcagatcgctctgggccacttgagggccataaacacaagtaagggaccaagtttgagcagtatgtctggaagtgaaatcaacagtcacagagagcaaatttacttgaaccacagttccaacaaacattcttaaggaccagaccaccagaattcctcctgatgcaccactagagggtgcaaaagcaaacgaatcaaaccgttttgggacaaacttcttgatatcagagatatcaaaatgttccttttttgtctcctgaatacagaaaacctaacatgcacagttatcaattttttgtcttaaggagagcaatttttgctctgcattcattcccctaatattccagtgcacattccaagacttgtaattactcatgaataaaataggattgaaacaacaaccaaacagagctagtataactagcctataatgtcatagccaacatagtgctaacaactgaatcaatatatgacaaagtctcaaaaccacttgaccaaacacagacccttatagaattaa

SEQ ID NO: 32352 - DNA, 1501 bp, Oryza sativa
accagctttgtttctatcatgcacatacctataaaaattgaaatcacccaggaaaagccaattttgttgatcaccaatcactaaattctgaaccaattgacaaaatcagatcgctctgggccacttgagggccataaacacaagtaagggaccaagtttgagcagtatgtctggaagtgaaatcaacagtcacagagagcaaatttacttgaaccacagttccaacaaacattcttaaggaccagaccaccagaattcctcctgatgcaccactagagggtgcaaaagcaaacgaatcaaaccgttttgggacaaacttcttgatatcagagatatcaaaatgttccttttttgtctcctgaatacagaaaacctaacatgcacagttatcaattttttgtcttaaggagagcaatttttgctctgcattcattcccctaatattccagtgcacattccaagacttgtaattactcatgaataaaataggattgaaacaacaaccaaacagagctagtataactagcctataatgtcatagccaacatagtgctaacaactgaatcaatatatgacaaagtctcaaaaccacttgaccaaacacagacccttatagaattaactaaaaagaaacacaggtctgacaaaaactgtcagaacattaaaatcattttccctccatgtcaggcctgggcaccttctttcttcttgcaccccccaggctggattcagctacctcctcaggagctaggctgcacatatccactcccatcttttgcaacaaagagatagaacagtcagatggtgaggaatcagagtgattatcatcaggggcatattcagcaaaatcagactctttaatgttaccatcatcaaggatttttgctatacctgcaagctctttcaatttatttgcaaattttccccttggcttaccaatgcccattataggattcacttgtagttgtacttcctccttgctctgctgcaaccttgcactctgcctcctgtaaggattatagagtaaggtcttgccatctctttttttcactggagccttaggtagcacaggaagagctagtgcttgaccaacaaggctagaggaaggctgaacagacaaaggcatgacttccagcacttccatagcatcttgggcctgggaattcatggtatcatcatcagtcttagtgggaaccagggcccaatcctttatctcttgtcacgtccagaaattcactaataatttccgaacttatttgtgcataaaatcttcgtccaggaaacagccgaggtacacaaactgacaatttaaaatacaaatccatcctaataatagcgttacatacttacaaaagaaaagaaaaaacaacagaggaattaacggcctagcgatggcttcagctccactcccacaggcagctcaactggggtataagctaaacgtcttctccttctggatcctttttcttcaactgaggttgattgattattgcaaggtgag

SEQ ID NO: 32353 - DNA, 223 bp, Oryza sativa
tttcaatttctggttgatgttggattgcgaattgtatatgtttttttttccaagaaatatatacgactttaaagtttagaacatatatttgttgattattgcaagacactggtattcagctagtaccgttgtatgttaatatttatgcaccatgaattttgtagcaagataatatggcacatactgcctgtttaatgtttgatttttcccctttttttccaga

SEQ ID NO: 32354 - DNA, 1501 bp, Oryza sativa
cgtgcgattcaccacgcgtttattcccctctcgttctgtctgtattattaatgattcgaagagggggatttgtgcggcggctaaattagggttccatgctctctcgcctccacgcttttgccctagccgtcgccgcacaaatcgagcgcatcctgccgccggtgtcatagcggctcggagtcgcggggttttgggctgcgctcgtcgatttgggtctcctggtatggttgctcgattcgattcggttcggttcgcttggttcgatttggtgcttgtttgttctgattttggctggaaatttcgtgaagggagttgcagttttcagtcacctgaaatattcaattttttcagtcatttttttaagctgttcggtttgctttttggtccgtgcactggtttagtgatctcagcttcatgaacatctttacttgtcccattgtgccatgcagtatgttggtgaggcctgtatgtgaatcgattttggttcaggtgtcagttagttgattgcgatttgtagtttgtatgcttcgcgaagtgctcatcgttatgtcttgcagtttatatgtttgtgcaattttaaaataaaccaaatgcagttattagggaaaccataggtaaaagaaatttttttatgccctggtaaataaagataatcaattcaaaattgcacattgtgttgatatttttgaattgcacattatagtgctatttccactgcaggctaatgcaattattgtactgttggatgttcattcttctcttgtagatggttccagtttgcatttgtcgaatgcagaagcatgttaatttttcttgtatcaaattttacggtggtattggagttgtaaattgaaaattacatacacatgttatattttgcgattggcaatctatcacagtaaagtaatgtttgttcagctagcacagatttacccatacagttttaggaaagaagtatgaaggagtaacaaccaaaagtgttacacaaatatattctttcttcctgggctaaactagcagcaattaaatctcgccggaagagcggaaatgttcctgacacattaagccggtgtttaaagcccacagaacgaggaagccaatcctctggacacaagcaaaagaccaaactacttaccaaactgttctttttttttattattttgtaatgggcccacttggaattgtaaccattttgtttgattcaacatagcatggacaaactgctatcattggatgtgcagatccaaaggttgcaaatgtgactgacacattttaaattttcaggtgactgaaaactagacgaccaggaattgctagttctcagtcacccgaaatatttaacctttcagtcaatctcttaagctgttcagtttgctttttgatccacgcactggttcgggtgatctcagtttcatgaatgatttgctgttgctagtggtgttgcagggttcaatggtggagtgagctgaattggggagatgtgattttaccggttcagcca

SEQ ID NO: 32355 - DNA, 1501 bp, Oryza sativa
ccggagatcagatgaaggtataaatttttattttggtaatatttatgggcttataacgtatatggccccgttcgaagactatcaagtactgacacacaaaacgagaaacttattagcgcataattaatttagttttagttattttaaacttgaaaaatggatttatttgatttttaaaaaaaatcatataggaattttttcactaaatataccgtttagcagtttgaaaagtatgctaatgaaacggaacctatttatgataagttgttaacaagtgagctattaatctcgaagcaagtgaccgtggcaaagagtaaagttccatttctgcaaatacatccatctactgttggtgcggacaagtttttacaacaaattgcttttactactccatccgtcccataatataataaaccggaagggaactaccaattatattttaataagtaaaagtaaaaaccgagaccagtgacaagaaaaagaaaaaacaaaccaccacatcaacaacagaaacctcgccgagcacttcaaacagcgccaactgaagaaagcttacaacaccaacttgctaacaactaatctctccgttccagaatatagcaacctagcaccatcacaacaccatgctaaaatgtgtccaaatctaacttgttactgcccagtctataccaatcatcctttatttaattttcacttaatcttaccccctattatcctcccgttctttagacaccccttatttctttcatccttaacatttaaaaaacaaaaggtttgaaatgtatattttaatatgagggattagtgagcaagccattgctcaaaatgaaagatgtcttatcgggaatgattagctaatggttgtacgcttacaccctctgttccaaaaagaatcaactttcagagatgaagctaatggttgtacgcttacaccctccgttccaaaaagaatcaactttcagagaagaacttagacagatacttctttagattcatcctcgaaagatggttttctatgggatggaggattcgttgttctatgttgagttgtcctaagttgagttttttttttagaacagagggcttagcatctaagctggcacacagatcacacataatgaatgcgatgtgatgtgatgcgattagttttgctgccctcgaagctgatatatcgagcatgtaacgtgctcagttctatcgcatatcctggccagctcggttgacagcaagagggagcaacccagcgtgcgtcgcgctgaaaagagagcgagctggattgcgacaagagccaagaggtagggtcccgattgcgtggtaacggatgggttcgaggctggtccgttgcagcggctagaatacccatgcccctgcttctgcttcttctccggccggctcgccggtgctcgcccacaccggcgaaaatggccgacgccgccggccgccgtaggtgttctggccggagaaattcgcgaactgcaacgctaatcggcaggcctcacaa

SEQ ID NO: 32356 - DNA, 1501 bp, Oryza sativa
tcttgcatgcaaccttccagaatataattaatcaaccatatcggatcgtacgtgtataacaaacaaacacacagatctaacaacaagttgcatatcccttctaggattacaacacgcaaaaaatagaaacaaaaaatactgacccaatattctgatcaacccctttctactactccatgattaacctctcttcattaccactcaaattaactctcttatcacatcttcttcttcttatgcatgcatacacatatgcaaagtccttctgttattgacatacctggctaataacttcctctcaaagttctccatgaacagtagtagtacgtgctcctcttctcagtaagtactttaacactacatagtaataactctaggctacggctagtgtcttccttggcctgccacggacgggcgccgccgcacggtgagggctgtggtggcgagccagacctcgccgctccggccggcccgcggccgccaccgcctcccgctcccgcgcctcgtcgacggcgatctgctgccaccggcactcctcgctgcagaacccttggtcacctctacatgtacacgagattatcatatatgtacatgagagtgatatattttatattaacctatcttatttttttaaaaaaaaattaataactatttagatgacatgtaaaaatcgaagggatattttctcgaggatgaaaacatttttctcatgttcatgcatggatgcatatgcatgataaatgtcttcttgaggtttgttaggtttttggtacctatacatgtagacatccttggtagggctgagctcacgccggcacagggagcaggccttgaggaagctgcacgagacggcgccgtggcgccctgcggcggcggcggcagcggcgcgcggccggaccatctgcttgagcactacgctcgccgcgtgcgcgtgcgcgtgccgaccgtggtggtgctggctgtgcacgatgatctggagcccgacgacgaggcgctcgcgctcgcgcgcgcggcggccgccgccgcgcgtgccggagccgtagtgtccaccggcgccgcccatccccatggacgccgcgacgaggtggttaccgccgcggtggcagtggacgacgccaccctcctcgccgaggtggaagatgctctggcttcttggaagcatggctgccggcggcggcgggtggaatcacctcacctcaggtgaggcggtgagaccaccacgcttggagccgaatagctaggcgccccttgtggcggtaggagatgagagggaaggatgaggggaagtgaaggggagaggagtgatggatatttaaaaccaccccatgtccacaaaatatgttttttttttattttgtgttcactgcttccatatgactcaatagtagctgatctatagaagaagaatcttctattgagattggggcccaatatatggtataaggttgtaatatgctctctctaaaactgtccatataaggagtcatcaagtttaaggagg

SEQ ID NO: 32357 - DNA, 1501 bp, Oryza sativa
ttctcgttttgtgtgtcagtacttgatagtcttcgaacggggccatatacgttataagcccataaatattaccaaaataaaaatttataccttcatctgatctccggtatctgaggggagttcagaggaagggtggtaattgatcggattaaacgtacgtagcatggtgacttgtgtggctcgtatggatttgaatatacgatagatatttttccggtgaggacagagagtgacaagctcagagaattcgctagctggaccaccctatatgttaatgcatcgatcgcatgagatgaaatgattaaatgaaatagtttgaaaactttcgtcgttcaaaacttaaaaaggcaaaatagccccatggatggatactgctgggaaggtgactggcttgtggccccacgtaaccagcgactagtgtgccctacaggagaaaaacgaaatgctggcacggtcgacgtagcaaatcgaagctttgcttggctaagaacgcatcaaccatctaatccaagtcgccctcgatccgtttaataagagtattgagaccaaggaaaaatttttgtttcggaaaagtttatagattttaccttgatatatagattagtatatgttgaatttgatggtgcatattcaggcgcatattcattttagcctggaaaaagaaacttagcctgcaggtcagattctatttaattttgtatgggtttgtgtacattttcaccaatttattgtgattctatatgggatcgggatttaaagggaagtctgaggcctgtcttaattaatctatgattagtatgtagtgtgacatgaaaagtatcacaatgtcggctttaatatacagggtgattgtgttagcgattcttatgtccaacaaaaaagagatcagcaaatgtacatatatgggtgaatttttttacttaggaatattctaaagtattgaatccatgagaaacgcaagtgcacttctccgatcaatccttcggtattttgaagttttcttaaacaaggtaagagatagttttgtaaaaatacaggtttaacatcaatttagtccaaaacttgaacgttaataactcaaacataacatgaggatttgaatcccaaaatctatagttttataataattttattattagatttgtagttttgcgatacttagtcttaaacctatagttttatgataaatttattattaaatctatacttttataattcatcaccttaaatatatagtttgtgataatttgatcaaattatctgtagtctttttaggaaaaaaactacaaataatttactcccttatttatgaaatattttgtgaaagttaccggagttttgtgaaatttactttcttatttatgatctaactttacaaaacatgttaaattaacaaaactcctgaaaatacgagtttaaggaaagaatgtcaggataacatgttgtcttctctttatttattaaaattttgacagacgaattaggatttaacacaaccgcc

SEQ ID NO: 32358 - DNA, 1501 bp, Oryza sativa
cccctccccttaatttcgctggtggcataaattggcaatgtatgcagtacatatcatttgtacctttcaccatattttcagaaaagataatcagttaataaatgttgagagcataaactaactactactaacctaagtagcaaaactatagacaaagagtatttaatagaatcgcaaattgtttctgtccaagattcaagtttgtgcgtttagctttcttttaaatgtcaggtcaatgaataatttgtttccaaaaaaatcacgcgaatagagctgatcagtttctgaaatttacccaaattaattaactcagtcaattcaatgcaattatgcaaatcattactgtgggtatgttgggtctactagaggtaaacagcataaaaaaaatcaatatgtaatcatttttcctacaagaagacacaatggtcctcatttttcttgtacacgtcaatctttatcagtagtacgaactccaatttagacattctttgcaatatatacaacatttttataggatattcataattcaattcaattacaataggaatatatcaagaaaatttctcacgttccaaagaagccccgaagaggataaggattccaatgaatgacataatatgttcatccaaaagtgttcgacatattttattatttggtttcttcaaaaattaagatggtcatatttgtagtttctatgtgcaaattagttgttgaccgaaacccaaaattttttttatacccattgattacaatgcatacgtaaagtttctttgttttattaattcctccttaaactttttttttaaaattacacagtacaacgcagacactcacaacgcacgcgcactcacccctatgaacgcacgcacgtaaaccctacccctatgagcatcttcgaagactggaccggcaaatcttggagagattgacgaagtcaccacaggcgcctcgctatcgacgggtacatcgcctaccactgaaagcacaacatcgttaaatcctggaaaattcctccttaaacttgatgactccttatatggacagttttagagagagcatattacaaccttataccatatattgggccccaatctcaatagaagattcttcttctatagatcagctactattgagtcatatggaagcagtgaacacaaaataaaaaaaaaacatattttgtggacatggggtggttttaaatatccatcactcctctccccttcacttcccctcatccttccctctcatctcctaccgccacaaggggcgcctagctattcggctccaagcgtggtggtctcaccgcctcacctgaggtgaggtgattccacccgccgccgccggcagccatgcttccaagaagccagagcatcttccacctcggcgaggagggtggcgtcgtccactgccaccgcggcggtaaccacctcgtcgcggcgtccatggggatgggcggcgccggtggacactacggctccggcacgcgcggcggcggccgccg

SEQ ID NO: 32359 - DNA, 1501 bp, Oryza sativa
tttataaaattagtcaaacttagagtagtttgacttggactaaagtcaaaacgttttataacctgaaacagagggagtactattttttctgcaaggaatactgaattactacttggatgttggtgcattgcaacggagaaaaatatgcatcaattgggcgccggtatatttatggattatggctcagttggtatattgacaagttcgggtaataaacgggagtaagtataattgtgcatcgatgagaagttcagttaaaaaaaatgggagtttcctttcaagaaaagcagtgcatcaatggttcacctgaacagtatatgtttcgtgatagaggtttgctccgatccggtccaacaaaaaaaatatctcgaaataccggtaccttatggtacctcgtttccgactgttagatttaacaattctcattctacccagctagatccaacgaccgaaaatgatttagtacaatgaggtaccagtatcttgagatactttttgccggaccggagcaaatctctttgtgataacccatctgagaatcatggacactttatgagaagcaagcatgtaatttgcaagaccttgttctgattgcttggtagttataatccctgacttttcatcaaatttctagcagcattatatttcttatgctgtaaaatcacggcgaacaatcaacatttcaatttcaagcccctacagatttatctcatatatttcctgctctaaaacctgatttgacaaaatatatttcacaacctgtgaaatcttgccccagtttttcctaattgcttgatggttcaagcaaaattttcataccatggattgcttgattcccacaagaactagcaagttatcactatccaaatatcgtaggatatcgatagttttgctaaatcttcatatcattcaactacgcctaaacgtgtggcgccattcaagaacgcctgaatatgtgcagcgtgtggcaccatgcacacaataattaaagtaactccaatatctctaacagcacaaaaatagctgctgcaacgagatccaattatagcatatcatcaaggaagaattataccacacttgaccccgtacatgaattgtaaaacctgcaacttactgtagcagtctagcagagatcatgtaaaaacaggtaaaaaccatatttgtggagcaatacgattgaggcaaatagaggtactcgtggttccatatttgacaatttgcaaaaaaaaaaaagaaaaaaaagaagcactatatgctcaattacacacgcttgggtcaatcttcggatgttgattcatttttgtgcagattaggcacaacccacacacagttcaatggctcaatgtgaccataaaatgatgggtagtacatcttgttatccatatcatagaacactggttttctatccacagaatatctagggaagtatatcctatttccatgaccaccatcgggagatcctacaccatgcgatgtcctgtgatcaagaaacaaggcacca

SEQ ID NO: 32360 - DNA, 1501 bp, Oryza sativa
gtgcggccggagccacaccgaggcgagcctcgacctcacgcggcgatggactgatgcgagcgtgaggccggtccgagatggcggctaaggggatgcacggcgacgcgtgaagccatgcgccattcgcatgaagacagtgaggagctcggagacacacgcgcacggcggtgctcatgccacgcgcggcgagactccgacgacctgagccccaaatcggtgagtcccaattccttagggttttctcatgatttgggaaattgccaatcgggatcaatctaattcgagaattcatcatgctttgttcttaatttggggaaatttcagaaattagggtttcgggttttaggaacttggggaaaaaaattggggattttcttaatctcaaccccgatctgagtcccctccttccaattgctgcccaagccataaactgagtagggatagcaatctaaacataaaacttagtctaatatcgatcaacagaacatgaatcacaaaattgaacttaattgcgacatgaacaaaacctaacagaacataaaccctaaaactttaacaagccggcgcttagggagacttgatgcggcttagtggcttcaccaccggagtgatggaacatgcaaaggcctaagaaggctctgataccacaatattgtacttaaatcttaaattcataaacctaggctatgcatgatcacctaatatctcatatgcggaatttggtggtatactaaccggatgaagaagccattgatcgccttagatgcgttggtgtagtcgccgtgaggagccggtgatggagatcaccgtgcggtggcggcgatgggaattcgcccttcgctcccctccaatacgccttaagatcgatagtctgagggtaatcttaggggttttgggaaggcttagagtgtgtgagtagaccctcgtacccgtgagtcaaggttccctttatatgcgtattaaggggatcgggggcgatttcttcttgaggaaaaaaacgcttccgatcatagcgctagaaagagcgacgtgtattcgggaccgagggaatcggtccttaacgttaggtgcgcgtgggcttggggtgggccaagcccattagagcaattctctgactcgatggccagagatcaatctaacacaaacatacccataccacatggagtacaaatttacccctccaccaattctactgcactactaccgggtgcagtaggacagcatctccgttggatctaacccaataaatagctagtgtccactttaatgtactccaaaaatccccttcatatttaatactgaattactccatccgtttcaggttataagatggctactctaagtttgactaattttatagaaaaaaatagtaatatttacaacaccagtatagtttcattaaatctataattgaataaaaataaatgttcataatatatttatcttgggttaaaaatattatatttttttttataaaattagtcaaacttagagtagtttg

SEQ ID NO: 32361 - DNA, 1501 bp, Oryza sativa
attttcaaaaaaacgatgtattccatgtatttactaaaatttacagtaagaaagaaaagaatagcgaattaaaaaaaggaaaacaattttaggctgcgtttgagagggtgagatagtgagtgagtttgtttcgttatccgcgcgcacgcttcccaaactactaaacgatgcattttttgtaaaagatttatataggaaagttgttttaaaaaatcatattagtccatttttgaaatttaaaatagttaatactcaattaatcatgagctaatggctcccctcgttttgcgtatcttctcaatctcctcaatccccttctcctcaaacacacccttagtttacctctttttctagttacggattgaaatttcgatgatttcgctcggaattttgccaaagccgacatgttttcgcaagcttatcggtaaactcagggaatttgtattcaaatttttgtttatgaaatttgttcggaatctatcggcttttcaccggatttcacgaaaaccatcattctgtcagaacctaaaacggaaggccatctcggaattgtaaatcttggttgccacttgggtttttgtcactgtgcttgtgccaccggaaaaggtctaattgcatgtttttcttggctcaagtacgcgtgtttgccactttataccgatacaaaccatgcttgttcaacgtggttgaacaaaaaaaaggaagactacagtctacaaatctacaatgtcctcctcaacgaaaggcctggaatccgtgaaaagccgaaaggtgggagagaaagcgcacacgccaacacatctcgtctccaacaaggcaacaacagataagccgtaaacgaaccaccaggcccaacgaggaaacaaagttgacacacaccacgggctcaacggcccattacaacttgaaacggtctacttcgccggaatcaaactgctcagtgctcacgtacggctgtgttcggaggtgggtgctgggaacccatctcctatgcacggaaaacggagcaatccattagcgtatgattaattaagtgttagtttttatttaaaaatggatcaatatgattttttttaaaacaacttttatatagaaactttttgtaaaaaacgtaccatttagcagtttgaaaaacgtacgcgtggggagtgttgggaacttgctcttgcaaacacacccgtgtagtcacgttgtttttgctgggaatgaagcgagaaatcggcagccgcgtcaggagctcccgcgcgggcgttgctgcctttgcatgacaaggaaacgagaacgaaccagctcccaaatttaacctgactccctaaaatctctctccacccttgaatcctctgaataaacaagctcttctcccccctcactctctcgctctcgctcgatcctctctctctgcctttgccgatcgtggtaagggcagagggagggagagagcggcggcggcgacgccgaaaacattcttcaggcagggcgagaaggtcgtcggccatgtcaa

SEQ ID NO: 32362 - DNA, 1501 bp, Oryza sativa
agtttcaatttttagtaaattccttgtaactatgattagttggatatagtggtttatgcgtagttttgctcccaggtgtggagggctccaacgttggaggagttgagtcgaattatcgaaggagttaaggcaagtacaagacggacttgtgtgatggataaactgtgttacttagttcggtttcatttacccaattattattcaaagattcctattatcaattgtgtggtttggtattatgctacgtattcatatttcacttcatgttcaaattcacgacgttattcatatttcattcttccggaagtttttgttacattattcaagtaccatgcgtagtcatgggagtgcaatttggatctttattcatgatccttgagaaacgttgatcacgcttgctcggcttaccggtaatgctaagaggatattcacacctgcccgggagggaactactactttttgtctccttcgttttaaattaaaggaaaacaaaagtatcatattggtttcttattgcattaaacctgtgtatgttttactagttcaatattgtacttgctgagtattctttactcattcttatgtttaatttggtttttaggtacctaatgatattgatcggcatgggatgggagtagcacccttgaactacactattattgcacactattgaaatttagttttaaattatgtttttgcttagcataagttttgcgtagaacttgtaatggttatttaaagttctggtctttactttcacgtggaatttgtggagctaggatggtttggattgtgtggattatattgttgttgagttatcttataactgcctgtcgtggatgtccgtatttttaggggagactttgctgaaatttctaataatttttggagttggtggtttttgagtgtattttggtgtggcattctaggtacgtggctacctggggtgttacagtctcatgattatctgatggctagggcaataaaaatatatgagaatgatttcaaggatggtccattcttgtttatgcattgttggaatgaacttaaaaaccaaccaaagtggcatgcatatttggagcagcttgacaagtcaaacaaaggaaggtagattacaatgatgccattccccttgatgacgaagatagctttattgtagtcagttcaaaattcatatgcagtccctatttcatgcttattaattgcagccaatcaaaaaaacatgtggtcaatccaaatttccatgctgattgcttattagttgcagttagtccaaacaaacatgaagtcagtccaaatttacgtattgtttgcacttggtccaaactataatgcaatcaacacaaatattctttgctagcagccaaggcagtgaaattggcaagcagtacaatagtacaattaagcatgcaaactactagaacctccatctatatatatttattgacccttccattgtgaaactctcaaaccaatccattgtttcattctgaaagtacca

SEQ ID NO: 32363 - DNA, 1501 bp, Oryza sativa
tatcttgaagctgatggtttagtcgcatgagatataattaatcgttcaaccggccctcttaattgctcatatcagagacgtgacaatagtactgttggtctgttgctcgtacaggcatgcagcaattgcaatagcactcgtaattaaatccactacataaattatttgtcagtaatgtactgaaaattttcaatagaaggtgtgctacatagctacctttcaggtaagctatttgcaatatgttagtagctagatttttttttttatagttttgcagtaaccaaaaattgcatacatcacgcggttcattttctttggaaagttctttttctctacgatttttttttggatttatacgttgaagttcttaatttatcgttgtttgaatttgaatgtgtctaatttaaattgagtaaatgtttatcagttctaaattagttttatacctatattagagaatcctatattcgaacttttatctaggaaagacgagaaagtgttttaaattaggaatgacggaagtgatgaaagtgttaggttatatctaagttatgagaaaagtgaagtgaaaaataggcaatcaccttaaatatataaattaactcttcagattaaccgtacttataggcaaaaaaaaaacatgtgacaagtaatctacaacctcatcaagtacaatacaatattttctttcagtgattttccccaaaattaatagtctccataagacacgtaatatcaacaaatactaataggataactaggtgaaaccccacgagttgctacgggagttcagtactcactccgtcccaaaatataagcatttttgataagtcaaacattttcaactttgactattaattgtaaaaaaaataaaaaagatcaatcatgtaaaattaatgttactagatttatcattaaacaaactatcataatatgtaactcattttatttaaaacaccttgttttatagatattgttgatcaaagtggtatctcggagaccgtgccgggtctaaaaatgcttatattttggaacggagggagtatgatttaatgagagaagaaaatgagagataatttagaccatgtatgaattatctaagggctaaacaattaatatgatatgacttattaataagagaggagagaaataatattaagtaagtgaggataaactatataggtatgtaagatattataaaaaataatgaagagatatattaaaacaatatgtgaattatgtagaataataactaaatgcttgcattttaacgctttaaaattcaataaatcatagataatatagcatgcttgcataatatttaagatgtaataattattagtgaataataatttggtatctttacatcttaagttttaaaatttagtgggttataactttatagtaaaataggatatatagcactatttaagtaccttaaatagtcaagaaggaatctgcagcaattaaatagctctcgctaaagaaaattcaggggatt

SEQ ID NO: 32364 - DNA, 1501 bp, Oryza sativa
cgactcctcccttccccgcaacctccgtgcacgccaccttcgtcgtctcttgcaacagctcgagacgatccttcgggctcccgtgcgtcgtacacgacgcggcaggggccgtcgtgctggcaatgccggccgtggccccccgtctcctcctcctggctttgccggacatggaggaagaggctgcccaaaggaactccggagccggcagcaccgactccagtaccctcgccactcgtcgagggtctccagcaacgccggacatgtgctcagcgccagaaagaattctggtagaggcaccgcaccactgtgcgtcccatgggtggaccgcatgggtgcgaccgcagctggacatgccggacgtggtgacggccttctgccctcatcatggctggacccatcatctccgccgcgtcatctctccaccatcatcaccggactgcatgccggagacaccggagacactgctgcacacactgacaccggccaacccgccggagttcctcctcagaggaacccttgctgcatgccacagagccccaccgttctacatggcagcagggggcttcggcgagagctccgcctcgccactggccccatcgctccccaacccccgtcgcatcatcaagccgggcatgccccggccaagacaagcggtggcggcaagcctagccatcccccacccttgggtgaaggggaaggcctgagcaaaggggagtaaagggtccgggagggcggagggtgcagggtggcgccggtgcgggcgtcaccggcgtttgctgcatcccgcggcggcgggaccaacgtccacggcgtcggggggagtcctcggcggagatggcagccacagctgcacagcgtcaatggcggcggcgagccgtcggcggcgacggccgtgctctagccacgccggtgctcgacggagacggcctccgcggcggcgactgcgcccagccgcgccggcccccgacggcggtggctgtgccccacattagcggcggcaggggcggcctccgttgcgggcggcgacggcggtggcttgaggcggcggccaggccggcccatttgccatccactgatgggccgccaacccctgcgccatccctcctcgcctccatggacctacagtggtggagggccaaaatactcattattttcggcccatcacccaataatatttatattttctgcatttacattatagtacttgaccttttggtcatttaaattttagcaaataattagagttttacatttgccatcagcactttgtacttctctgatattgttaatatatgggtgtgtttaagcatttccatgtcttttattatacaattactttgcaaatttattctcgccctattttatttttatttttccaaccatgccataatttctcaaaattttggctatcacaatgtaggtaagatggcaaccaaagagttcgatatactcgctctcgatggttccaatttccctatttgggcgatggatctcaaagtga

SEQ ID NO: 32365 - DNA, 1501 bp, Oryza sativa
ctctccctcggattcgttcggatttgctcccgcaaacctcgccggcgccattgatggagcccgagatttccgcggccgattccttcccctccggccgccctctctcactcccgacgctatttaaacgctccccgtgcctctctcctccgtttccgccactcgccgcactctctccccgtcggattcgagctcgcgccgtcgtcctctctctccgccgtcggcgccgagctccggttcgccgccgtcgtcgccccgtacctcctcccgcttcggcatcgcctccttcggcttcgccgcgttctcgtcgacctcgtccactcctccgtttcgcccgccaaccgccggagcaccgccgtcctcgtcgacccgagccgcgccgccgcctctctccgctttggtcgccgttcccgtcatcgccgtcgacccggggtgagccgaggaccgccatttcgtttcccccttccctcccctctctcggccgccgctccgcgtgcctatggccgccgccggcgaccataggggcgcgggcgcgccgcctcccgtcggccgtgccggcgaggccgccttcgggcgcgccccgcggctgccaggtggggcccggccgtcagccgcccgcgcctgcgggtacggctgacgcgtgggacccacggcgccagccggcgtcagccgcgtgcgcccggtccaccgtggaccatgaggctgacgcgtgggccccactcccgtggacccggtccgcgcgcccctctctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttatgaagccaagaacccatttttatgctttgtttctgctgttatatggagtttattagagtaaaagccttttcttttccgttggtcgtgtagacgctacagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttattgttattattaccttgttcaccctagaataaacaaaacctcaactagtggacactctactcatggcaccactagtttaattttaggtagatgcttcgcaatttaattaggtaacattaggtggtttttcaactatagactttgggaaatattcatatcacctggacactttggaatggtttggttattgtggaattggcttcacaccgctccttctattcaaaatccccaaaatggttttaggctgggctcggggtgcatggttttgatagtagcacctcggccatataaggaccggt

SEQ ID NO: 32366 - DNA, 1501 bp, Oryza sativa
ttaaacgagcgaccaagatttttccctcgaaccacaagaacagatccccattttccggaacaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacattcagatccacgtcttacaaacatcataaaagtcttacagaaatgcagcggaaaacaaaagaaactggagctaagccttgactaaactgcagcgggaacaccactccacaggcatcctcgacggcacggacgaagcctactcctcggggaaaccttcatctgacacatacccgtcctctggggttgggaaaagtagagcaagactgagtactacccactgtactcagcaagtcataccggaataggggtatgatgcagggaattaacaaagaagagctaaagtggttcatttgcataaatattggcatttaaaaacaggaattgaatgcgaaaacggttgtaataattaagcagtattaaacatccgccgtccaacgctaacccacgttgcgacaggcccaaccatccacctaaactatccacattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgattcattttaattaaccaacaccagagcggtggtactaatccaacattatcattagaaccaacagtctaaacattaatatgattttccccattgtgaactagttgaactaagcatggctaagcaattcctagtccaaactctaatcatgttataaccccaagctaacaaaggagcatgatatccaaaaacatggctgtaacaataggtaaccatcccatagtaatattataaaacaatgcaacatttgaaagaaaacaatagagcatttgcaatataggatcaatatgatcaagtgacaagcatgacttg

SEQ ID NO: 32367 - DNA, 1501 bp, Oryza sativa
gcctggcgatcaaaaataaatagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggcggatgcacgattaatgcaagggggtacaaggggataataataggggttaagttttgcagtaaacagcatttaaaagtcacttagttgcccaaagccattttaaaaagacgatcctagagctacacagtattgttaatcaaggtcgtgaacccgcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacgtcttcctcacgtgtaaccacgtgccacataccaccacggtatacggacggaagacgtgacatagttcccaacccatcctagccatagacaagagtactgacccaaccccacctacggccggaacctccgggacaggtaggcaggattgagcccctagcagcaggacaccagccctgtgccatgacatctcgactaccgggccgcaactcgtgtagccttcatttgtcctagagatgtccatcgacccccgacttcgtccatctccatccgtgtacttttgtttataaccagactgagccacaaactaagccttacccactagacatgtggaagtacggtaatgctttgcaacagaggcccgaagaccggtccttatatggccgaggtgctactatcaaaaccatgcaccccgagcccagcctaaaaccattttggggattttgaatagagggggccgtgtgaatccaattccacaataaacaaacaattccaaagtgtccaggtgatatgaatatcccaaagtctagagctgtaaaatcacctaatgttacctagttaatcagcgaagcatctacctaaattcatactagtggaaccatgaatagagtacccactagctggggttttgtttattctagggtgaacaaggtaataataacaatagcaataataataaggtcataacaaaggtaaataggcatggctaaataaaacagtgctaaagcaggaatttaaataaagcgataatgcattaatttaaatcaaaataattttataaactgggattcaatatgctcaaggatgatatgacttgccttgctcagagagaacggccttccgaaccttcggcgacgaccacgaaccacgcttcgggaacctccggaacgacagaagctacgcgaagcacacaagcaaagctacaa

SEQ ID NO: 32368 - DNA, 1501 bp, Oryza sativa
gagggaaaaatcttggtcgctcgtttaagcggggtttttcaaaacaagtcagtctagggttttagtaaaattattgggatttattcgtcagtcagttggggtttgatgggtgaaatgcattaggtcctagctctataacatgggttgcaaggtgtttatgcttcgtttgttattattaatatgtatctaatttctcattattttatcgttatgtgagtctgtcttatttattcgctctcatgcaaaatgatctatgcacgaaaatttcgcttttattcgtttcccttatttgagtcttttattgctttatttaaatttggatttgagcatgcattgatcctactcctttgtcttctctagatggccggtcacccacccaaccaccgcggagaaggcatgatcgacttcgtggcagagctggcacgcatgacactggtggtgggctatcccaacgcgccagagtacacgaccatcccaccgctcagtggcgagcttcctcaccgtgtccgcttggaggtccatggctacgtggggacttgcctcgctaacatggcggtcgaggcatctggaggcacagtagatcacgcctgtcaggaggcggcctacttgatgatggccaggttatgggagcgccacgactacatcttccacgacacggcgtaccgctaccaccctcgtcgagcccatggtgatggcgtcagctccttccgtccgacagctggcgagaacgacaccacctttggtcacatgtgtgctgtgatgaggggattggataggatgcactcggacctgcacaaggcgaccaaggccttgaacgatgggaagctcatgaggatcgtcgctctgaaggacgagatagcgcgcctgaagaaggagaatgctcagttgaagggtcttccagcgccaggaggagtccggatccgcactacgccccgtaagaggacgactgcacctgtgcgcatccagcttgcgcccaggaacccacctccagcagcagctcccgcagcacctccagttccgcccgcagttcctgcagctccagctccagctcccgcgttcactctctccttcgctccagcatcagccgccagaggtccagccagtggtaccggaggttggttgtctgctactcccagtggcagcggcgagactgatctgtcaggctccaggagtcgctcagagggaccgggtgacgagcaggaggacgccttcgactccaccgaccgcaggagccgttccgagcattaggctcgttttcccattagtttatcgattgtctagcttctgtttgttagtttgtgtgtttaggttgcttgtttggggtcagtcgacggtcgatatcatgtgcctatgatatggctgtcttaataaggatttttgcttgctcttttgagtgttttaattcagatcagaacaattgcagttttaattcctttgtaataaagcttagttcttgagcatctgtttttctccttttcccccgtctgcttttccctccaga

SEQ ID NO: 32369 - DNA, 1501 bp, Oryza sativa
gtgtcgcgaccgagaaaattgccttttcccgaacgctagtgtattaatccccgtctcaggaaaagccggggtacaccacacaaacatgatataaaagacacatctttattatatcgatagtatttacattattacagaggcgcttcaggcctggcgatcaaaaataaatagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggcggatgcacgattaatgcaagggggtacaaggggataataataggggttaagttttgcagtaaacagcatttaaaagtcacttagttgcccaaagccattttaaaaagacgatcctagagctacacagtattgttaatcaaggtcgtgaacccgcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacgtcttcctcacgtgtaaccacgtgccacataccaccacggtatacggacggaagacgtgacatagttcccaacccatcctagccatagacaagagtactgacccaaccccacctacggccggaacctccgggacaggtaggcaggattgagcccctagcagcaggacaccagccctgtgccatgacatctcgactaccgggccgcaactcgtgtagccttcatttgtcctagagatgtccatcgacccccgacttcgtccatctccatccgtgtacttttgtttataaccagactgagccacaaactaagccttacccactagacatgtggaagtacggtaatgctttgcaacagaggcccgaagaccggtccttatatggccgaggtgctactatcaaaaccatgcaccccgagcccagcctaaaaccattttggggattttgaatagagggggccgtgtgaatccaattccacaataaacaaacaattccaaagtgtccaggtgatatgaatatcccaaagtctagagctgtaaaatcacctaatgttacctagttaatcagcgaagcatctacctaaattcatactagtggaaccatgaatagagtacccactagctggggttttgtttattctagggtgaacaaggtaataataacaatagcaataataataaggtcataacaaaggtaaataggcatggctaaataaaacagtgctaaagcaggaatttaaataaagcgataatgcattaatttaaatcaaaataatttta

SEQ ID NO: 32370 - DNA, 1501 bp, Oryza sativa
gggctgcacccccgtctatgaggacacgccccaacttcacattgcaaatggtgggggaaaccaccatcgcgatctgtcctccccgggcaacgcacggcgggtggtcggtctgtgtcgcgaccgagaaaattgccttttcccgaacgctagtgtattaatccccgtctcaggaaaagccggggtacaccacacaaacatgatataaaagacacatctttattatatcgatagtatttacattattacagaggcgcttcaggcctggcgatcaaaaataaatagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggcggatgcacgattaatgcaagggggtacaaggggataataataggggttaagttttgcagtaaacagcatttaaaagtcacttagttgcccaaagccattttaaaaagacgatcctagagctacacagtattgttaatcaaggtcgtgaacccgcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacgtcttcctcacgtgtaaccacgtgccacataccaccacggtatacggacggaagacgtgacatagttcccaacccatcctagccatagacaagagtactgacccaaccccacctacggccggaacctccgggacaggtaggcaggattgagcccctagcagcaggacaccagccctgtgccatgacatctcgactaccgggccgcaactcgtgtagccttcatttgtcctagagatgtccatcgacccccgacttcgtccatctccatccgtgtacttttgtttataaccagactgagccacaaactaagccttacccactagacatgtggaagtacggtaatgctttgcaacagaggcccgaagaccggtccttatatggccgaggtgctactatcaaaaccatgcaccccgagcccagcctaaaaccattttggggattttgaatagagggggccgtgtgaatccaattccacaataaacaaacaattccaaagtgtccaggtgatatgaatatcccaaagtctagagctgtaaaatcacctaatgttacctagttaatcagcgaagcatctacctaaattcatactagtggaaccatgaatagagtacccactagctggggttttgtttattctagggtgaacaaggtaataataacaatag

SEQ ID NO: 32371 - DNA, 1181 bp, Oryza sativa
gcggtcaaccagattcaccgtgattagtctcaccctagtgtaatcttttgaatgtggatagtttaggtggatggttgggcctgtcgcaacgtgggttagcgttggacggcggatgtttaatactgcttaattattacaaccgttttcgcattcaattcctgtttttaaatgccaatatttatgcaaatgaaccactttagctcttctttgttaattccctgcatcatacccctattccggtatgacttgctgagtacagtgggtagtactcagtcttgctctacttttctgtcacgcccagaaatttagcccaaatttccagactattttgtgtattaaatccctgtccaggaccagccagggtacacaaaacgacaagtaatatacagttccaaacgtaaataaagcgtaaaatacttacagaaaaggcacttagtcctcacaccgaaacaaaaacagcagcagcggaaaaaggcgatcctagcggggcttctgctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctgaactacagtgcattgggtcgatttattaagatgggactaatcacggtgaatctggttgaccgcccataaccgcgggcgcggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactaga

SEQ ID NO: 32372 - DNA, 303 bp, Oryza sativa
cgtgcaaggagcgagaagatcagttcagagtcgtcgttctgcgaagatcaagtgaagttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttaaaccataaaaatctactcacaacagatcagtagacaagtggtttagtaccttatctttagcaacccctctcttccacctctcttccgttctggcagc

SEQ ID NO: 32373 - DNA, 171 bp, Oryza sativa
cctgtgtcgcgccctatcttccgctgtttcccgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcagg

SEQ ID NO: 32374 - DNA, 279 bp, Oryza sativa
ccacccatttacccctttattttagtttttaattttattttagcagcaatttcatattagtccctgtgttttatttaatttagtacaagcagttcatcagttgtacaaattacaatgtaagaccactggtgttatatgttacttaacataggtgtttattcaaataccctgcttcactaaatttcatgttgtcttaattaaatgccttttgcatattattttgagacatgctctacttcctcgcttcattaatttacaaaattctttaaattttgtact

SEQ ID NO: 32375 - DNA, 1501 bp, Oryza sativa
gcgtccgtcacagcctagaaatcacagatgtgaaaagttatctcaatcggacaaacggctgtcactaatgaagctatctcaatcaggcctcaattaaagcccgtcactgatagccttgaaccagacgaccagtcaaactatagcccatcacggctgacctatctcaatcgggccacaactagcaaatatctcttatttggtttataaactataaaatagatatgtaaaatttgtgaacaatgttactaacactttgtctgacgaagaaatgaaaaaaataaaaattatagatcttgatgagttatacaactttgttgttgatgactttttagttgaaatcatttagtatttgaaaatgttgtttgaagttgtcatattttcaaattcaaattcaaactgttcaaaaaaaaagttatatagaaaaataaccaaaataaaagttatagatcttgataagttatacaaatttgttgttgatgacttttttagttgaaatcatttagtatttgaaaatgttgttttgaagttgttatattttgaaattcaaattcaaactattcaaaaagagttatatagaaaaatgaccaaaataaaagttctaaatcttgataagttatacaagtttgttgttgacaatttttccatttgaaatcatttactacccgaaaaaataataaaatgaattattatactgcagttaattattttgatataggtcaactcacaaatataaacatttcatatgaaaaatggaaaaatactaagtcatattaatcgggcattactatagttaacggatgagtcatgtgtgacaggcctaattattatcgattgagatatggtcgcacgtacatgttagatgggcataaaaatcaggcccgccactgatgacctctatcagtgacaggccgtagtttaggcccgattgagataacgatccatatctcaatcgggtctcaagttggcgcccgtcacggatgatcatcaagtttagccccgatagagataatgttccatttctcaaacttgaggcccgattgagctatggaacgttatttcaatcgggcctaaattacggcccgtcactgataggtgtcatccgtgacgagcctgagttttatgcccatttaatatgtctatgcgactatatcttaatcggacactttttcggcccgattgagatgactttctagtgacggcctactaattctaggcatgttagagaccgtcacagatgaaaggttttgtactagtgaatatacatgtcaagtattataaaaatgatgactatatatgttaaaatattttagaaatgatgtgagaggtgatgatgattggatatgtttacatgttgatttatagaatttaataaattataaatgatattgtatgtatgcattagcttttttataactaatattattgctagtagataataatgtggtatctttatatattatgtttaatatttagtgagttataactctggaaggtatagata

SEQ ID NO: 32376 - DNA, 1501 bp, Oryza sativa
taaaatatttttattatataaataagttacttttatcatatatataaattacttttcgatttgattaaattacttcttatacattcatgatgttgtgaatatattgtttattttattatcatttttggtcaattccgtaatttgtgctaattaaatttaattgctagataaactcatgtttttatctccataacggatttacttttaatatcatcacaaagttactttcttttttttaagttacttctataatatatgtaaattattattttaagttacttctataatataatatatgtaattacttttatgctttattgaatttacttttatatgtcgaagaagtagtttagtgaaatttaaaattaattaaggtatattataagagtaatttatatttttttcattaaaacataatcatgtgagatcttgttataaaactttaacttttatgaacacaacggtgtaattggatcatagatcggataagtattttaagagaattttatttgaagcacatgtgataggaatatatttttttctacttgcttgttggactagctagtactatagtgaaggtatattgttagggcctctcgttagcattaaaacaagatgcctcttgatttagattttaccaaaaaaaaaaggttcgtatggagaaaaaaaaggagaaaacttttgggaaggaaaagaatcacgaagaaacagcgaaaccaagaaattcccacctcaaccagtcaaataataaacaaaattagcttaattggatccatgcctttacaaatttgcctattcaaataaatgacattaaaattcgtctattaatagtcgtatcactaaaattttacaaaattggaccgtgccactgtcttcacgttttccatcaatatcctttattttccatcttcttccttctttctctcgtcttcttcctagaagaagagggcatacaatcacgagccatagagagccatagccacaagccacgttaagagatagccaacaggaagacaatcgctaagagataggacaactgtagtttcctattgcaaaactatatcctgataattaaatcaatacttcaacatatccacctcatttaattagatgatgcggtcatattatctatatttttaatagataatatcttcaaataaaatattgtaaaattcacaaagacatatatagtatgaaaaaaatgttacttagtagaatttagaaattccaaaagtaagatacttacaaaaacacacttatgtacaaatgttatatagtttcataggtagcaacttcatcgtgacacgatattttcttataaattcaaaactcggtgtttttaagtaattttagtttacaagttatacattgttatacgccacaatggtaatcccaaataaatttttttaaaaaaaacatgtttacaatagaataagtataaatattcgtaataaaaaagatggacgcgcatgtgtgcaagctatcttccaatttcattaaa

SEQ ID NO: 32377 - DNA, 1501 bp, Oryza sativa
agcactgtgccagagtgtgcagtgctgcccatgatctcccccatcagcgagcagatccccaatcctgcctccaaaaccctcatcttttctactcccctctggtttcttgcatcttgagaccacctgctttatgtgctggacttttggtttcgtgctcctgcctttacccaaagcacttggtcctctagattttagaaaaaaagaacgagctgaaatgagatatagtagtagtgactgagcctacgttaggtgctttgcatgttgcttttgtgcaagtaacatctttgcaagagagagcaccaatataatgtgctatgccatgtccgattggaacggtgtcttgttcattgtcactatccttgtgtcctttctggttacgattaagtgcactgtttaggtgccgcggctattttgttaagagaattaatggagctatcctttgtgaaaaggttaacgtggatggggtactttatcaaagagatacatgtttcgttttatatggcacatggtcccaaccgctccatttcagaaaagctcgagataaaccggcaatattagtttgggtgtggatcttttggacaagactagagaaaaaacaaggagggttattctgttttggtgttccatttgggaggggggtttgctgtgtagcagttgagaatttggtggtccccttttacatataaaagagaggaccagtactttgtcatcttctcttcaatttatcactctatgctttattccaataatgtgcattatgagcttacaccagctttaggtgtcaataataacaatcagttgtgattcaaagttgccaagtgggctcctgattatgctgagagatagcttagggtatgtagactcttcagtcttccctcgcatgcaaattcttcaatctctctctgatcatgttggccctgcaatggatgccattctggcagcatatttgtttgtattccttagcaggaccaggaatctgatactcaatggatcaatgctcttaagccacccttgatatgaatagtaaaaaaattgaaatgcttctggtaaattgtaaatggacgaatgcaaatttagtgcatcaaactccactgctccttaaggtagttcgtacatatgtgtgtttgggtccattacaaatcgttacaatgacaaacagaaaagctatcgttgcaaggatgtatcttttcaggtaggttcttagttaaaaagaagatacatgtccactagaaagtttaaattcttcatggcttcatgttttgtattcaaaataccttatgtttttactagttttcccactttgcaaataacatgtgtttaatatttaacgcttcatgtatttctatgtctctcactcctgatgctatgaacaatcttacttgctattgactatgatccttttaatgtggcaggaatgaagcactgacgtggacctttggattataattctggtcctcattattggtcaagttaatcctaacaatgcagcaccttgtgctca

SEQ ID NO: 32378 - DNA, 704 bp, Oryza sativa
cttttttctacagaattagtcaaatttagagtagtttgactttaaccaaagtcaaaacgtcttgtaacctgaaacggagggagtagtttactactactcaattgatgactttttaagatggaagtcaacggaagctaatcagtaagcaagtaaatttggtggtctagttgtgatgtcggtcagtcttaagttgatcactaactttactttgatatattcttaagactgagctttgtactctttgcatatgatcaaccttacctaccacaagtaggtaaggtttcgcagcagtgttctcgtgtgacatcttctccaaaataatcttgaaagtggtgtgcaaaaatgtgaacattagtctttcaagtttagcaatcaactttgactaaattaattgtgttaaccaatcaaaggaaactcatataacatatttcctcgttaatcacaaatttttttaggcaagtgaagaacaacttgcagttgcagcctctggtctacagaaaaaaacaaatcttatgatcaggtatgtgtgctgcaagggcccagctccaacggcccaatccaaatgcagctgcaaagcctgcaagcatcagcaacctccatttctttttaaaaaaagcatcagaaaaaaaatataaacaaaaaatgttaattgcattatcccacttgcattatcctccgcccgccacgtgtcccgtctcccagcc

SEQ ID NO: 32379 - DNA, 306 bp, Oryza sativa
cgacgaccgcaaaccacgcttcgggaacctccggaatgacagaagctacgcgaagcacacaagcaaagctacaagcctataaagaagcaataacaatacataaaaagaaagcacagggttctttaggttataacaaacattaagagacttgaacgggtcgattcggagttcgtatgaccaagatatgatcatccgaagtttagtgctgttatatggagatttgcggattattataattaagctttgcaacaataaaacatgtgtaagcgctagcctggaaaagacaggaaggctgcgccgttgaca

SEQ ID NO: 32380 - DNA, 273 bp, Oryza sativa
tatctcatatattactgatatatacgggcaatagcgtaggtttaatcttttctttgccatatacttcactgccaatctgatccatatcgcatcagcctgatatgaacgatacgtcatcagcaatccagccgatcggctatcgtttatggatctaactttggctcctttgtttcttgttggttgcaggatcaaaccaactggcacgccttgaacccaaaagcaaaatttaggacctgcactagagtaaagcaatctctcagaccagtgtgtgtt

SEQ ID NO: 32381 - DNA, 209 bp, Oryza sativa
cgaccgaaagggggcgcctcgcggtataccatacgatttgcacggtctcggccgaagctccctactcacccttgctcgtgaggggcttgttggaggtatactgcgaaaggccttcggccgggcctgccgaaaccgaaaacttgggcgacatgttcaaaccggaagcaagcggcgaaggtcgaagagggataccataagggcgaaagcca

SEQ ID NO: 32382 - DNA, 1501 bp, Oryza sativa; identical to SEQ ID NO: 19270

SEQ ID NO: 32383 - DNA, 1501 bp, Oryza sativa; identical to SEQ ID NO: 21955

SEQ ID NO: 32384 - DNA, 167 bp, Oryza sativa
caccccccttacaggaatctcgtccccgagattcgaggaggctagcaagaggataggttgggcggtcttctcttcttgtctgactccttccgctccgtcttctataacaaacttgcctaacaaaacttctccactctggactgcttggctcgatctcctgttgcaga

SEQ ID NO: 32385 - DNA, 680 bp, Oryza sativa
ttcctgcagccctccgtccattttgcgccgttaaatacattgttcatcctataattaacggcgcggaatggacggaaccctaatggcgatggcatttttgggacaaagttgtttgtatgatggcatttcttggaactcacacttatcaatggcatttctgggatttggatgcttgtcaatggcatttctttgattatcttataatatataatgtaggcttcgaaatacgcttaaacctagtgattcggatagatcggacaacatgccgagatagtataaaccacttatatctaaaggtactttgaagcaaagattatatatattcctagcaaggccttaggcaaatctaacatgtattggctactgttctgatactaatttatactaagataccagtttagattaaaagcaaaatttgctacaggacataaaaaacgtgtaattagctgggagacaccgcaagaacggaaatatgctatagggcatcgcaaaatattggtaattagctgctggacacccgcgggattattttattatatccggagaaattggagagagaaaaaactgtgtaagtacggttctacccttcgaatttttttcttttttttctctatccttctctgttccttcttttccttgttcttttctctctcattctctctctgctcttttcttcaagc

SEQ ID NO: 32386 - DNA, 1501 bp, Oryza sativa; identical to SEQ ID NO: 19066

SEQ ID NO: 32387 - DNA, 1501 bp, Oryza sativa
atcatgcattttcaaaataaattcagcgcgtgccttagcatcatgatgaaccctctcactagtaggtaaaggcaaaatatcaattggagcacgaggattgaaaccatacactaactgaaaaggacttatcttggtagtagaatgtgttgcccgattgtatgcaaactccacatgaggcaaacattattcccacatcttcaaatttttcttcaaaatagcccttaacatggtacccaaagtgcggttgactatctccgtttgtccatctgtttgtgggtgacatgttgtagaaaacaatagctttgtacccaacttgttccatagcgtgcgccagaaatgacttaagaattttgcatcactatctgaaacaatagtagaaggcataccatgcaaacgaacaatcttatggaaaaacatatcagcaatatgaacagcatcatcacttttatgacatggtatgaaatgtgccatcttagaaaaacgatccaccaccacaaaaatgctatccctccccctcttagttctaggtaatcccaaaacaaagtccatagaaatatctgcccaaggaatagaaggtacaggaagaggcatatacaaaccatgtggattcaaacgagacttagctttctgacaagtggtgcaacgtgccacgaacctctcaatatcctttctcatccttggccaaaagaaatgcatggccaaaacatcttccgtcttcttagctccaaaatgtcccgtcaaccctcctccatgcgcctcctgtatcaacaaaagacgaacggaaccaactggaatgcatagacggttagctctataaacaaatccaccattgatcacaaatttgttccaagtacgtccctctttgcaatttatcatcacttcattaaaatcagggtcaagcgcatattgttctttaattgattcaagtccaaaaatccgacaatcaagttgggacaagaaagtatagcgcctagacaaagcatctgcaatcacattatctttccctttcttgtgtttgataacataaggaaaagattcaataaattcaacccattttgcatgtctacgatccaaattattttgagagcgaagatatttaagcgattcgtgatcggagtgaataacaaattctttaggccacaaataatgggttccaacacgatacacgggccaaaggcccaaatacggtgacgcagcaccgggacagattctagacgtcaacttgttcggtcaattcccattgactcggaaagaatttggacgtcggaccaaaaccattggaaaggttatcttcttagctttccatccatataaagacgccccaatccgagtacgtatgcgacctaggcgcccgttttagtgcagactagatctggactccgaattgcacccgacgtcaacttggtttggccctccaccttgacttggacgtcctcgatgatcctccatggctctaagtccttctccaagtgtctcctttacccctccattgttcctaatc

SEQ ID NO: 32388 - DNA, 740 bp, Oryza sativa
aatggttggcctgggttggcttgggacgagctgggacccagggtcgggttgccagttcggtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaaggtggagccgtaggctcgctagtccgctgctgtttatttttgattgtcaggcctgaagccctttgtaataatgtaaatattatcgatataataaagatgtgtcttttatatcatgtttgtgtggtgtaccccggcttttcctgggacggggattaatacacaagcgttcgggaaaaggcaattttcccggtcgcgacagagacgcatgtccccagcgcttgctagtgacgccgaagctgcaacgagtggaagtgcctcggctccggccgctggagcgaacgtctccggggacgaataggttgaggcgattccttcgcaagctcgtcagcgggaaggaaaagctccggcggtcgaaa

SEQ ID NO: 32389 - DNA, 1501 bp, Oryza sativa
aagggggatagggacgttgctcgccgttgtggggccgttgatcatcacttgaccgacgcggcgctccacggtttcgctgttcaaacctgtagatcgagaaccagaattcgataaaaaaggaggaacatgcacataaggaatggaatctgaaatataagaaaaataccccgaggagaaacccgggtcccgtcctccggccaagaatagtcaaaggctgggtgggctcgagcctggagcggctggatccgcctaccaatgaagtcggcagcgacttcataccccgacaaccctcgaattcggaggccatcgatgatatcgatgaaggactgaagggagggggctaaggcgggtttggtggtccaagacgaaatcttgtctggttgttcctctgggacaacgaagacgggatccgaattctctatctgaagatagaaccacctcgcccgccatttgctatgagaagaggggcactggaaggggatgtatcgcgacttcaggccatcccgaagtcagaaaccgacacatccggataccttcttaggttccatccagcgcaactcgtagtagaaatgaaagagatcaagaaacggctctaccccaatgtaggcctcacaaagatcggaaaaaatactgaggaaggcgatggaattggggttcaaatggagcaacgaaagaccgtagaaattcaagacaagaagaagaaattcggaaggcagaggaagaaaaccacaaagaatatagtcctcaaccgcaaccatgcggcccaggataggttcgggttcaatacctcctagttctctctccatggtctcgtgactggggagagcgccgtcctcctgcagcttcttcagggatgcaccggtggaagtggacttgtcgagatccatagccgccgtagatcgccggagaagagactgagatgagcaagcttggctttttgcgggagcggagaagacgaggagcgcttggaggctggaaagtttttcgcagcaggtggacttcaacgtggatacccaaaactcccttaaatagacgcactaccgacggtacgaattccaaggaaaggagagagatggctgccgaaaatttctgggtccgttacgcgcggcagttttcggacttcaatttaaattcactcatgaccgttgaacttcgcatggtgttgttgattactccttgtctctacggttctcacaccgagatcaaccagtcgagaacgacaacaaccccaacatcagaagtcgcgatcggtcatatgagttcatttaagcagaagtcgggggctattgtcggggttatagataaagtataccctctacccttggatatacgtcatatatcgatatggtatatctacgcgtatacggacgttctctgtacacgttaaggaaattcatcacggagttcacagatgggaaggatccctactcggatagaactgggtcgtcactgtatcgtgtagggtccgatgtctccgagtcctacttggagaccaactaac

SEQ ID NO: 32390 - DNA, 1501 bp, Oryza sativa
ggtgtattttttaaaggtttaaaggaagatatacaaaagctatgatagattgggtaaacaaataaaagggtgataaaagagtaagaggcaatgactggtgtaacttttaaataaaaatttaaaaaatttaaggatgataaggatcgatcttttaaggttataggacaatataatggctattaacaaattctaagtaatgtcaaataaagaaaaatagataattttatatgggtgctggccgtgcaattgtgcgggacatgcagctagtttaacactaaactgtatgtactacttgctgaaaaattcctacgaacatacgagcacttatgttaagtttaactgagcataccccacatatgtaatgcactacctcttaaccctaatcatagaaaaaaatgaacacccttgctaaagtataagacttagaaccccaataggcatgtttcgccaggaaaagtttagctaaccaaccaagttaatctatcagttcgctaactagctatttactgatagctttgaacatgctatccaaactatcaaacttcatatcccattaatttagctctgcatattatagggcagtcgagatgctctcgttcgttaacaagccagagagtgttgaccttgtagtaatcaaggcacagcctgtctaattcagtataattcgtttgcttggagggcgctccactccagttgttgctatacaattcgtacaatatactccctccatattttaatgtataacgccgttgcctttttaaccaacgtttgaccactcgtcttattcaaaaattttatacaaatataaaaatacttatgtcgtgcttaaagaacatttgatgataaatcaaatcacaataaaataaattataattacataaatttttttaataagacgaaaggtcaaacgtttgtaaaaaagtcaacggcgtcatacattaaaataaaataaaatacgagggagtaatttataataaccaatagctagcacaagaaacttatatataacaagtggtgctacattttacagagacatcgcaggctcgcagccaaaaaaaactagctgtacctccactgcttcccatggccaaggtcgttgttctcacatttgtatacgtggcaatggttaatgtgctactaaaattaataaacagatgaaggatcggagaaatctagatcaacttatttaaaacttcgtgggttacattgaaacggttgaatttcgatagaaattcttttcaatttccataaaattcattaaaactgatcggcggtacctgggccggttgaaagcctacttcccatggtctaggccattaatattctcgtgatactacccaactttctcgaattttttttatttttaatttttttattaaagtatttacaaaactaattttgtgtttcaaaaattgacaaaactagtcgcccgccgccctttgggagggcagtttttaaaatcaacctcccaaagggcgattttcgtgacgtggcagacgac

SEQ ID NO: 32391 - DNA, 1501 bp, Oryza sativa; identical to SEQ ID NO: 19060

SEQ ID NO: 32392 - DNA, 1501 bp, Oryza sativa
gataggcttcacaccgctgaaccatgtcgcaagcatctttgagggcaatcggccaaaaaaacccttgtcgaaaagcttttccgaccaatgtgcgaccggcgacatgcgacccacagatcccttcgtgtatgtcgaggaggagatgtttgccgtcgtcgaacgagacgcatttgacaagtaccccgtttggcgccttcttgtataggtcgttgtcgatcatacagtagattttggcttgacgggttattttctcggcttctgcatcgtcctcgggcaactcgtcgctacttatgaatttaatgagcgggatctgccagtcgtctatggtctcgatgtcggcaacggcgcgctctgcctctatatgatgcgaacccgctagggtttatggcccgatctttcgatgagaggtaagggataactcgattagatgaagacgacgttcacggcccgactacaactgtccaaagacgctgcgccttagcaaccgatacaccgtctccaatggtcgccgcgaacttgtggtgcgcatcaacccggccacgagggcactcgtcctgcaagcaatcgaagaacaagcaagaacaagtaggacaagcactgaaattgctagataaagatgaaagtttcactatcaaacacaatatggtgggttccgattacaggcagacgggcggtttagccaacacgcgcgctgcgagccggtagcaagaagctatctctatcatcaaaacccgcctgttcttggcggccactagaggtataagaagaggggaagaacgaccatagggtcgtgctccaaccctagggcgtgcccctaatgggcccaacttggatacacagcccattgggccaaaagaggtgacgcagcaccatggacagaaaatagtcgggagtaaaatgacaattgcggccgctccagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccctgtgcgaatcctcttccctttggatcctctccatcgttcctgagtaaaacacgagtgcacgcgtctccggggtataaagacgaggaatatgaactcaagaaagaactcacctgataatttagttgacgtgcacgagcgcgggtaataggaccatcatgctgtacatggggggacgtggatgtatcgatggtgttgatgtcctcatcactatagcccccgagctgatgtcgggggcgactaggctatcttcattgtttgcctctttcactgatggctttgtcaggacgtccaaaaagttgccaggttcgagtggctcccgtctggacgcacgccttgctagatcgtccggttcgatgttgtcattgcggtatacgtgtcggacctcgattccatcaaatcttttttctagcttcctaacttctgcgaggtacttggataa

SEQ ID NO: 32393 - DNA, 1501 bp, Oryza sativa
ggcggctgcgtcccggacggcagggaggcggccggccggacctcacctccgggcggccgccgctcctcccgccgcatgcgatcgccgccgctgggccgcactgtctccacccgtcgccaccacccatcgcctgccgcctcccctcttgcgccgccgcctgtcgccttggctccgagagagaggagagcgagagaaaagcgaacaagaggaccgagagagaggagagcgagagaaaagcaaaccaccagatctggcgaccccagcctcctcgctggctgatgcgacaatggtacacgacggtagcacggtgcgcctcagcggtgcgtcttggtggcggtggagggaggccggaggaaggagggtggagccggggcggcagaggagccggcgatggagatggccatggcagtggctcgatccaggcgaggaggggtgaggccaccccaatccgcttgacatagatcctcctcctcctcctcctcctcccctgctccctcccgagatctcacactccatccaacattttctctcgcgagcacaccaacgcaggagctcgccagccggccagatccagcgcctcatcaaagtcaagccagagacaccgagcagcggcatgaggatgcatggggaaggtggtggacagtggaatttttttgagaattaatattatttttatggaaaatcgcaaaagtagtggccaaccggggaaaatcgcgaaagtaggtccctgtcgaacgggtgcaattcgatagggcacctatcgaacgacgggcagtcgacaaagcccagtcgaacggctggcgttcgacacgctcacctgtcgaacggagggagttcgacagggcccaccacccggcgccacgaggcctgtcgaaccgggggcgttcgacagggccctccaccgaccctgtcgaacaatgggcgttcgacaggccggtttaaagccccgtccacccaggccgcgagttcgatttgttttgaggaccacatcgccagccaccaccgagagtcgccacatcgtcgccgtgagcgccggagggagcgaggggaggggatagcaggccggagaggaggccgaggaggcgccggccgggagcaaagggttggcaacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcagga

SEQ ID NO: 32394 - DNA, 553 bp, Oryza sativa
ttcctgcagcccaggatatagcataaagtttctagagattatacaactcctaggtgcaaaaataagtgtttttatgaaactcacaattttagtgactttttcagttccgaagttgtaatgttttaatttacaaacataaagactacaaatttatgaatacatagaaatttggttcacttgaaaatgagttaagatgaattagttatggatttttgatgttttcctagttcacgtatgttttcaattactagtgagcgtgcagttaattttgaaagagtattcagtcttggtactaacaaaaatatgtgtattcataaatatgtgattattccatatagctctaaaaaaggttgagattgttttaaattgctcaaacacgttggagtgttcgatttgaacataattctttgtaaacttgaactccaattcatttacaccgaaacaatgtcaaacatcagttttcaagtatccattcattattttacaaatattacaacttacagaggctaaaaaaaaaaaccagagaccatttatctatcagacgcttattttg

SEQ ID NO: 32395 - DNA, 1501 bp, Oryza sativa
tagtctttttcccggtcttcgtgtttggtgtagaccggatttgctatataggcgccatactatcaagaggggtctatgaagcgagcacgtggatgatcttgtgccatattagttcatatgcatgtaggtgcatttggtgggcttgtctagccatgtgtgatgaattttctcatgtcctaaacaaagagagaagtgggcatgtccaataggagtgagtgacatcttgtgagtatgtccggtggatatcctttggagcgtgagcccttcatccttgacataagttgtgtttcttggatgtatttttcatgggttggatagccttttgaataagctttccatagagtccaagaacatctaattccaatatccgagtcaagagatatcgtcgttttactgtcggtgggtcgtgctgaaaatcggtctgctgtcagaccgacctattatggccggtcagacctcccgaaggcctcgaaagccccccaacggatagttttttgtgcgttggactgagggccggtctgaccgggtttagaagggcggtcagactggcaggcacgtcctaaaaggtgttttagcctctaacggcttgttttggtggttgggggtatatatacccactccccagcagcaagggtgaagttttggcactccattgcattatcttgaacctttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgccgcctcctagacggcttgtggaggtgttgcccggtgacctctccgaggagattgtggaggaggcccggcgccatttgtgagtggtttggagttcaccacgttcggagtgaatgaagaactaccctggtgatcgaggcttgggtagtcctctccgtgggccggctcccaccttgcccaccccttgacgaagggggcgtgcggtggcttcgtggttgagcggtggagttgggctcgcctcaacggggattaagaaaccggcaataaaaaattccttgtttcttgtctcatttatttgttgcacttacatttgtgcaatttacattcatatagacatatttgatcccatatcacttaggtttgcaaaacttaacttagttgcttagttaaccttgcacctcaccttgcctagcaacttaggttagttttgtttaagtgccattaagttttaaaaccacctattcacccccctctagtcggcatccttgatcctacagtcctgcgccggctcgaccaccctttcctgcctgccatgttcgatgactttgacaccggccagaactactcccccactcactccgccaccgcatgcctggtcatcgattcccagtcgcgttcaccaggttctacgccgctgaggtgctcctcgcgctcgagtttctgcacatgatgggcatc

SEQ ID NO: 32396 - DNA, 1501 bp, Oryza sativa
aatgctttggaaccactgtcctgtgaatgagccttccttgcaagtatttagtagcaggaggtcaattgtgtgggaacactttgaacatgacttggtatcattgataatgtcccaaaggctgtggcaactactatgcactcagcttttttactagaagagtgatttgttgtataatctgtatattttgaactgtggtcatgctgattttactgtattgtaaccattgtctaatttgaaaatgtcacaagatatgcagtctataaagcttccccacttattctttctgattcttaattgtgctcttgatctctttcaggtgcaatactgttggccacataacactattcagattctcaaaccttttggctgatgctgtatcatttgcatttaattaaagttgaaaccaaaggtaatgcaaagtgcaaccaactgttagtcttgctgcatatattcctctttgtctgaaaagaagaaatttatctgtgttatatactagcaaatatacaatgcttttatctcctagatgtattattgatttcgctctttttttttggcccttggtcagcaattctctacagtactgaacactcaggggaaaaacacagaaattttaggggttttgtcaatccctattatacaaataataattttacgctcaccaagaaaatgctactcctttccataaggggggcatgatgcaggctaaaagattgtttaatcgtgttgaagttttatgttttgttcttgtaagtaggcctgctaatggtcttgaaaccgttctgaatccaaactacccaacaaggacagcttctcacccacaaatctattgatagaaaccaaaccaaaccattccagcccaagctcccaccctagccaaaccttcagtagtatgggtaacagcattacacccaattctcagcccgtttctaaccatggaatactttttatcaaaatgttgaagtaatcgaagcatctccagtcttcctataaggatatttttagtaatttgatctatgccaccactttaattacagttttggtttatgctgctacttttttggcaaattcagtctgccacacaaatgtgaaatttgtttgggccacactgaatttgttttggcaaacaatattgggacggatggagtattactaatggtgaagcgatattgctgtagatttagtttcttgagataggcaagaaggcctatttggcctttgttctactgtagtctgttatttatcaacaagtgtttttttggtccaaatggaaattcttaatcagagtcacttgttcaaattttgtgcaggctggcaacttgttaaaattggtgtaccatttgttatttgaagccatagcatatctcagctcctgaacaataaggtgctgtattcagcacagtttaagtgtgaaaaagaatggatagaaaaatcacactttgttgccactggtatgcttttgaaagaaattaggggtttggatctctatctattctagttacaa

SEQ ID NO: 32397 - DNA, 202 bp, Oryza sativa
tcgcctaacactaagaccagcaaattaacaccaccgatgccatccaaaactcaaccagccttaactaagcagtactagtgaaaaggcacaatggtctataggatcacggaaaaactaatctactatttttttttgttggtcttttctggactataggaaaaaaaaataataatgacgaagggaagggtaaattcttcaccga

SEQ ID NO: 32398 - DNA, 1501 bp, Oryza sativa
gtctcccaacgagaaggtcaagcggctacgatggctgaggaggccaccgtcgccacttgggtcgtgagtggcgtgggctgatgttgttgtgctgcacgatagtgtcgtcatcggggaaggtattcagctgaggagggagctaacgagggtacaacggtggtgctagcggtggtcacagggtactgcatcgaagaggagatggatgttgggtgcaaccgcacacactctccttgctgagcgtggcactgctgctccccccctcaattaacacgatatgagatagaaactaatatcgatggtggcactggttgcctaacttcgccaccctctcatcatcatcctcgtttcccccaaccaccaccgcttggtcctccctgttgtcgtcctctcccaccaaccactggttgcctaactttgccatcctctcatcgtcatcctcgttttttagtcccgccttggctagctaaggtaaaggagaccatcctataagataaggtgtccggttgaaaaaaaatccggttaattgttttgcactgagcgaggatgaaagcacaaacaaattaatttaggggtgtggttcgactagatgagttctggcatctacagcctctagaatctctagctgcaagaagctcctcaaatagtccagattttcactcggatttgaagaaactgtagttgtacaatccagaaaataaactagaaagaagctgtagttgtagaatccagaaaatgaactagaagacagaaactaggtttcctagcttctctagataagctcccccaaacagggccttaagtcccgcctcaactagctatgctgagggagacaaaagcgcaaacaaataattcagaggcgtggttcaatttagatgagttgggcctaaatccgtatcacaccccagatgtttcgccgggcgccggaaataggaaaagaagctgtcactagggctgtcaatgagccgagctcgagcgagcttgcctgcctaggctcgagctcgatacaagctcgagccgagcctataaaatgttcgagctttcaaacaggctcgctttgagctcgatcaagctcgagctcgactaacgagctcgatttttaattagaacaatgtatatttcaaaggataatttttaaaaactatttaatttatggtttatcatattagtgtaagaggaaaaagaataaaataaacatatgatgccaatacaaggcatacaaataacatatttgatctaccgatttgttaaatagcaacataaaatcatatattactaggctcgttagaagctcgagctcggctcgacaaagctcgcgagctttgggacaggctcgggctcggctcgtttggagctcgaaccgagctcgaatcgagcttaggacgagtcgagctcgagcagctcgcgagcctcgagctttttttgacagccctagctgtcactaaccaatggggtccacatattattttattgtttttattattgtaacgccatgttagatgat

SEQ ID NO: 32399 - DNA, 1501 bp, Oryza sativa
gagaaacggatgctgaaacataacaaatctgaactttgtttatgacaaaattttcccccctgaacaaatctttcactgccaccaattagcagtagcgaaacaaatcaatccaatctaaggagcaacttttttttctctgtaatccaatgagtaattggataaatcaaatgagaagaatcagaagaaagaatagactgtacaagcagccaccacctatctaaactccttccggagagagcatctccccggcttcaacaccacgccaccagcgaccagctctgcgcagtcgccgtcgccgtcgccgtcgccggcgccggcgccggtgggggcgggaattctgcctccggacgctccgacgacccctccagcggctgccaccgcggcggagcctccgcagagtcagcggcggcggtggcggcgaggaagaggttggtgatgtcccggagcggtacccgcctacgctccttgccgagccgcttcagcttgagcttcttgacggcgacggcgccgtggaggcgggcggcggcagcagcggccgactgcggcggcacgttctccttgtcgccccggtggtcgacgacggccatggcggacggacacgggagctcctactcctcctcctcctgctgctgcgccgtggctgagcgctcggcgaggcactagtcggcggcgagcgagcgtgcgaggaggtgtgagatcttggggaatgggagggagcgaggaatccatggctatttgtaaccgagatgtggtgggatttgggagggagaggggaaagatttcgagttcttcccggacgggggggaatgaaaaggaaatttggagggatcggtggggtttcgccgatttggtccggagcgccggcgaatcttggaaattttgggggaaaattggggaaatttggagctcagagcggcgcggccccgaggcgaggagggagggagaagacaaattttttcgggcgctcacggcgaggagggagatttgaacttttttttttttcagtttgaatgcgaatgatgatgtggcgcgaggagtgtgaaagcgcgccggttctctccgcgccaaattgggcaggcggacgcctgcgcgccgtggcgactcgtggtcgcgcgcgcgcgccgaacattggacgttgtcactgagacgcaggacatatgatgtccttttgttgagccacaaagcgcctcgatgtttggttgatactcattttggtcttaaaacttattttcattttttttcattgtagcttattttagaacttttggttttgagttgatatggaccattatataaaagttttactcgcaaataattttttatttgctaataaacgattcaaataataagcatataaacaatggaattcaaaattcactattagccaccaaatatgcactccttttaaatttgacacacaatatgtgtgcctatcaaaatttatcactagagatacgaattccttcattccgtactattttatctgtctttggatttatcg

SEQ ID NO: 32400 - DNA, 562 bp, Oryza sativa
cattaaaaaaacccacaaagtttatgaatgacatattgagcgggttagcttgctggtgaagacattaaaaaaacccaagaaatttataaatgacagagagaaggaaaaaatgtggagttgacattttcttgagcgggttagcttgctggtgaagacattaaaaaaacccaagaagtttataaatgacagagagaaggaaaaaatgtggagttgatattttcttgagcgggttagctagctggtgaaggcattaaaaaaacccaagaagtttatgaatgacatattgagcgggttagcttgctggtgaagacattaaaaaaacccaagaagtttatgaatgacagagagaagaaaaaaatgtggagttgacaagaggctgggtacgttttctctagctaggaggccgaaatccagtttgggcgggctgacttgctgccacaattccaaaccatttacgacgccagcacattttttactttgtgtggggtcgaacccttgcaggctcccttaaaatgagggtgtctcccttattaagggacttttagatttggttgttactagg

SEQ ID NO: 32401 - DNA, 1071 bp, Oryza sativa
gccgcgcggaggcggcagctgcggtgggcagccgatcagcggcgaccggcgcggcgccggccggcaggcgcggaggggaggcggcagtggccgccggccggattttttttcttttttttgagatgtgaatctgtgatgtatttttgtgtgagatgtgaatctgtgatgaattttttagaatcttgtgatgtaatttttttaagagtttgtgatatatttggagatgatttgtttgaggatttggagatgttctgtaatatgtaatgatttggatatgggatgggattgtgtgaaatcaatattcaatattaaaggcagaaaaaaaaaaaaaaatatctttcgtcccggttggtgttatcaaccgggactaaagatgctcccatctttagtccggttggtaacaccaaccgggactaaagattgatttttagtcccggttatttgaaccgggactaaagatagcgatctttagtcccggattcgtagtcccggttagaaaaccgggactacaggggggttatgaaccgggactagaaagcatttctccaccagtgtcaagatcagttcctgcaattgctcaattgtgcaatccataattaatagaccctgttgtatgaaaaatgtcagacagcaatgtaaagcggctctgttggacagctagcctagtattgtcgacttagcaaaacatgataccataagggccccatcagtaaccgaaccgtaaatcctcatttcgatttgaagcttacatcactaagggcctcatcgtacggcacatttgcaaacgaaaaataatttgtgaataaaatttttatacacgtgttcttaacgacctaaaaacaaaggctgaaaaataaacttcgatgaaaaaacctaaaatctttaaggctgaaaatttaaattttagctaataaatatagcgaaaagatgagtccgtaaaacaatatgaaatgcttagcatttagttataaggacagtgttttcatccatgagaccatgattggtacaaaggttgggagttcatcagttccgttatccaaaacatatcagcgagcacagatcgagcaaaga

SEQ ID NO: 32402 - DNA, 1501 bp, Oryza sativa
catacaagacataatgagaaagaagtagttgaggttgaagaggcaagtgatagcagtgaagaaggaagaagagggacacgcatcaattggactgaagatgacaatatacgactaatgagttcttggttgaacaattcagttgatcccatcaaaggcaatgacaagaaatcagaacaatattggaaggctgtagctagagagttcaacagcaatatgcctagcaatgggaacaaaaggaaccccaagcaatgcagaacacattgggacaatgtcaagagagatgtcactaagttctgtggattttattctaaagctagaactactttcacaagtgggtattctgatgatatgataatggagaaagcccgtgaatggtacaaaaagcacaacaaccaaaaacctttcaccttggagtatatgtggaaagatcttaaagatcaacctaaatggcgtagagtccttgaagagagtagccataataagaggagcaagatttctgaatcaggagcatatacttcatcgtcgaaccaagacacagaggaggaaacagagcgcaaagagaagcgccctgaggggcagaaggcagcaaaacagaggcaaaaaggaaaaggtgcaccatcacctttaggggataagccaagtcaaaatatggttctctttcacgaagctattacaactaaagcagcagcattgctaaaggcagcagaagcaacactgattggagcagaagcaaaaaaagagaaggcgattgcaaaaaaaagagaaggcaagggcagaaaaataccaaatgtatttaaaactgatggagaaggatacatcaacctccagtgaagcaaaactgaagagacatgaaaatgtattggaccaattagctagagaacttgctgaggaataaatgactagcaagcaatgttagcaattatgcttattttataatgtcagtattcttgtcatatattaaaattatgtactgtgttgatgcttgtactgtgaacctatttgtattgtactatgttatggtaatttgtataaatattgtgtattacagctatggaatgaaactacaatatccttagtacttgagaaatcaccttttcacatggatctagttggtgttgatggtttttcttccatccatgaccaatctgtttttttttctccacctgaatacatatgagcaataattaatagagaacaaaagcaagagggatgttgacaaaacctaggaaaatatagctgttgtaaaagactgacaaaagcaagagctagctgttaggatattgacaaaacccaggaaaatatagctgttgtaaaaatctgacaaatctagtcgttgtaaaatgtatcatctacaaataggtaatgtagttcagcagaacaacacccattctcattttgttcaacttcatctcaacagccttcccactttcaaaaaaaaaaatgtccagcaagtcaccacatcaatctagtgagtcagatgattctagctctagtgactacc

SEQ ID NO: 32403 - DNA, 1501 bp, Oryza sativa
tccgattaaacatttaatttatctcctcgtttaagttttagataaatgaaaactacaaatatggttaacatatttgaaaaaaaattaaaatatgaaataagtctaacatttgggaaggagggagtattggaaacaagtgcatgttcattggatgcactctaaacctcattttctaggctgtgttcatgtgttagagttcttttttttttcctaaattcctatatttagtatatgggttggcgaattttttgcgtggtctgaggaccaccctataaatccattcttgctataaaataaacttcatttcattggcagcggaatactccagttctacttattatactactcttcgtctaaaatatatgacgtatcgttgctgctgctgtgactggttgtcggcccattgaaatgatcagtagctggttcttggtcctgcatgtacacactccattgaaacaaatgggttgcgtttagctcagcgtaaaatttagattttggttaaaattggatataatgtgactaaaaaaattatatgtatgacaggttgatgtgatgaaaaaggactgaagtttagatccaaactttagatctaaacacagccaagtaaaaaatgatgagcaaactgccagagataaaatgactcttgacgagacctgcatcttgtctggtcaaagacggcatgcttgctattggtcgacaggagactgtctcagagaattaagttagtattcattgacacatgggcctcgctgaccccagtcctaagtattcctaggattccactttattaatgttcttaatatgaatgattactggagagcccagcactaattaattgctcacatgtactccttacataaaaaaaatccaattctaattataaataatgtgagcacatattcagcttcatagctaagattagatttttacacatgcaggtttatagctacaattaggctttttttttacttagggtgtagacagaaagtacacttaaagtcaagaagttatatctatggtatcaaaacacaatagtagtactgttggttacaaaaaattttcacgtcatatattactaacgatctaacgttgacttatacttcttccgtcctaagatataagggattatacttttttttttgcaaaaaataagaaagtggcgaaaggaaaaaagacaatacgaaagtgatgattggagaaattaattagtaaaaaacatcatatgaaggaataaattagttacaaaggtggtaggtgaagaataaagtaccgtcttagaattataaaatcacttttattaatttttgaggatataatctcttccaatatgagacgaatggagtaggcttgatcacatgattcactatttgagtatgccaaagttattggctagcaggctgttggattcatcatgctgtattgggatgattttgtgcctggcgactgtttaggaattgctaactttttctctctcatcaccttctcttacaaagcaggtacg

SEQ ID NO: 32404 - DNA, 1501 bp, Oryza sativa
tatttagctttggatgtgtctaatattgcccaagaacagtagccactcgaagaagagttagaggagtttatatacccgagcctctcaaaactagctgttggaggccaagactgcaattttcggacaagttcataaatttatagtagccaatctcagtttcgcagccattttcggaatttccaaaatattttcagactttttgatattttttcataatttctgaaaagcatagagtaaaatgaccataaattttcgctcgggagtctgttttttatgatcttggactctatgtaaagctcactcagaggactatcaaactcaacaaaaaaggtctaaatccactcaaaggataggttaaaatttaggtttatctcaaggtagcactaggatagatcactttgagcaccgaaacatacacaaacacatcgacgttccatccctcttaataatacggcattcctatactcaaataaaaataggaagagaattataccaataggaatgccttctttccatcttccttcctttgtcttaagggatgccaacgccaaaaacatttcaccgtatattcttcaaatgattgatgcagttacttgttgcttcaaatggtctcgcacggtccatcatggcaaagctgtcacaggcccttcaccacctgatttggttcttcggcaccaagcccctcgcttgcccttcaccactgcatggtccatcgcgactgcgcatcgcttgcctttcaccgtcttaccatagtagccacttcatatcccacatctgcaatatatttgctttgttattcttgatattttaggtgtaatcatatcacttgagcgtcaacacctttttaatcattggaacctatttttctcattcaactcaatgaaattattagtctcaatgatccggttgtcaacctccacatgttgaccaacttattgcgtgtataaaagaatataaataaataatgagtattaatcaacaccataagtgtcatatactcaaatatatgatcaaatgtaaagatccaattaaatgaaagtgagtaacttggatcaagtacatgcataactaaggtataggatttgctccccctaaatgtatgcatacaaaatatttgtgtgaagcaagagtatgcataaaaagatatgaaacattgagagcttatcctatacaagaatagaagacatttattaaatataggcattaaaattaaagcataccttcatcgtctccatgttctcaatgtaaagaaactaaccaagagaaaatgctcaaacaaaacattagtctcacatgtatattatcattcacatggaaatattagataggaacatatgtgcatagagagaaagagtgatacatatagcttgatctcaatgcatttcatccttgtgatttaggtccactatcaatgctcgtttctatctgaactcatataaagtccgagagtcacctctcagaaattctacttccatatccacatgatactaggcaaagaaat

SEQ ID NO: 32405 - DNA, 579 bp, Oryza sativa
aacaccaccttataccccctctgtcccataaaaaataaatctacgatcggatgtgacatattctagtacgatgaatctggacatatgtatgtccagattcgtagtattaggatatgtcacatccggtattaggttggttttatatgggacggagggagtatatgggactagctgatccccgtctctacttgttcggttaagagagcttggaggagatcgatcaagggagaaaagttttataccacaatatgtctcatttagtagcctgaattctgttgagattctgacccatttcccgaagaaaagaccaacgagaaaattttatgggccaattctcttatccaattgaaagcccacgggatgaggtattccaaacccgtttcatgtgggatccttgggaaccaaaccatgtttacagaggggaatttccctcgctcaagatactcaagataccattgagcctcccttctcaccagccctagccttttctcctcctcctctggcaagccattaccgtcgcccctccctgtttgggatctagggttcaggccttctttcctctcctctcatcttcctagg

SEQ ID NO: 32406 - DNA, 1501 bp, Oryza sativa
cttagcagtgttacctagctagcttaatcttcatctagctgatcaatgacaggagtttgattaccaccagccatattacgagatagcgtgtacgcgcgaggaactcaaatcgtgcatggtctccagggcttcacggcttcacgcacttccttttctttcgttttccggtttttccttcacatttttttctctcccactctctttccttttctttttctctcacacgtgtcttttttccacatgatatttttttttctagctttagtgggcctccacactggatatttttttccaacttatccttttatatacttcctccgtcccctaatataagagattttgacatttttcttgtactgtttgaccactcgtcttatttaaaaaaaattgtgcaaatataaaaaacgaaaaattgtgtttaaagtactttggataaaaaagtaagtcacaaataaaataaataataattctaatttttttaataagatgaatggtcaaacggtacaagcaaaatgtcaaaatcacttatattatgggacagagagagagtatataagtatattagattaatttaaattttgaaaattcgagtaaactttctagtaaaaaattaaaactttcaacgcgagatttgaaaacttttaacttgaaatttaaaaagtttcaactcaggattgaaaatgatttgaaaacttttaagtcaaaattcaaaactttcaactcagattagaaaatctttaacttatattgaaaattttcaactcaagatttattccttgaattttgacttgaaagcattttaaattttaagttgggagttttgactttttatatgaattttttaaatttgagttgaaagtttttaatataatgttatgaaatttgagatgaaagatttaaattctaaactgcattaaaaaatcacgaaaaaaaagaaaaaaataaaaagagtgtgcaaaaaaacctaaaaaaattgcaaaggaaaaatcatgaaataaaagacgcgtcgacttggcaagacgcgccagctctgacgggcatgtgtgccagcaacggagctggagtgtctgcaccaggtagcaagcccaccattttatgcctcaaatatgtctatctaacacaatgcaaggcattaagtgattttattgtcctgaaaaatatacaatattcttaattatgtcaatctaacactatgcatactatgttcatgtgcttttttggtgcacagagctttccagcctctaggtagtaggtggtaggaggtaccatgtcttatataaaaataacttgttttctcggttcctatgatatttatctaatgaaaatagtcatagagaatctgaaaagaatttgacactacaaagtttgtcgacattcaccactctatgaaatggcaaatacgatggtgaacagtgcacgtaacgtttaaagtttgtatattgttggttgattttatcggtatatcgccgatactaattaggaaggagataaaaccatcagt

SEQ ID NO: 32407 - DNA, 504 bp, Oryza sativa
tgatcatgttgcaattaaagtatttactagctaatgaaaaatgcagtgctgtgttgtttaataagtaacagcaagaactcaagaagactttgctatctgttaaattatattgagcaagacaactttctttgacaaaaaggaaaaacatatttgaaaccaattttttatgcaatgcacgtttgtgaaaaccaaacactgcaaggttcgtcggtgcactaattctcaacgaaatcgacgttctccgatggattatgacgatggcagcgcctgttgccatgtctctgtcacaaaacagaacaagaccactgttggcattcagatcttgctatttgagtcagctagtgcaaactcagtatctgttgcaatccagtgtacttaactgctgaagattccatgtctgaaagggatgttgggagggaaacaaacatcagtaaaaggtgatgttaggtaacaaggttcttttacttcaccgtttgctttcagaatgattcatttcctttaaga

SEQ ID NO: 32408 - DNA, 1501 bp, Oryza sativa
gcgggtgccgacgaggagcgccatgaggaggcccagggcgaggtagtagaggcactgcaggcacacgatctgcgacacgatcagccacggatcccacaccatcgccccatagaacatcttctcctccttccttctccgcctcctccgccgccgcagcacgcagccgagatccgaggtggccggcggtggtggttgggggggcggcgggatctccctcccctcccgcggcttcggcttcggctgcggtggggttgggttgggttgggtggttcgcgggtcgcagggaggagaggagagaggaagagatgttaggtttgcttgctgctgcgctgctggaacgagcagccagcccaggaatatgctctctttttttcttctttcttttttggtttctctgacatggaaattaatattactctctccagacccatagttcttaatgtttcagacacgttttcaaaatataactttcactatatttttactataacatatataataaataaataaataaaattttacttttgttatactctctggtccatattataagtcgtttgattttttttcacagtccaagattttttttgattgagtaagtttatagaaaaaattagcaacatctacaatactaaaatagttacatttaaatctaatattgaatatattttaataatatatttattttacattgaaaatattagtattttttacaaacttaatcaaaattaaaaaaagtttgactaagaaaagtgtcacacgacttataatatgaaaacggagggagtactattttgtaagacaaattaataatgtgtttattttgcattgaaaatattagtatatttttttacaaacttgatcagagttaaaaaaaagtttgactaagaaaagtatcaaatgacttataatataaaaatggagggagtactattttataagacaaatctatatatattgtactagtgtctttaaactacatatttttaaaattattgctagttaaaattataaaaatttgtcacaaatcttatcaaaacattaggaattacggaaccggacggagagaggacgctggaggaaattatattgtggggagtgtgtggtgtctctctcactggattgtgggtccagggggtctattttgtggttggtccatgtggcgttgtcactctgattgagcggctgataagtatgattagtggttgcaaaggtgaagcctgattgatcctggattccgggagctacgtatgcaagagtacctggcatttggctaaactaatttgaggtttatatcattcttgcttgattaacttacttttgagacatcttgtggttggcatgattattgtattttcgaatctagtttttttagctaactctatatgaaaaatggatataagtgctttcgaaaggtaaccataatgtaaaccatttttgtgtatgtactttacatgagaattcatattatatataagccatattttatgtataaatttat

SEQ ID NO: 32409 - DNA, 365 bp, Oryza sativa
cgtggaaaacaagccgtatgattgcgagaatggttttgaacttggggtccacttaagaaaaagaacccgtattgtcccagataactcctttcaattaaacccaacataaatccccgcggggcgttccattccgcggtgtaataataacctagacccccacattccctcatcgcgtcagttgccacaagtttaaaccctctggctcccaatcccattgaccgagcaaaggaataacctctgaagaaagccgagtggtagagtccatacagttcttcttgtcaagaaccttcaagaagttccccccgattcacatccccagttcagccactcgtggaaggatcccaagcaatcgcatcctctccaca

SEQ ID NO: 32410 - DNA, 228 bp, Oryza sativa
tcaatacctgataaaaccataaatgtgaaacatccaacatagtggtatgatttatttctacaatttccacgagtgttggtgtatatttgtatgcaggtgatcaaccaccaaagttgggagagaatgagcataaagaatggaaatatattttgctctgatgaactcacatggttttgagctacaatatataaaatgtgcaatcatttggagccaaaacatggagcatca

SEQ ID NO: 32411 - DNA, 546 bp, Oryza sativa
aatcccttatatttagggacggagggagtatctcattgttaatccaccgtggtcatgtttctggatatgctaggcggtgcacaagaacatgtacaagtattaggcctcctttggaatgaaggataataagtgtaggattttgattcatatggattgaatcactgtatcaggctatccgcatttggatcatccctggaacgagtcataggaatactaaaggcaatattcctttgctacggatttgatggcagaaacacaggaaagttcccatctactcacagctcatttttttgatttccttcgcttggggaagctgctaatcacatcatccaagcatggggacaactgagaatagctcgttagcttgagaattcctgtgttttgttctaacggcctcaatttatctaacaaaaattcctgtgtttttggtatactccatccgaacatcaactcatacaaattttctacatttttcaatcatcttttttacacatgcattcctattatattcctgtattttttacacatgcccttattattctttcc

SEQ ID NO: 32412 - DNA, 1501 bp, Oryza sativa
tacgcggattggagcgagctagcagaagtagcagctgggacgcatgagagagagacctgattgcagtttgatcgcagttgcgtcgccccccatgttttcgtagacctttatgtgtgctagctgtgcgtatatatgcgtttcttgcgccaaacgagacgtacgagagcttttgcgtcctccagctggttgttctttgtaggttgttgctagcggcttgcatgcaatgggcatgcagaattgcaggtggtgatcacgttctggtgtttgcaatggtaccaacgcaattagctaggaaattaaaaccgcctagccgtgatttgtggatcaggtgacgccgtgcgaatccgaggcgatcgatatactcctcggtcctcgcccaccagcagaggggaggggagtgccggattcctgtggaaaaaccagccatccaagccagcggcaaaactcctcttcatttaaaaaaacacaggggcaaaattgcaaactttatgtttctctgaacaatttttgctaaccatctcttttgtgtgtaccagatctgctgcctagaaagttagttattcatcttggtgcatctggctagatccttatattggttaaaaaatactttcatgaaaacacaaggaacttatcaggcttttatttttattttattatcatccttgcttactgacgtgttgtcacaatcagagcaaacctcttgcgggtctgcatttatgagatataaacatgctcaacacaagtaatgcagactaaattggagtttttttatttgttgacaaattcctcatagaaattggttgacctaacattctggatgatgtggacatcactacctcggatacacacaacaatcttccaacggtcattcaaagaccgataacaagagctcgtacgcgacaattaaatttagaggtgagctcgttcttatgttcctctttgtatgaattcgagactagattgctacataatgattatattatgattagaaacaatggagggaacaaggagacacttggagaaggacttagagccatggaggatcatcaaggatgtccaagtcaaggtggaggcccaaaccaagtcgacgtcgggtgtaattcggagtctaggaccagtctacactaaaacgggcgccaggtcgtatacgtgctcggattggggcgttttttatatggatggaaagctaagaagataacatttccattggttttggtcgcacgtccaaattctttccgagtcaatgggaattgaccgaataagttgacgtccagaatctgtcccggtgctgcgtcaccgtatttgggcctttggcctatttatcgtgttggaacccattagggttgtgtcgagagggggttgcatgaccctaaactctatatatcagtacccgccgccatctttaggtttttgggttttgcttagattaatatgtcgagaacagtttcaccgctagatcggtttgtaagaccccaactcgtgagcttaatcattcatgtgc

SEQ ID NO: 32413 - DNA, 371 bp, Oryza sativa
ttcctgcagcccgaccgggcagcgtgtgccggtcagaccggcggtgattgagcggtcaaaccggccagcccgcggtctgaccggtcgacgctgtgtcggtttcggttttgggttgtttatttagatatccgtgattatttcatgattatgacttctagatggatactatacgtatgtaatactgttatttgctactaatgagtcaagttggagatagtttggtctcggaatatggtttatttatttatttcatgtgtaggtgacttgatgcctcgggagagtatttgcggtgatggaccgggagtcaacttagggataagacgacgtccgtggtggtcagagatcatgcgggatacttaggctagagttga

SEQ ID NO: 32414 - DNA, 1501 bp, Oryza sativa
gattgtatgttcggggattacaattgaaccggccttatcccttaaataggggttggttttgccctctacaggccctcctccacatccaactcagaatagaaaccaaaggaaacccgaaaatacctttccaagcaagaaaacccaagacccgatgaaaatagactcgggctcgaaccctgacggtctgcccggccacataattgcggtcagaccggagttcaggccgcagtcagaccgcccatataccggcggtctgactggccctgacggagcgtggggctcctcaccgggagaccgcgcaggcccccctttgccggttcggccggggactcagggtgagattctaagctctctgtatgtggaaggttcgcgagacaggaaacacacaagacacgggcgatgtatacaggttcgggccgctgagaagcgtaacaccctactcctgtgttttgggagatctgtgtatgaaggagctacaaagtatgagccagcctctcccttgttctgggttccccctctcccccaaaagtccagtcccagtgggcaaggtcctccttttatatcttaaggggataccacatgcaccatttctctcttttttgtggggacttaccccaccttttcataaatggacggagatttgtatagttgccgtccgagtcaccttctgatgagacggcccacaactacctccactttcgctgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgtgtcacatcctgatttttgtttcaggatttataaattatttaataaattattattagaatttatattaaatgttcattaatttacaagtgaagttaaatgtgggaaataaaatttcctaaatttaaagcatggatggatttaatttttattaaattctccatggttaattatactctctggaatattctcggatttttcgaagctcaattcctaatttttaatcttacaaagagtatttcagtaattacccacatattaaattaatcattaaatggtctaattgtaatttttttaagtactttgagtgtccaagtattttcaggatttttcttgaaattatttgagcattggaagtatttttaacaattcaaagatcatttcattgattaatttaattggaaaagtaataataatcctcttcctagtcttgggccctttccagcccatctccctcttttgtgtgcacggccgtgcagcccaagtcagcccagccgagctcccccccttctctttctttctttgctttgttttcagccagcccaagacaaaaagtctaatttgcctccctcg

SEQ ID NO: 32415 - DNA, 1501 bp, Oryza sativa
caagtctgtggagtggagcaatagacgaggccaccagccgaaattgggctagattgggccagccccaagttcggccgaacctggtggttcggctgaacctcccgtggcgccgatggatgcagggtttggatggacggctgggattgatccccaatggcggttggagggtattactgatcattccaaccgtcacaaccgtcattacctgcctataaaaagagctactcttctcacttcacacacacacctcaagcaatagctctatcatttctctcaagtttagtttagtagtatttagctggtggaatagaaatagaataggagtcaaaactccagaagccttcggaagagttcgggtatggctctagtaactttcctttcctcttttataagctttgtacttttattagaatactcttctaaatacatttatggtattggaatactttctaagtatatgagtacctactttacattatgttcatgttataatgaatatacggctagcttatctgggagatgttttggtgcgggtataatgtttgcttttgcaattactctatgtcatgacgatgatattagagtactatctggtaatttaggcgtggtgtctaaattacgagatatcattatttggggttatatattgcggatgagaggtgggccgctgatggtgacaactcagtacgggtattccttcgcgcctatatataatcctaagttaatttcctgaggagggtattcctccgtatttagccccggttgtatggtcatgacgggctgtcgtaaggaactcggcagtcaggggtggcttctcgaagtaccaggagggcatcggatagagggtattagctagtatatcagttaactagaatgtatgtatactatgtatattagaagtataggaatagattctctttctcttttctttacacctagtttagatcatttataatgaggatgagttgttaatgcttgtgtgtcactctacccttagattatcttaacccctacttagaatatgattatcacaagtaatatataaactattagtcaatctttctctacatgatcttcccatgggagaaaataaatacgatacccttggaatactctcgggtgaaatgctacaatggtatatctgtgcgcttgcggatgaactctgtaaccataatataccagaagtatttctgcgccattgctgggaattatatttctagtaatgtcattaagaaataccaacaagcatttctagcgccgttgacggggattatatttctagtaatgtcgttaagaaataccaacaagcatttctggcaccgttgccggggaagattcataatagcgattgcttgaactaatactttatatttacttctgtataatcatttcctttgtagactaaccttggttgttttcacttgttgttgtgaaaacagggtagtgcatgactggtttcaacctgccggaaaacttcaaagaaaatccagaagctttcttc

SEQ ID NO: 32416 - DNA, 751 bp, Oryza sativa
ctcggcccttggggccgaggcgggtgcggcccgaccccctcggggggactaagaggagggcgaacacatcaccctcgggcccaacgtccctcgggggtgccaggccacgtgtgcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgcca

SEQ ID NO: 32417 - DNA, 1501 bp, Oryza sativa
aaccaatataatccctgtttcctgtttgcttgatgtcgtactacatagatcgtcgtaccagcgtaccccaataccctctatatccggtctacgggtatcccccgtcgacagtggcatgccaggtaggcgcacctggtgctcaaggttctactactatgacatccagcttcgtcgacaacaatgtcaacaccaacctcaactaaggagttcctacttcaacaacgctggtgtggactcaagtcggcgaaatcgtcttcccggtttacaccacgatgccgatctcagctagtccatcaatggccggaaacgagaacgtagtgggtacaacccagaacaactccctgtcgaaggaccctcccgccggagcggagattggaacgtcgacgacatccgagcccgagaaggatcctagtgcggccaaaccttgtctttttgacaagaatcacgagccgacgaggatgacttccgaggtgacaaggtcctggtgtcctatccacaaaaccagaaaacacaccttgcaagccagctgggtttttctcaacgtccacgctgaaattcgtgcctgcaaagagcgtggaattcagcgtacttctccaactcgtgatgtccattgtcctattcacaaggcaaagaatcacgacatctcaagctgcaaggtctttctcagcgccatgaagacgccacctcctaaggtccagcagtcacgcatccccctcagggataaggacaaggaacaaggagcgacgctgatttcagatcgatttgttggggtaatcgatatcgatccccacgaaccatcagtcttgcacctgctcgaagactatggcttatcatcaacgagtacgccgcgcgaggttctggctatcgacgagtccggcacgtcagcgcgcgctaatgcggaagcggaaaatcaagtgactacaccagcccagcatattagggtcgtcaacgcaatactgagggaaaccccctacgatcccgttctgaacgacgatctcgcacgttggacagaatgactacgggaatcagtgaccaacctcagcaacgcgttcgaagaggtcgctgccgcagcacacccggaacagccaccaactggtgatgctaacggtgaaaaccctgaacagcgggaatcgcctcatcgagccacccctccacctcgcggcaccggcgatctccgcgatcacctgaatggccgccgagaggcgcgacgcacacgagacaacgagaaccgttcccgacgtcacgtctcttcacggcgtcacggtaatgaagaacgaggaggccgttcgagtgaagaccgaggccgtgataaccgccacaaccgccacgatcatgacgatcacgaacggcgggtgctgggcgatactggtcaaggacgtcgccataatgacggcgatggtggagatcggcgctgagacaacaacgggagacaacgacaggattctcgagaacccagccgacgtcctcgtaatcgtacgccggaaccaagcgacccatcgtc

SEQ ID NO: 32418 - DNA, 935 bp, Oryza sativa
tcacctaaccacatttattgcggtttggctgaacgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgtcaggcttcatcctaaccattacaggcaagatgttgtgtgaagaagggcgaacatgtagattgctaagctgacacgtggtggacaagaatgaccgacgtgactggtctgacaccggtcatgtcgtcagcagacagccatgattccacgtcgcatctgctcccggcgaaagtggaggtagttgtgggccgtctcatcagaaggtgactcggacggcaactatacaaatctccgtccatttatgaaaaggtggggtaagtccccacaaaaaagagagaaatggtgcatgtggtatccccttaagatataaaaggaggaccttgcccactgggactggacttttgggggagagggggaacccagaacaagggagaggctggctcatactttgtagctccttcatacacagatctcccaaaacacaggagtagggtgttacgcttctcagcggcccgaacctgtatacatcgcccgtgtcttgtgtatttcctgtctcgcgaaccttccacatacagagagcttagaatctcaccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcttgttcagcccaa

SEQ ID NO: 32419 - DNA, 1501 bp, Oryza sativa
ttcgacgtgcaagaccgtacctccttgcgttttagttcatggattttcctcccgtctccggaggtgatggagcgggcgtcttcggcttttccttccacaccttctttgatttcggtgcggaagatggcttcttctaagccggctgctctaacttcttggccggttcaggtgattttactagcgtcctccaataacggttcctgggcattgttgtttccttctccaggaagttttgcatgaatttcacaaggttgtccgtcttgggtggctccacttcgaccacttgaatattctacgggtttggcccgtacttgattctaaccatggagcattgttccgtcctcggttgaaactcaaacttttcctccttcccgttgaactgttgtgccccgatcgaacaggtgatcgtaggacaccccggatctttcttcttctccgggaacttgtggagtatctggttgctgcattgttctgtcagcttgaccacctccgttgttgggagcagtctcttgttgttgagtatgtccttgagataacgggcgtatgttggcacttgcatggcgtccaacaacggcacgttgatgtggatcttctggattacttcaacaaaacgggcgaattgctcgtccactgacggtttcctactccgttgagggaacggcagcaaccgtatgtcgtattactcctgcggcactgtcttttttggctgaacttccttgtcagccgagtcattagatggcgcttcttttgatatccctttagttcctgcagggttaggatatggcggatcacgagtggacttacctcctctccttgtgatcgccttgacattttcaatggaggagtcgggttgccccggaatcctcccagattcatttgcagggactaaagatgccaactgagctaactgggtctctatcattttattgaagctcagctggttttgaaatgtggaagcaaagccatctaatttgacatttatgttatctaggatcttatcattggcagcaagctttttgcttagcgaatcagtggttttagcttgcgcaaaaacaagatccttcaaggagggctggttagagaagttaccgttaatgttacctccttgataatatgggcatggttggttccacccttgacctccttgtggacggtacccgttgttgttgttgcccatgtacatcgcctcctcacgggtttccgggcaatcattcccagaatgacccgtgccaccgcagacttcacacgtaacgtgtgagtccaaggccttgacggtgcctcgtggccttttctcgtggtcgtccaagcgtttcatgaggaggttcagcttggtagcaagtaacttcgtctccttgacggtgtgcatgtctcgctgacgggtctggagtcgttcctcgctccaacccatattgaagaccattttctctattaattcaacggctccttgaaccgtttttgagaagaaatctcctccaggtgatcgcgggacattggggtgagt

SEQ ID NO: 32420 - DNA, 1501 bp, Oryza sativa
gctcctgttcttgttttctgtaccgattattttttacaaccggaatcaatgtttatctcatactcttatcagtccgttaacttgaattgcacatggggaagaaagaagagcgaggatagaagaaaatggaactgacatgtgagtcccacgtctggggtctgacggaaaactcgacggagtggcacaattctaatttccccaaattccagtggcatacagccgatatcatgaatagtagtgacatttatctaaaatgacatatttgtagtgacatattttaatcgcctctcgctcagactcagagagaagcacccgtagaagtagcggtaaaggaggtcgtcgcacatgggtgcggaatataggggaggcgactggagcgtcaaagaggctatcgccatcggatccacccgtgggaagccgtgggagggcgccgccaccgcctttgctcatggtgggggagggcgtcgctgttgctgtccgcggtggggtagggcgccgccaaatgggccgcacgtacctagcagaagccacaagtttgggccgggctaaaatcaatgttctctctctcagtaattttaagtttttttttattttcagaaatagtattagtaccattttaattgtttatgactacttattaatttaattctagctaaattgaaccaacgagaaatttggctagatgtttcttatgacatggatttattttccgatcaacgttgattataaatttgtatacatttcatttctgttcatgtttcttaattatttacgccaacagtgatataattcaagaattatttctgtttaactatgtaattagttgagacaacacaatgatgagatctcattatggtgattattgatagctacaagactagatcactagtaaatagctaggttgtgtcctgactgctgtgtgcagttgctcctcctgagatgggtcctcttgctcttttttgagcttgaatagatttgcttttactgactaaaatttccaaaccaatcttgagggcttcttttgaagccttctaattatttgcaaagatatgaccttcagaaattctcttgctgccactgtatttgtacaaaaccaatattaggtttataaaaatgcagaaattaacttcatgattttgtaggagatatttttgacaagtgctttttttagggatgacaagtttaaactgcgatatttttttataatatttttacaaccgaattcctaaccaatacaagatttacttatatttgttttttttcacaggtaatttttatgaagactgtcatgggatgtagggtgaattgagtgcacttcatggtggaaacctttggatatagcagaaggttcatcaagaagggacccggatgtactaacccttcagttagaagtagcattgcatgtagaacatctattttcacagtaatctactaaccctgtaactcgtattgtcgcatcaggatacacctccatgagatcgtgtagacatgctttgtgagg

SEQ ID NO: 32421 - DNA, 499 bp, Oryza sativa
  unsure (1)..(499): unsure at all n locations
gatggggnnnnntttgatgatttagattccnnnnnnnnnnnnnnnnnnnnnnnggaatcgcgatgtcaaattaaacagtgcaaaacatgcagagacaaagtatttgctgtttaattgttccttttttttttgttctcaggattaatgaagctgcatcattcagtgaaatgtgccttacatagataaacatcatttactggcctttacagaaatatggataatttggttatgtaccactcaattattgccgtaaaagcgtttgccaagtactgtttataaattgtatgaatggtgttactgaaagctaaactctttttgcatttaccacctgatattttccatttgctgccttcttcgccaatgtgacatggcctggctaggacagcaaatgtgcgacaagtattggtcatcatgtggccattgccagggtcaacatgacagtagtgcagtgctttcatcaaattatgaccaggtgacagtgagcgccaatggtcagcaa

SEQ ID NO: 32422 - DNA, 1501 bp, Oryza sativa
gttcgagtcgagcgatggcgatcccatcttttttatatgctattgaagattgctgagaaatgtcacgtgcacttggcatgttatcctggtatgcaagatcaatattaatggaggatctcctggggatgttcttaaatgcaacgtagaagtagaactgttggccatatgcttttaattgtatagacgcaatatcaagtttaaagtatgattttttgtacagcgggaggtgcacctgctagtatttctttttttcttttttgactgaaaagttatagatggcttgagaagtatatgtctgcttgtgtgaactgcactgtacattggaattggtgttcagaagacttcttgttgtgttgataggacgacaagaatgttaaaagaaatgcatgcactgctacttgtttgattgggttcatactgtcaatatcattttgttatatcattttgatctaggttcaacttatttgaactgcggatggttgaataaagttgtatgatattctgggtttttttagttttttaattaatttcttgagtttctatgaattttatggaattttctatgaattttcagaagtttttgtcgttctcataaaattttcttatggtttttaaggtttgtttttgaactatcttatttttcttatactcattatagatttttattatttttaagcacatatgttttctttttcctactatctctttgtccattccaagtcccaaattgtatatgggttttttcctcccgtgggagtaggttcccctaggtgtggggtgtctcacagggaaaatccccttgggggactattttctcgggtttcttctcccgaactttcagactagctggctcaatcccctccaattcctttttcacagagataaatcaaacaagatataagaagagtgggaactaaaaggcgtaggagtgcgagaatgagattgcctgtgcattaaccttttggctaattggcttgcttcgattgttttgacatcctaccccatttttattgactcgtataatgccacgtgttatgctaacaagtattccctccgtcaaaaacaaaccaagcacatatgtgatatatctatccagattcattgtattaggatatgtcacatctatgtcttaggttctttttttatatatacagagggatagggttgaaactggttcggatagtttctgtccgtccggaccatttttcagatttggatagtttcggttggaactatccggaaattctcggattcggaaacgaattcgaattttttttctcggaaacgaaaatgaatacagtaagggtactatctgttagaatcggaaaacggtcggaaactatccggaatttttttcgaatatctgcagacattgagcaaattttagaaaaaaaatacgtatatatacataactttttggcaaattttaatacatgagacccaaaatttgtgtaatttgctgatagacatcgaaaaaacgtgtcatggctgaaagacattc

SEQ ID NO: 32423 - DNA, 1501 bp, Oryza sativa
ggatggcgctgttgcagctgttagttctcctgatgattcggtctcgaagctgtttgatgtggtggttcttttttctccaaaatcatagttggtatctgcgccctaagttgtcctctttataggagaaagaacacattgatcaaatgaagaaaaagcatgctgcaacaaagcattcgcattaagattatgaaaatagcaaactagaaatgccattgcattatttgtttttactgatatggtattatcgtctaagtacaaccactttgactgctatattttgacttctttcaattgtggttgagatgtaccccttccccccaaaatacccaaaatataaaggattttggttagatgggagcctgtccagattcgtagtactagaatgtatcacatctgaccaaaatcctttatatttttggacagagggagtattaatcagcgacagacctacaatgttcaacgtatgcttggcaatatattatgggttctcattatttgacctacaaaattttgcaggttcaaataattcaacaggaaacaaaagataaactatgttggaaattcacaaacaatggtatctgcagtacaaagagtgcttacaaggaggtttacaaaagagaaatttcaaatgctcatcaggttcactctcaatccctttctatcttgaaataaatctagaagaacagatacatccctcccaaagttaaaacttttgcctggagactcatcatggaggcccttccttcttcccaaaggctaaatcagaggattcaagacattttagcagcctgctgcagatgtggtcaaatactcaaatagaaacagatttccaccttctcttttcttgtccttttagtaaattaacttggatgatctcagaagcaaaactctactgatatttttcctgctaatgttcctatggctcttattattgcttatatcattaacaatggctcttccaattccaccctaattcgaactctgaatatcatgtggtagctttggaaagctagaaatgatcttaagtttcagggaaaaatcaaggagccaactcaagtttgcatggaagcaaaagcaatgattaaaacttatacaaacttcctttcaaatgatttgatgcaggaggatcttgatgaggaagatacaaacagaagaatggtgaatttgcctaattgaattagatgctactcagatgctgcctggagtgataacgaaacaggaattggcattttctttcacataccttcctctcataatgccatttttattagagccacaaccataatggctcaatcacctttgaaggggggagctgctagcatttcaactggcaatggagattgccagattcttgaagttcactttctcacagatagtgccatcatcgcgcggacacttgcaagagaagaaactttcaagaagaaccagggcattggagcttaaggccaatttggagccaaatttgtatgagaaggttggagaatcttttgcaggttaactg

SEQ ID NO: 32424 - DNA, 458 bp, Oryza sativa
atgtatactatgtatattagaagtataagaatatattttctttatcttttctttccacatagcttagatgatatattatgagaatgagtagttaatgcttgtgtgtcactctacccttggattattttaacccctgcttagaatatgattatcataagtaaaataaattattactcaagttctctctgtatgatcttcccaggggataaaataaatacgatacacttggaatactctcgggtgaaatgctacaatggtatatccgtgcgcttgcagatgaactctgtaaccataatataccagaagtatttatgcgccattgctgggaattatatttttagtaatgtcgttaagaaataccaacatccactcgtgcaaaatgtaaaatcaaggagctaatttagattttgtgatgaaaatattggttgtttgttgatgatattttggagtttaataga

SEQ ID NO: 32425 - DNA, 555 bp, Oryza sativa
ttatgcgggtagcgggactacccacttgcatccctacttgttcccttttacacccgtgaaacacatcttcttcctcggttcctccaccacctacaccttggcatgccttcgccgaggaagacatccctcatcaactatcggagtacaatttgtgcgataaaggaaagtcactcataaccaagaaaaaagggcagattatagtattataagagaagtatattgcattattgcagccctgcttgttacatggaaggcatatgtcaggcctggcaattcagaaaaggagtctaaacaaaccttacctctatgaacacaagaggagaaaaatcatattctacctcatagatctgaacatctgaagttgtatatttgaaagaaagaaacccaaactacaaacttactaggtgcaggacaacttttagaaaagaaatcccaaccttgggcgacccaacggacgtaataaccaaaacaatctacggcacactattcatcattagataaatctgactacagtttagctaagtaatgtatcttgtatggatactgtaccggaga

SEQ ID NO: 32426 - DNA, 726 bp, Oryza sativa
gagaccgcgcggtcttgcgccgctgccgtacgataccgcctgcgacgtcattcccacgtcactttcgcgtaacagttgtgcgagaccgacggtatatttctgtaaaaaaaatttgcatcctaaatattcgtgaggaaaaatcgaatgaacattatattttcaaatttaattcccgggagtacctatgcgtattttgaaagatttgtatgatcatatcacacatatttttaatatttggattaaaattcaatagacacagtaaaaggcaaaaagcagataagaaacaccataatggacactaaattatcattttaagaaaatgaccaaatccaatataaatttcaaaacttacatacgaagattaaaaaattacactgtaacttacgaaagttacaatgtaagtttcataaattacactgtaacttacaagaaaatacaccgtaaatttgagtgagaagaaaatacaatgttggcttgtttggtaacttgagggaaggggattgagagtttacacgagggaatttataatgagattaagatgggaatttgatttttaatcccaatgtcttgtttggtggatgtgatggaaattgacagggagtttagttggagattagctcattaataaaaacggatggctgagatttgcttagacaaagtaaaggaggaatttcctcccaattacctgcccctacccaggtattgaaaaggagggagtttcttcct

SEQ ID NO: 32427 - DNA, 256 bp, Oryza sativa
ataaaaccttttcaactttgcttatttcttttcaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattatttcttttagagaatgatttttatttcgggatgaatttatcaggacgtgacagtcaccaccgtcctcg

SEQ ID NO: 32428 - DNA, 1501 bp, Oryza sativa
gatcggcagagttcgagttggacagggttagccgattgagccgaatccgataatatgacacggcatacgttgtcgggttaggttgacgtgcttcatgatgatttccacgcatggatggagtcctgagaaggcaattgtatagtgcttcatgatgattgccacgcatggatggagtcctgagaaggcaattgtatttattaattaggatattttatgtaatttctttagagatatgtttgggcaaatgtctgccgcaaagacttatagtatcttagagtttgttagagataagagtcatgcccgatatggacatattttgtaatctcgggtataaatagaccccgagccccatgtaataaaactaacacacgttcaaatcaatctcggtgcatagccacccttttacttttgttttgtttcgacgagttcttgctttggggttgagctgcatcggtttcaatcttcaacaagaggtaaaacttattgtggcggcttgcattctcgggattagtgcttccatctttatgatactctaatcttgtttatgtgataaattgaattatcatatatcttatataatctccggcaatatcgctatctaacctacaatcggctaacatcaatctgtcagtagaagacagccgattaggttaaataccgatgttgacttagattatataggaaatccaccactctatgacacatccaacggcttgattgtctagatattgtcttttttttcatacttatagatgcatctgttgagtttgatcgtatgagtcgtgattagaatctcaatctctagcctgcctttggttgccaattagggtagcatcggggtttcagccgatcttatctgatttgaatatatttatcttatgtgcttgattgacatgttaaatccgccctttatgttaagatctcgtcgtatttaagtatattaagctttccgtttggtatattgtacttgctttaatatctcaatataaaacggtatcggagtattagccgatacatgctagatctatctgatcggctatgctatgaacatatataatcttgttgttaatatatatttcggtctaagtgatttatactgtctcgacatggcgaccaatctatcccaatcacttgatttaagtatatatcgacataaggattatatattgttaatatcaacagccgatcaagtagatttagttctttcttacttattaatgtctgccgatcgatgcatatatgacatcggctcaaagataaatgatatgtcatcggcatctagccgatcggctatcgtttatagatttaaccgcggtttctttgtctttgtctcttgttgatcgcaggatcaaatcaactggcacgctcacatacccaaaggcaagttttggacctgcactggagttaagcagatctcccagacctcgtgtttttacatcaacacgcttttggcacgcctggtgggaccattagaagtcagaaccgcaacagtattctctca

SEQ ID NO: 32429 - DNA, 283 bp, Oryza sativa
tactcaagaagaatattatattgaattcagagtaataaacagaataaaagaaataggagaagattaccgacaactccggaattcttccaacttcttctactctactctcttcctattctagtatagaattgttgatgtaaaaacatgaggcctgggagatctgcttaactccagtgcaggtccaaaacttgcctttgggtgtgtgagcatgccagttgatttgatcctgcaatcaacaagagacaaagacaaagaaaccgcggttaaatctataaacgatagc

SEQ ID NO: 32430 - DNA, 1501 bp, Oryza sativa
ggctaaacaggactgttctcaaccttataaatgagaatcctcaacagcccaagtgcaccagcaaggttgcaatctgtccactgcacaagaaaaaggaagaagtgtgcagctggacagtatgacattctcatctgaagacaggcgccatcatattcccttctaaattcagcagcactgcatttttacaaacaaaataatttagtctaactattgtaaaacaatgatcttaggcagctcagtagctagacggctgtagagctttatccaaaaataactattcaaagtttgatgtttggagtagagctgaatgtctcatgagactcaggtgactttctgcaagtttgatatacatggtacggtaggacttctgaatcttcaataaaaggacttgtatcacagtatgggggtattaacaatatggtcgatgttatacgtgaatggctaaaaatatggttgcagacctatgctaacagtttgcaataggtgtactcaaatcaacaaaccatttgtcatcattctctacatataaaatttgaaaactaaataaataaatgtactctcatggctactccgtgcacatgtttattgaaagttgaaatttcagaaacaattaaggcacctggtacatagactcaatatttcaactcatctgtgatacattgtaaaaaccttggaatagatctattaaagcaaataaattagttgtcaggaatgtaaaacacttgttttcaacctgtcacttggttatttctgaaaaaaaaaacaaattaaacatgcacattatctccacaatgaatagaaaacaactccatagagtcatattttgtatatgcagctccaaccaaaagatgtaacagcaacatggatcatagaaatcaccatttactaactggacatctcaatcattaaccaacatggaccctggttcatagactgatgaatgtctcaagtttcaacaagtctcttgacacattgtaaaaacatcaaaacaggtctatcataccaaacatagtagttgtcaggaatgtaaaatatgctctctgcctgtcacttagttatttcataaaaaaatacattaatatattgcttctttatctccacataggacagtaagcaacaactctataggggtcaagtgaaatactaaattaccatggccaacatagtaacatgagagccatattttttttacacagctccaaccaaaagatgtaacagcaacataataaaattcatgatcagtagttagttgggccaaatgatattagctcttagtgtgtagcgcatgttgtggacaacaatttccaaatacggctttcagaacacacgatgatagcgaattgtgatgaaccagcagcacaactgcatagcacaccgacaacaacaaaaaagaaaacctcatgatgacaaaaccaaagtagtacaaacagacctgcaaggccaaaggagatagctttggccacttaagcagtatatctggtgacaggtgtcactgcagcca

SEQ ID NO: 32431 - DNA, 1501 bp, Oryza sativa
gatccctaccaagctccacatatcaaaccttagagtaggaataaaaaaggaaaaactggtgaggaattcaaattgatacacttggagagaccgagtgaatcatttgaggaacttggttttctttttcaaaatcatttgaaaacttctggaataagagttgaatgaagattggatgattggtgctctaattgttgttctgtctttcaactgcccaaggcaaggagaagcagtgtctcgtggtaatcaggagtaagggtaagtcaccgtgtcaaagattatttaatctgagagagattacatataccctgcacctgtatctttgagatatgcagcatagtagcaactcctgatcaacaaccaagtctttgtttccttctgtccttcacttggaacgagcaaaggttcaagctttgggggttttgttgacggtcgttatcgatcagtttcgaccgtcaatattactaaaatagagaagaactagtgatacttgcaatgcatatatctgttagaataataatattccactagtattaggtatactaaccttttgcagagaatgacaataaagtggaggagaattgtcacgtcctgataaattcatcccgaaataaaaatcattccctaaaaggaataatagaattaattaaaattcaaaaagaaattggcaaacactaaaatacgtacaagaaaaattcgaatatggcccggagaatttttgttaaattctccttggtctaaaaggagccctcaaattttacttgaattttcagagcaccggaaataattattaagcaacaacaacatttatcaaagtttactaaaaagaaaaagctaaaaataaaccctccttcctcctttgggctgagcccagcccaaagtccttccctcctccctctctttttccatccctctctctctcttgggcctccccttccccttccggcccactccatactctcctcctccttctgggccgaccctcccctccctccttcccctcagcccagctccctcctcctccctctccctcccgggctgcctctccctcctctcctcctgggccgcctccgggcccaagccaagcggcgccctcctgcccgtgccacgcacgtgcgtgcgctgacggcgcgcccgcatgggtcccacgcgccgggtcgttgtcctcctcccgcccgacctcctctttctctcccggaaacctagcgccattcctccccaaaatccacgcgattcaaaccgggaattccaaaattgattagggggaattaatcccctttccttcctattcaattccccccaatttcccccttgattcgtgccctctaacgcccggaacagccgcgccattcccggccgccttccatggccaccggccacgaattccgccgccgttccccgcctctcccgtggccggctccctcccctcacctataaactggaaccccctcgctccgttctctcgttttagccttctcccgcacctccccgtgtgatatgacca

SEQ ID NO: 32432 - DNA, 1501 bp, Oryza sativa
attcaactaattttattagatatatgtgtttttcttttattactaaaagctctttattttggccaaaatccattgctatttgggctgttaaaatctgaaccgttctaatacatttttacagttttggtatttgttatttgtcatacgtctctgaggtaataatgtcagtaaggacaaaggaagcaatatgcatagacaatatcgttaatttactccatcgatttgagtgaattttactttaagccaccttttgtcgtataagtttcacttttgaacacccttaatccaagctttttattttggactagctaacttcacgtttgttgcattttaaatcacgtcaattctcttatatggacatgtttattctctactatgacaaatgtatggcacgcttgtaggcacataattttgcaagcgtaacagagccaaacatgcttgaggttgttgatgtgctaaagaagcggtcagaggtacttgtaggggttaatatgtgtttgtgcgtgtgtttatagtggtgagtgtacagtttatatgagtgcttgcctctatattgtgcttcgcaagcttgagctcgttgacgaccgtactcctagaaaggagcttgtgctcgttgcatccacgagggtggcggcgtttggatgaggcttcgcccgtctctcttcgccaaatctggaagtgttgacaaagatgagaaggtctacactgtggtgatgtagtcgaggtaggtttgtcactgtcagactcgggtgctgaggcgatagacacgttgctaaagctccgatgccaactcacacgcactagctgtctgactcagcgagaaactcgcagcgacccaaactatggggcttgtagcatgggaggaatcacaacgataagacatgactctagatgaaactaggtgatatgtctcttgctgtgaaatttacggatgaataagtgctagtaaaacattatagaaatgatgatttaaaatgttgtgaaaattatggaggaagatgattcgacgtaattgtatgttgaactttacaatattatattttagatgacgtgttatgtttgtatgatatttaaaatgctctagaatagtaattgttaggtggagctccgacgaacgtcgatggagaaaatgcacctatgaaaaaaaaaacctcgtccacacgcaaagagacacacaataaaactgcttttgataactgagggaactgtgtataactggttccggggttgagtgatggtaattaaaccgagggagaccaaaataaacttttcacctttattttatggactttttttttatgctacaccgcctgaaggcctcacagactcacagttttaccgggccgtatccgagcccatcgtttagcttcgattcgaccattccccaaatcccaattaactgaaaaaaaaaaaagaaaaagaaaaaagtctcctcccagtagtgagtccaaggagagggtattcgaggggttcagtcgaccggcggcgagcatggcggcgg

SEQ ID NO: 32433 - DNA, 1501 bp, Oryza sativa
taatatttagaagttagtgtgcatcaactttattgtatgataggatttaggaacaatagcatgtacttctcagttctccctcaaattcaaaatataagaagtatttcatccgttaggatctggttttaaccaacagttgctctattagtacatcatttatatgatagaaaagcacaatcataagtaaatatttttgaacataaatctaataaattcaattttatgtaaaaaaaatagatcctgatagaatatttattggtaaaaccattagtagacgggtcatatccgactatggtatttgagggacgtaagataaagctggtaccaaagtatacgcaagcaaaggataaggatgtttctactggtccaggtcccagaggtgggtagcagcccaactccagtttatgtgtattgatttggggtttgttacaccaactacaaagcgggaaacaagcttgctaatctagcctacggaactactcttgacgtgttggctggttgtatttggcggcaacctgaagggcttcctcctggcgtaaactcactgtgaatttgttttaagtagtttaccttaacctcctcgcatgtttttcaattagaatacatgtacacaagaccctatcgtccctaaatcagactataccgtctttcctagccaaacatgactctctattatttttactttttatatatactagaaaaatacccgtatgttgtaacgggtgaaggttattttaatcttattattgttatacggtttagttaaggtgaaattcattgtgagaattcgcgtggatatatatttgtttagaaaatcatgagttgcagtcaggagtccgatcgtctgaagttagcatgcgagattttttaaagagattttttatatgactccttttgtatttcccaaagcaacgaacttaaaaaccgacttatacacggatgatgtaccaaagtaccagaaaaacatctttaatttttataatagtagagatttagggatatatttccgtatataagtgtgtggtattcttggcgatgatgattagtgtaggtatatggggtatcccttatttataacattgacaatagcgatgacctcaatgtaaatatatatccaatattattgttgctgtccttacccaagaagccatttcatcaaataaatcgtaatcggaaaacatgcgcttaggttaaggtaaactacttggttctttaatccgagccaaatactagaacgtagtcggatttcaaatttggatagatcaaatttcataataccacactactgtttcaccgggaatatcgcaccacattcctcaaaacgtgaaccgtcactccagcctttatatttcagtagtgacattcatttcaagttcacttcaattgttcattggcctcttcatctccatccttcagacactcaaaatccttagcttccactgaaactttccctttcttctgtagccatcattcatagatcttggagagacaaatgagaaga

SEQ ID NO: 32434 - DNA, 1501 bp, Oryza sativa
tgacagggattgaggtgagagaggaaacaagccaggaaagaatagaccagaactagagacaggaccttaaaggaactaactcttcttgttgatgtgttgtttgttttacttattctgcaagtagattaagcaaacaacctagcatggttacatcacaacccaccgatgcaaaccacgcgctacacacacaagcaaaggaaacacacgacaaacgaaacaatagagggtggcttaggttctgcgacgggttctccaagatcttcactgcttcttcacagctggcttcactgcttccttcgcttcgctagcggaccctgtggtcttccggagcttcggcaaacaattggcgacatcttcttcttcgcaaagctgaccatctagtactagtcaaaaatccgaaggaggaagaagagaataaacattttgcaaatagcattacggaaaggaggaaaaaggaactttcacaaatagtttcatttataaaatatgtccttaggttttatccacttggcttatcctacagttgagatggctctgataccagcttgtcgcgactgagaaattttgcatttcccgaacgctagtgtattaatccccgtcccaggaaaagccggggtacaccacacaaacatgatacaaaaggcacatctttattatatcgataatatttacattattacaaaggcacttaaggcctgacaatcaaaattaaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagccacaccggcagatgcatgattaatgcaaggggtacaaggggtaataatataggggttaagttttgcagtaaacagcatttaaaagtcacttagttgcccaaagctattttgtaaacacgatcctagagctatacaatattattaatcaaggccgtagacccacacgaacctgccttaacccaaggcctacgatgattcagaccgaactggcaacccgaccctgagtcccagctcgtcccaagccaacccaggccaaccatttcacattttagttgttaagcaggttttaagaattaaaacactaacttgggtacattgctaggcttgcccataaccgagggcgcggctatttgaatagattatactctgatcagaggtgtacatctttacccacaagacacatcttcctcacgtgtaaccacgtgccacataccaccacggcatacggccaaaagacgtgacatagttctcaacccatcctagccataaacaagagtaccgacccaaccccacctatggccggaacctccgggacaggcaggtaggattgagcccctagcagcaggacaccagccctgtgccatgacatctcgactaccgggccgcagctcgtgtagccttcatttgtcctaga

SEQ ID NO: 32435 - DNA, 1501 bp, Oryza sativa
catttcctgtgaaatatccaaagacacgattggagcaattatacaagcaattctattttgagtaaatttcataaagctcacaatgatatgtatggagcaattatacatgcaattctgttttgagaaaattgcacaaactacaggtattttaatcaaaaaatcacaaaactacatatttaaaatgtatatcacaaaactatagatttagcactaaatttatcacaaaacattaacatatttaaagccaagtataataaaccatatatttgatattgaagttatcacaaaattatagattttagagtttgaaattctagcacaattattatgttggagctattaacactgtagttttgtaactattaagattatagttttgtaactaaattgtttataaaccagtagttatatgataattttgttactgaatgtgtacttttgtgataccccattttaaatgttgagttttgtgataaactcaacgttaaatctgtagttttgtgatacaccgagttaaatatgtagttttgttatagtatttgtagctttgtgaaatttactcatctattttctataggattcaacatgccacgagatttcaatattgtgatttatctattcatgtgtttcaatattggcttggtcattcctaatatatagctctgcccagccatgttcttctcttgtagctgtactgcccaaccctgttattctcttggagatatacttgcatgggacagtctgcaaaatggttttatttgattttctaaagaaaaaacttctatacataaaatttgtgaaagaaacgtatggtcaagcagtctgaaaagctagtagccaaaacaactgacaatagtgctaggatctgactttttttagttcagttagtgcaattaattcacctgtggcgacgaggtgcaccggtagatccaacgatcctatgcgtcgttggcagtttggcactaaatcgaccccctcattcctcattccccccttggttaagggaatcttcagtagagcttcaactcaatgtagtttcaaaagttgggtttaaagtgaagctgtgaagccgtctactagttctagttcaacctctctagcttattttgtgagagtgttacacctaacttcgctcttaatttagatgaagttaaaactgtttagctgagctctagttttatcttaatcttagatcgatgagtcgctgcaactgagcatcgaccatccccagtagtcgtgatcactagcagttcctctgaccatatatcacgttctacgtccaggtcaaatcacatgcctggaaatttgcgctaacgaccgtatatgaacttcgaatttaattaatcatggcattgggcaaaagcttataaaaggcccttcagttcttgctgttcttcgtcaagctaaactgccaagtaattaaacctaatcaatcatcaagccatatatacatcctctatctatcgatcgatgatggagataaactcagaagccaccgtca

SEQ ID NO: 32436 - DNA, 1501 bp, Oryza sativa
ttcccatccaggaattgcgaatacagccctagtgtgggatgcgacataatatagtacaacaaatttggtcatactcctgtccggatttgttgtaatagattatgccctattccatattaggatgggtttttttttggacggagggagtattgttgttttgacttattataatgtcgtaatgggggagtgattctttcaaacaatacatagagagttaggttcattttaattttattattatagatctatttaattatgaagttacatatatgataataaattctatatcattatatttttaataattttgtaatgatttgaatgacatgaaaaagtcatagaatataagcccaaagtgacatacttttctttcaaaattgaattctagtgaaaatgaatctttaactgcaaaataatctaaatacacaaacaaatcaaatattagtcgtatgatttagatgtcatagttgattttttttaagtataacttttgctttctaagtaatatattccgggaacattattcatagtaatgtacattttacttttatgattttatatataatttaattattatgaagttatgtgcgatgataaaatatgtaatattattataatttaatatttttaattgtttaaatggcatacaatatcagtttagtcataaaaaaataaacatattaatggataaaaaaataattgtacaatttagatgttatagtttcttaattgtttaacaaaaaaattgcttctctaactaataaagcatggaaataggagaaggaattggtgacaaagaggaagaaggaattaagggaagacgggtgcggatgtacatcagtaaccgtatgtacacatgtacctacaggcctaggtgggccctggtttgggaggtgaattttttaatataaatataatggtggtaaataatgtgccaactaaatttaatgaaaatcaatgacaagatgttttgcctttcttctcatagtatttaggttttttttctaatttattacagtgctacgtggcggcttagtaacgtttgtaggatgtcatatggtaacttaagagtatttgtaagaaatttaatagacttttcgtatataactaggaaggtggcccgcgtgcatgtgtgggcacttatattgttaaaaggtatgatcattatttgtttaaaaattttgttttgtacattgagaggaaactatagatcggataatatacttttatcataatataacttaagggatctattttgattaaatatctaaaaaatcattcaccaacttttgaatagaagatggattaagttcatgcgagttttgaatcatcttttgcattgagtaaataataaactaccacaagctaattatcctacatatcatctatatacataccgtgcagtatagctacaagcaaatggaaagagcaactcgaatttcttgtgattaaatggtctcatgaaggcgtataatgcagtgacaaccaaattaaatgttgg

SEQ ID NO: 32437 - DNA, 1501 bp, Oryza sativa
gtcgttcgtcctcgccggctcgtcgtctcgcggcgccgcctccgtcgtcggattcgcagcggctgttccacgccgtcctcatctctgtgcagctactgctggctgccctcgtcgcctcctcgccggccccggtcgtcgtcatcgtcgtcctctcgtcgttcccggtcgtcgtggcgttcgtccctccgtcaagccattcgcgttcgtcgtccgcgttccgtcaagtgagccgctacagccccgtcatcgtctttgtcctcgtctccgcatcatcaagcctcgcgccggccgcgtctcaccttcgtccaaggatcgccgccaaagtcgttccctcaccgtccgtctccgccgcgcccgttcgtcgttgtcgttcccacgcctcgtcgcgtggtggtaagtatccctctccctcgctgctccgtcctcgtcctttcggtgtcgcctgtgcctgttgtgcggttgtcgaccccggtacccatgtaccggtgtcggtagtcgtttgtgtgtgcgtgtggtggccgtgtttgtgtgcgcgctcggtagccgcgtggtttccaagtgtgcagccctcgtggtgtctagtggagtccgtttgtcggccacttgcctcggttgacacacggggtccgcttccgtcgacccgtggactgtctctgtgtactcggtctaccatggtcccttaggttgacatgtggggtccgcatgtcaacagcgcagtcttcctgtcttttccaggctagcgcttacacatgttttatagttgtaaaacctaattacaataatccgcaaatctccatataacagcattaaacttcggatgaccatgtcttggtcatacgagctccgaatcgaaccgttcaagtctcctaatgtttgttataacctaaagaaccatgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttgagcatattgaatcccagtttataaaattattttgatttaaattaatgcattatcgctttatttaaaattcccgcgttatcactgttttatttagccatgcctatttatctttgttatgaccttatcattgttgttattgttattattaccttgttcaccctaggataaacaaaaccccaactagtgggtactctattcatggttccactagtatgaatttaggtagatgcttcgctgattaattaggcaacattagatggttttataactttagactttgggaattctcatatcatttggacactatggaatggttggcttatgttggaattggacacacacctccccctctattcaaaacccccaaaatagttttaggctgggctcgaggtgcgtggttgggttttgttagtcgtacctcgggtactataaggattaa

SEQ ID NO: 32438 - DNA, 1501 bp, Oryza sativa
ccgcttccgtcgacccgtggactgtctctgtgtactcggtctaccatggtcccttaggttgacatgtggggtccgcatgtcaacagcgcagtcttcctgtcttttccaggctagcgcttacacatgttttatagttgtaaaacctaattacaataatccgcaaatctccatataacagcattaaacttcggatgaccatgtcttggtcatacgagctccgaatcgaaccgttcaagtctcctaatgtttgttataacctaaagaaccatgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttgagcatattgaatcccagtttataaaattattttgatttaaattaatgcattatcgctttatttaaaattcccgcgttatcactgttttatttagccatgcctatttatctttgttatgaccttatcattgttgttattgttattattaccttgttcaccctaggataaacaaaaccccaactagtgggtactctattcatggttccactagtatgaatttaggtagatgcttcgctgattaattaggcaacattagatggttttataactttagactttgggaattctcatatcatttggacactatggaatggttggcttatgttggaattggacacacacctccccctctattcaaaacccccaaaatagttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctacctgcctgtcccggaggttccggccataggtggggttgggtcggtactcttgtttatggctaggatgggttgagaactatgtcacgtcttttggccgtatgccgtggtggtatgtggcacgtggttacacgtgaggaagatgtgtcttgtgggtaaagatgtacacctctgatcagagtataatctattcaaatagccgcgccctcggttatgggcaagcctagcaatgtacccaagttagtgttttaattcttaaaacctgcttaacaactaaaatgtgaaatggttggcctgggttggcttgggacgagctgggactcagggtcgggttgccagttcggtctgaatcatcgtaggccttgggttaaggcaggttcgtgtgggtctacggccttgattaat

SEQ ID NO: 32439 - DNA, 1501 bp, Oryza sativa
agagctggagagccagagagctcttattctaaaaaccctcttctcctttttttttctctcctgggatctcctctccagatcctccccccttccagcctcccctcttaagtgggcaaggtcctccttttatatctcaaggggataccacatgcaccacttctccctctctccttttttgggtgggggcccatcctatctatagtaaaacttggcttgccttcttttggaagctgaaacactgcctgtttttgagtgtggccacgcgtcctcgttcgtctgacctcggggatcaccctgtcatctcttcataaatgggcggagatttgtaacggctgctgcccgagtgacccttctgatgggacggcccatacctacctccactccgccggaagcaggtgcaacgtgggaacacggttgtcttccggcgacataaccagtgtcagaccagtcacagaccggtcacctttgtccaccacatgtcagtttagcaatctgcatgttcgcccttcttcatacaacgtcttgcttataaaggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgccacctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgaccccctccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcacgatatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtca

SEQ ID NO: 32440 - DNA, 1501 bp, Oryza sativa
gccaagtgtaatacacgtcccggtgctcaataaccgcgagcacggctattcgaatagatttggtttactcacactgtagtggatgtacactttacccgcactccgcgactgctcaacgcatgagcctcgtcccaacacatgagacgcgtcacggcaaagcttttcgataacctcgcattggcagtacctgctccatgaactttacatcctcatgcactctaggcgtacacggtttctagcagtgagaggagttctggcgcacccgggaagggaaaaacacacacattcctacgttgcttcttgtcgttgaacccagtccatcatgattgttctcttatgggtatcctcatgtagtattgccaagccagcctctgaccatccagaacgggcatccgccatctacctggccacctgaaccgggcatccgccagcagactgcttgccgcatcacacacctagagaaaaccactatgcatggatactgcctccgcgcagctatctactccgctaggtctatacccatacgagaagtgcggttgtacgggggtcgtttcatgcttaacttcatggctctgtccttaactgaccacggacggcactagccttttccggacaccacccaaatcctccagccgccctagtcgaaaatagttgtttcactttattttcctttcacaaatcatgtcatcaatatcatggcaatgtggcgctcatgtctccacatgcagcatctcaattaccttcccaaggtaattgcccaagcataaagcattttgatatatatgagtatgcatgattctagagtagcatttctaagcatttgtcatagttgactagggactcatacgtaatcatggttacaagggaataagggtaaacaataatcaaggcatggcatattcacaattaggatgttcatcattgcatgcaattttatttgtaaacaaaaataatttcgcaattgggatcaacatgttcaagaaatagtgatgacttgcctgctcagaatagtccttattcttgatacaatcttgatcaaccttcacctcctgtaagttgcagacgttgcctcacgactaaccgatacacaaggtctataatacgcgagaaaaaccaatattcaaacaacaatcaaatatgcacaacaaaatgtactattcgtgtttgctaatggattccaatcatgctaagggctaaagtttcttaatctttctattgtcatcgtggtctatttaggagttaaccaacttagcgtttatgatatacatatatatttggctaatcggtggtttagtctatcaaatggctatggaaggattatggctatatatgtatctatctaaatagcacgatttcataccagaggttctgttgttagatggatttaggatcaatcaaataatgaatcatttgtattattattttattgatggaggcgttactttgattatgaacatattttacttgtcacaataaattacaaaaggttaataattatcca

SEQ ID NO: 32441 - DNA, 1501 bp, Oryza sativa
gtcagcagcactgtttctactgtttctcctgaaccgtttatcggaatcgaacgaaaccagcggcgttggaaagataacagtgaataccacaaatcttatttaggtcaccaaacttgaatctctacgaataattaccagatttaaaaataagttttctgcctagcggccggtaaaataaattcgagctaccggaaacggatcgtcttataaataaattagaaacaaaactagggattaaaacggattatctagcagtactaatttgtaggcaaaacaaagaatttagaaatatccaccaaattccccaaatttgtccttctctccttcctgttcttctcttcttccctggtgcagcaacaagcagaagcaaacagagcagcagcctagttcagatcggtagcagcaagacctcaccgggaagaagagaaatggaaaggattcaccggtggcgacggaagatgatggttgtggtggccgccacggctgtagcggcggcggcgtagaagcggcgccgttgacaaggagcagcagcggcgacacaagcgcagggacggaggcggcttgggctagcgttactttttttttctcttttttttctgttgattaaatagagatgctaataaagatcgaacggcccacattaaatcgatccccgggacttcgttcggactccgattactataaacttacagtatattttgcactactcagcgagctctacgcatccacggtttcggatcgcctattcgagcaacggtttaaaagttaaacttttgcacatttattttaatatttcccaaaatacactaatttgaatctcggggtattacatcagagtaggaatcaaaaaggctacaattggtgaggaattcattttgatacacttggagagactgagtgaatcatttgaggaactcggctttcttttgcaaaatcatttgaaaacttccggaataagagataaataaagattgggtgattggtgctctaattactgttctgtctttcaaccgctcaaggcaagaaaaagcagtgtctcgtgggaatcaggggtaagggtaagccaccgtgccaaagattatttaatatgagagagagtacatataccttgcacctgtatctttgagatatgcagcatagtagcaactcatgatcaacaaccaagtctttgtttcctttcgtccttcactcgggaagagcaaaggttcaagcttggggggttttattgacggtcgttatcgatcagtttcgaccgtcaatattactaaaatagaggagaactagtgatgcttgcaatgcatatatctgttagaataataatattccactagtattaggtatactaaccttttgcagagaatggaggagaatcgacattaactcagatgataaatcaattgtatgatgtcgagaaccagacttatgtataaatgggccaagaactcagaattgacacgatgaattgggccaaaattcacaagtttacaaagtgaagcaatag

SEQ ID NO: 32442 - DNA, 1501 bp, Oryza sativa
tcttctttgggcctaccgtgtttccttcatatgggccttggcctgcaaacttgtctgcctatgcttccagcttgtttaagctcgtgagcgtctcgcgagccggctcaagctggctcgttagctcggctcgtttcaaaaagatatcgaaccgagttggccacgagccgagcgagctaacgagccacgagtttttcgtccagccatacacacgaggcactcatcaagaatagaacagtcatttttgtaatcctggaagcaggaagctggaagattcatcggcaaacagaaatcctggaaagctcaatcaacttcaaccaccagagcagtgcagtgcaccatacagactaaaagcgaaggaaagaaaattctaatgactgaacaatttcactgaggcaaactgtttgcgattcatggagatggattcgatctaatcgataacgcagcttcttccaacccaaagattttcctcgcggcaggtcgggagcgcgaatttgactccaatttccggctgtcatgagcttgatgcggcttgacgccgcagggcgcgggcgcgcggcgctcgccgcacggtgctcgggcttgaccttgacgcctcgccgaggatacgaagataaatgggaattggagagacgagggagagagaggctattttgagattcgtgcgggacaggtgtcgtgtagaggaataaagtccttccgatgagggtaggacttcagtccttggcaattttcttccaacttcagagctaaggtcgtgtttagtttaccctcgactaccccaaacttccaactttccatcacatcacgtcacatccaaaactttcctacacacataaactctcaactttttttcaaactaccaactttcctcaaactttcaacttttttcaggaactaaacacaacctgagaaagaaaggacggggtatgtcacctcaaaaaattcttttgcaggaatttttcctagggattttctcccccttccttccaaaggagccctttaggccatcctcaatccaaaaattatcaagaaattattaagtaattttcatacttatcatgttcactatgcatagaaaccatgtatacaatgaatggtgtcttcaaattaaattcttatccattcatctctctccttttattcacaaggttcttgtgtagaaatagtttcttgcatgagaaatgatttcttcatttttttttacctctcttctcgttaattcttttaccacataagatttttttttacttatgtgataatgtattttaatgctatcgacattggatgatacggagggttgggaatgaccatatgttttttcatctaaggccttgtttagatttaaacttttttcttcaaacttccaatttttccgtcacatcgaacttccctacacacacaaactttcatttttttcattacattgttccaattccttcaaatttctaattttggtgtggaactaaacacagcataagggtcgattttgaataggatctat

SEQ ID NO: 32443 - DNA, 678 bp, Oryza sativa
gtctccgtctcaaataagccaaaacgtttctccaacctagctcctggattatggattaacactgtatagctcatgactttagaaaagccaaacaaaaaagatcataagctaagcttataagcctaaacaaaagagggtctactatggtccttgaacttttgcttcgggatgaatttacccctgacgtgagctagtttccaaagaactccatataaaatttgttatatactccgtactagctttctattggttcctggatcgacctaaagcgtcatatggactttggcatgctatccttatatgcaagatcaatattaatatgttaattttacccttatatgtagcacagagaaacagaaagaaaaatcaaaggcaaaggcaaaccagaaaaaaattacggatcagactgatcatgtacgtatgctttggttggatgcataaataaaatagtcactctctacagattgataatacttatcatttttgaacaatccaaattgataatacttatcattttgattgtcaaactttaaaactttgactataattacatctaaaatatttgtataaattggtcttaaaaatattttgataaaatcatatatttattgatatttccatatatattataataaaaagtcatactcacaattgtttttaaagatggtgtatctattc

SEQ ID NO: 32444 - DNA, 1501 bp, Oryza sativa
cgaaaacaagaaaggaaatgcagacagacaaatccactcatcagatgatctgatcaagcttaggttgcattattgctgatatatagcacactttgtcctagtaaataactcatgaaatatctccacagatttgtcatggttgtcatctacaattttcaagactaatctaacagcttaatttgtctgttcgatctggggaccagagttttcactaaaaatcaaaccctgacagaacaaaacgcattgtcttgttcagtgctagtcaggttaaggtggtgtttagatctagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaatttttaaacatccgatgtgatagggacttaaaagttttcactacgccagatcctcacacctctgacgggatacctgtgacgggcaaacgatttggtcactagtgaccattacctctgacgggtcagacgggataacgtcaccggtgagccatccggccgcggaccgtcacaggtatcccctcacctgtgacgggccgaaaggaaaacccgtcagaggtataccagtgacgagttttgcttccaacccgtcactggtatcccctcacctgtgacgggccgatacattagaagccgtcagaggtgatgggccgccacctgtgatggctttcatttctggcccgtcacaggtgagcggataccagtgacgggccgttgaatagaagcccgtcaaaggtatgagcaatacctttgacgggctttttaaattttgacccgtcagtgatgagtgaaaattcaaatttttaaattttgcaaaaaacctcggattgaaacatgtcctatataaaagttgtagctctcaatgatatccacaactttataactaacaacatttctattagagatcgtttacatccccgaacatacattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagataagcatagacaaaataataacattgggttagtagtcaatatgt

SEQ ID NO: 32445 - DNA, 718 bp, Oryza sativa
taaatgtgttatggtctcagcggtgtattcacgggtacctaaatatagggcatatgtgtcttccatataatctgaaaagaagctacatgctagctcatctcgcttgctgttaaattgtgtttacagatattattatgtacacgcagctgagcttttaataaaaatttagtgagaccaggatttgtcgttggtttttatcttcatgagtatgtgttacagtatatatatatgtggatcagtggatgtgtgagggtagtagtgtttgtgtgtacgtgtcttctgtgtaatcgagaaagaaaagatatacgctagttcagtgcacctgctgattacacttagctgtaccgcagattcccttgttcttggacgactttaaaagcctcgaagatctttcaggccacgagctgttgatacgtttgctcaagattctttcgtgtataacaaggtcagatgtggtatagtttagtccatgtccgagttgtgttcttggcgttaagtctacttaggccctgtttagatgggactaaacactacgccggaccaggtcatctctgacgggcccaaaccctcacctttgacgggtttggtcttggtcagtgattagtggtcactgatgacaaaatcacctgtgacggatgaaacacccgtcacagataacccatctctgaccggtatataagtcatctctgacgggttaaaacttgtcacccgtcacaga

SEQ ID NO: 32446 - DNA, 319 bp, Oryza sativa
atagccgtgcccgtggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatcccttttgcacgtctgcatcattggtgtggcttgctgagtacggtggttgtactcagccttgctattattcccccttttcaga

SEQ ID NO: 32447 - DNA, 1501 bp, Oryza sativa
gtctggttctatatttttttatttgtttggaggtaatgtgatgttttgagataggctctaaatttgcttgtaatacggatgattatcactaatcactgtgaagccatcctactgttctggttagtagttattgagaaatatataacatttgtcttgatcctcgagaatacccaacttcttaaagagaaatatatctatatatatatctatactaatataaaaagaggagttgccccctccaatgctacatgccaagtcatccggactaaacgcgtccatccgcgcgcttctcttcctccaccgcactatttcacagccgaggattccacgcgcgaagacatcgctcctccacccgcagccgcggagaccgcgcgcttctcttcctcgctcactcctcccagcgtcctcgcaggagcgactccccactgccgccgcagccatcctcctcgctcgctcctccttctccccgctgctgccgctacgccgcgccctagccggagccgccgcggccgtcctccttcttccccaccgccgcgccccgctcttccccacctccttcttcccagatcgtgcttctcccactcggatcagccgccgccggagccgactttggccccttctccgccgccggaaccaacatcgacctcagcccgcggccgtccttcttcttccccaccgccgcggctgtcctcctcacgggcttctcctctgccccgctgccggcgctacgccgcgtcctcgccggagccgccgccgtatcgttcttctcccactcggacccgtacgaatctccgtcctccaccttcgccgctcgcccctctctctctctcttcgcccgcgactccatcccctccctagccgctgccctcacggcctcgccatcgccaatccctccatgccttctcgggctcatggtggaggggcaggggctgccttcggtggagagttacagccgatcccccatcaacagcgcccgcgagtgaggatcaagccgccgttatcgagccaaatcaggcggacaagctgagctgacggtgtatacgggaggtagagatggacaccagcgacggcggtgcgttcgataagtgaccttgatagcatgtggcgggagaggatcggcggtggcgcctgagatgtcgacagggaacatgcttgcagatctcttttccatcaatggctaccacgagggtcttcccatggtgcttgcccacattgccacctacgccgcgcttgctcttcccccaactgtcgacgcccggcaccatagccgccgaggccaagaagatctggaccatctggtcatctttggcgccatgaatccggccacttccgccaacggggctgctgccatcatcgacccgccgtctagcacggttcaatgggcatcatcacacgcctatgcttcatgtccttctttactagcaggttaaaaaatccttaaggatttatttgctaatcatctttacctaatacatatctggtataattcttcgttgccttg

SEQ ID NO: 32448 - DNA, 1501 bp, Oryza sativa
ggctatctaatcaccaactgttccttcaacaattgcgttgtgaccttgttaatatagcgttggaagattgcacaattaagctagtgacgacaaaaaagcttgggagatgcgtgcacgcgaccagcgagtggatctgtggatgtcaaacttttctgtcgtctaaaagtccccttttgcgtgattgtcaaacagtaaatcttctgttcttactttacccttttccttatttttctcaataacaacagagatgtacttgcacaggatatatcttaacggagtagggcatgttaggttactgtagtagacgttactcctatatgttaggatagagagaattgttaaatcttttctagtttcattgtggtttgtgccgcgctgcacacttgcaccggtgtgatcaacttgatttagatggaggctaactttgccacacaaatgtgactaacaattttttgaccataactatagtaaacattggttaaaaaataagagtatgaggtatagaccaatgtattaataaagtatggatttgctcaacaccatgccactcaaccaaatactagcataagaaaatgtggcaaacctaagatttagtgtggcgaactcgccaaccaaacaaccccaacattttccggtatctaaggaggatggactgagcttctactcactactagaattaatccctagaaccaaaaacccaagggaatggcgcaaaaactctagagtgaaccctagggaatgccctctagggaagcctagtcgatttggatagcaactagaacaaagagggattttgggggagattggagaacgaaacaacaacaaatttggggaggagaaacccttgtgctgttgtttaggggagttgggggggggggggggagaagatatttttgtctactatattgcccttcccgcaaaaaaaaatcgttgctgggagttttgcctccaaaattttatatgggatctactttggttgtcactgtggcgccaagaatttcactatagagcttatgtggtataagttctctaggttgcatattgttactctagagaacataaatcttccctttagttctccatagtcaccctagggattcttattatcccttgagttctaatttagactctagggaagttattgaattctagtagtgagtggcagattggtagctcggagattacagttcgcgatggacaaccaattcaataaacatgtttaggttgctttgagcagagaaatctaattagatttttttttacattttggcgtggtttatagaaaaccgaagcttttaaaaactaagttgatgagaatatggagaagctctagttccttgcgtcaatgaaagtataaccaccattttcacacttttccatatttaaaatattataaccactgaatcttagaatcacgacatctttttcagataatccaccaaattattacagtagattatttgctccacgtctttaaaactacgttttctgaaaaatattt

SEQ ID NO: 32449 - DNA, 1501 bp, Oryza sativa
gttttaaattatgatgatatataaaagttttaaataatcataattttacaaacaaagattataacatcgtataactctttgtaaatagaggtaactaaattagctctataatgtttggaaataaaattacaccactatatttttacccattaaactaataatataagatgattttcagttttcctgttaaaccggtggactcattactttgaattattattttaaataatgcaccattttaaagtaaagtttgcactattatatcattatattatttaaccattaaattaacaatttaagatctacataactaatttacatttacacttaaactaatggacccattatttaaactatcatatctatgttttcattaataaacaaagccttcgaagttccttctctagcctgctacacaacacatgtctacaactctaccttccacacgagcgacgaagtgtcgtatctaaggcagttaaggtgatcacgatagctgcaacactaccactttgccacataccaaataaaatatggataacgattagttttgttagtaacttggaaccaaattaaaggtgtgatgcagaaagagaagaagtaaccatcgtgggttatgtttttctaacacttggctccgtttaagctgaaacaaagagcatacgggttataatgtattgtatgaggtcgtatttagatttcatccatacagcccaaagaaattactatttctccatgcaggcgaaagaaattattatattataaatgtgagcataatattaaccaatatcaatacacttcttcctaagacaagagtgttataagcgaatttaaggctctttttttccctgattccgtattttggattttcatttgcatggttcccaagttcctaaatggtggcatgatgtggctcttgtgcaaagagtttttctttgagtatgaatagtgacaaagatagaagtaagaatgagaatatgaatatgtagcaaaaaacaaattaggtgaaccaatgttttttaagtagtcatggtttgttttgcgaagtttgattaactctgaagatgtaaatcatattgaacttattgatcataatttacaacaaaatggtattcttggtgtcggtgatatgggaccgggagtatcgtgaccagaggcttgaggcagacacaatcgcccacgtggcctggcaccttcggggacgacgggcccgagggtgaggtgtccgccctcctcctgatttccccgagggggggggggtcgggtgactcctgccccggccccgagggccgaggcgccccgaccccttgtggagttagcgccacatgaatgggttgggtgaacatggtaagcctcacttaactacatttattgcggtctggtcgaacgtgtcacgctgcatgcagcgtagtgcagtgcgttcctttatccggtccgtgaccagtcacagaccggtcagatcacgggttaggtggcgactggcggtctgacgcacgccttgccc

SEQ ID NO: 32450 - DNA, 675 bp, Oryza sativa
agcgcgtcaaggtggaggaaagggcttcggaagtaattactatcaaagtggggttccatgatgtgcctataccttctggagatggagttggaaagtccccaagcaaaaaatccgaagccggtaccagctcttcgcagtcggccggtctgaccaggccctctagccggtctgaccgcggccatgttgccggtatgaccgggccattaggccggtctgaccgtcgacccgacagtgatccgaccgacgcctcaggccggtctaaccgcgtgccacacgtcggtctgaccggcgcgtctggccggtctgaccggtggtctatggccagtctgactgggctccagcgccggtttgatgagaggattgcaaagggcaatgtgagggcttcatcgtcttcaagcaaagttaataaaggacattatctacctcctggaacagagccgaatcctaggtagatgcctaaggatttgacggctacacaaaagagaaggttgcaacgtcttcgggcccaagagctaagggagaaaaaggccgaagaacatagggataaaaggttcaatgagttgcgaccaccaccggtatggaggcctaaatccatagagaaggcaaaaccgattgatgtagaggagaaggaagaacaatcagttgataaaagtgaattatctccaaaagaagaca

SEQ ID NO: 32451 - DNA, 1501 bp, Oryza sativa
agaaagctcctccagctgccgcgtccaggtgatcgcgggacatcggggtgagtccattataaaagttctacaggatcagccagttgtccatcccatgatgaggacaggcggccacatactcctacatacattcccatgcttccggaatagactcattccttgtctgctggaaacttgaaatccttccacgaagggcattggttttgcccatcgggaagaatttcgagaggaatgccatagagcatttgtcccaggtattgacagcaacacggttggcatagaaccactgcttcgctctcccaagaagggagaacggaaacagccgcagcctggcggtgtcgggactgacgcccttgatggtgtacgtgctacagatctccaagaattgtaacagatgagcattggcatcctcattaggcttgccacagaatgggctaagcctgcgccatcgtgatgaggctggacttcaagtcgaaatccacacctaccatgttgatctgcagcccaatggccacattgtcagcagagggagcagcgaactcgcggagagtcttgttagccatagtcttgaaggtcggtggcgctggtatggctggtttctttgtcggtagagttttctgcggaccaacgactcgcggcctgacgctccagaagaaagcttctggattttctttgaagttttccggcaagttgaaaccagtcatgcactaccctgttttcacaacaaaaagtgaaaacaaccaaggttagcctgcaaaggaaaatgattatacagagataaatataaagtattagttcaagtaatctctattatgaatcttccctggcaacggcgccagaaatgtttgttggtatttcttaacgacattactagaaatataattcccagcaatgacgcataaatacttctggtatattatggttacagagttcatccgcaagtgcacggatataccattgtagcatttcacccgagagtattccaagggtatcgtatttattttatcccgtgggaagatcatgtagagagaacttgactaataatttatatattacttgtgataatcatattctaagcaggggttaaaaataatccaagggtagagtgacacacaagcattaactactcattctcataatatattatctaagctaattgggaagaacagagaaagataatctattcctatacttctaacatacatagtgtttacacccaaatttggcacctaggattaaaataggaaagattgccaaaatttggaagtctaccggtttcctccgagtgggccggtctgaccgctgtgtgttgggcggtcagaccgccggttgagggccggtcagaccggcggtgtgtggccggtctaactggcaggaccgagtccgattctgtttcgtcgggtctcgaggtttccttgctcgggaaggcatgtttcgggtttcctttggcttctatcccgagttggacgtggaggagggcctgtagagggcaagaccaacc

SEQ ID NO: 32452 - DNA, 1501 bp, Oryza sativa
tatgaccggtggtgcgccttcactggagcttcatcacttcggtttgtccctggcaatagtagtacttaaaaaaatcttgacaagaacttttaagttactgaatgttgacaagaatttttaagttactgaatgttgagaggattttaagtttctgaatcttgacaagaattgaagttactgaatgtttgacaagaatttaagttggcttcccagctgattaacatttttgagttactgaatatgtgcagccgatctgtacaacgcgaagcaccctctgtccctgtgcaccgatgattccggcctcttttcaacgagcctctcaaatgagtactacctcgttgcatctaccttcggtatgcgctctccttgaaaaaagatctgcaaatagtctgacaattgttgttgttgtgtgtgtgtacagtactctgaactctgaatgcaaaatccaaaatgtggcaggtctcagcaaggctgagctgtttcaactagctcaggacgcggtggagttcgtgttcgccggcgacgagttgaagaggtctctgagagagttgttcgagcgcgtcgggaaggagctgacgacgtagggtaatccaagatgcgttcctgtcgatcggcgtcggaacaaataaatgtatttattatccatgtggtctcgattgtgattttagattttccatcgtttctgcgtttatgttcccacgggcgtgtccagtttaagagtacaagcggccgacccgagaatccacctatatggtgggtttggataatgggaaataagggtgggattggaattagaaaataaatgaagggttaggattaaatggaagagggagaatgaatggttaggatttaaaatgggtgggaaatcatttccctttcccatttgccaaacactaccataatgtaacggaaataagtgggtaatctaaaaaaatggattacccatttattcgtactatgggtggattcgtgggccggcccttgcacccagtccagtcccttctcccgcttgcaaatcccggcgccggggatgcgagcacggtggagatctccggggagagtcgccaccgcgcgcctcgccggcgaggacagagaaaaggcgtgggccttcagttgggccggaatgggatgggattgcggccttcaagcggcctgttatgtatataggccggaacgggattgcagctacgtgcggcccgtttaagtcggccgggggagaatgaattcgaccggaaatgagtggaagttgacattgatttgaagtttgtatttgattgaattgaaacattgagctggaattttaaaactacacaaaacaaaggatggagtctttaaacgcttccgctactaatgtcgcacaaggcggtaatgatttttcagaagagtagcgcaagcaagttccttgaagaaactgtttgcaaaaatacaagtcttgtttcgatcaaaagcttcaggaactctatcgtagcaacctcataaggccacacctcagatctcatgt

SEQ ID NO: 32453 - DNA, 1501 bp, Oryza sativa
tttaacgacgcctccgccttgtgatccgcgagcggcccgatgacgtctatcagagggagagcttgcgtacatgaaggcacaatgcgatccaaggaaagaagaagtaaaggagccatcgagtacactcatgttgattgcagcttcgcactcggtcgtccccttcttgcaaaggggaacggggacgttgctcaccgtcgtagggccgctgactgacgcggcgctccacggttttgctgttcaaacctgtaggatcgagaaccagaactcgataagtcagcaggaacatgcacataaaaaatgaaatctgaaatacaagaaaaataccccgagaagaaacccgggtcgcgtcctccggcccagaatagtcaaaggctgggtgggctcgagcctggagcggctggatctgcctaccgatgaagttgacagcaacttcataccccgacaactctcgtactcggaggtcatcgatgatatcgatgaaagacttaagggagggagttagggcgggtttggcggtccattccggaatcttgtctggttgttcctcatggacaacaaagactggatccgaattttctatctgaagatagaaccacatcgctcgccattttctacgagaagaagggcactggaaggggatgtatcacgacttcaggccatcctgaagttagaaaccgacacatccagatacctttttaggttccatccagcgcaactcatagtagaagtaaaagagatcaagaaatggctctaccccaatgtagggcccacaaagataggaaaaaatgctaagaaatgcgatagaattggggttcagatgaagcaaggaaaggccgtagaaattcaagacaagaagaagaaactcagaaggcggaggaagaaaaccgcaaagaatgtaatcctcaaccgcaaccatgtggcctaggacaggtttggggtcagtacctcctgtttccctctgcatggtcccacgaccagggagggcaccgtcgtcctgcagcttcttcagggacgcattggtggatgtggatttgtcgaggtccatcactgccggaagatcgccggagaacaggacaagatgggaaagctagggcttttctacggaagcggagaagacgaggggcgtttgaaggccggaaagttttgcagcaaacggacttcaaaatggatccccaaaactcccgtaaataagcgcactaccgatggtgcgaattccaaggaaaggagagagatggccgccagaagtttctgggtccgttacccgcagcagtttttggacttcaatttaaattcactcatgaccgttgaacttcatgcaatgttatcgataactctacgtctctacggttctcataccaagatcgaccagttgagagcgataatgattccgagatcagaagtcgcgatcggtcacatgagttcatttaagcagaagtcgggggctactttcagggttacagaggtataccctctacccttggatgtatgttgtatattgata

SEQ ID NO: 32454 - DNA, 177 bp, Oryza sativa
ctcaccaccttgcctcttatatttctccaagagcatagtaaaaatcaccttggtcttcctaggggccttagaagttgaagctccacttttgttctccttccaaacgccaacctccggcttctttggcactatcatcttaggcctcggctcaccaatgaccacttccttttccttagt

SEQ ID NO: 32455 - DNA, 1501 bp, Oryza sativa
aaggatccatgttaagattgcaagtgctgtgagttatgtacgttttgttgatgattaaggagacctagggtctcatttccgtgagctcctactctattatgaatcaaataacctagttgtagatagaaaagaaaatcaagtgatcaaccaaagagatatttgtttggactaagagtttcatatgtgtctttttctgatcaaaggcaacgacagtcagtatagcttttgacgaactacttcaaggtttctccgaaaggcagcagggcccaaggacctcattgccccagaagcacccacaacacccggagcgaagagtacctggttgagaaaggtcaaaaggtgattgatggaagagatcggaaaatatgtttggttactgggaaaagaagtaggtcgaaaggtgattgataaaggataacgagaaacatgatttgtgtcactcgaggaagactcccgatagcaatcgaccctacaacagtcaccctgtcattaaggtagaagaatttgcgagtaagcaagatgaccacaggtagaagtacttctatgaggacaaggaagtcaagaagttaacctaaacagttggaatctaaagctcggttcaaccttcagctctatgtccgttagtcgagatgtcatggcactggattagtacgcgggtggtctcacccctatgtgtgtggcgcacccggtctaggtcctgttgctaggggctcaatcctggccctgcctgtccgggatactggccgtaggcagggttgggtcggtacttttgttcacggctaggatgggtgaagggttatgtcacatgtttacgacaggttccaaggccatggaatgcggagtaaagatgtgtctttgggtaaagatgcacacctctgatcagagtaaatctattcgaatagccgcgctctcggttatgggcaagcctagcaatgttcccaagttagtggtttaattcttaaaacttgcttaacaactaaaatgtggaatggttggcttgggttgacatgggacgagctgggacccaggtcgggttactagtttggtctgaatcatcgtaggcctttggttaaggcaggttcgtgtgggttcacagccttgattaataatattgtgtagctctaggatcgtgtttacaaaatagctttgagcaactaagtgtcttttaaatgctgtttactgcaaaacataacccctattattaccccttgtacccccttgcattaatcatgcatctcccggtgtggcttgctgagtacggtggttgtactcattcttgctctatctttcccccccttcagtaagagaagatttggagaagaagtcctaggtggagtcctggcttataccccagttgagcacttgtgaagatggaaccgtagaaccgctagtccactgctgtttattgttgattgtcaggcctgaagtgcctttgtaataatgtaaatattatcgatataataaagatgtgtcttttatatcatgtttgtgtggtgtaccc

SEQ ID NO: 32456 - DNA, 1501 bp, Oryza sativa
gggagcgagcttgggacgtggcccgggcttgatgatcacgccttgacgagtcctagtagttgctctcatcaacgcctcccgtgtgagctcgttgatgtactcctccatagctttacgatcttctccttcgaagtcatccgatgtgaccggcatcacattagatggctccacctccgtcttggatggcggcttcgtcatggcgaagtcgaagttgagttgacgatgaacggatctcctccccagcggagtagccaaaaatcgtgttggcaactttttgtgacaagttggcaagcacgatcgcagcaccttatgccttgcggtgatcctagagtcgccaaccacttagatgggttttgataactaaaccggctagcggagccgatttctagataactacccgtctcgtgggcaaaacggaaggttttcaggacaaacctacaaagaggtgttgcactctcgcagcggcggcgggcggtttacggcgcaaaccgacaaagatggacaaactaagagaaaactaaaagcaatatgaaaaacgattcgattgattgatagtagattggtcttttacaatgaaccggccatgtcccttatataggggttggtcttgccctctacaggccctcctccacgtccaactcgggatagaagccaaaggaaacccgaaacatgccttcccgagcaaggaaacctcgagacccgacgaaacagaatcggactcggtcctgccagttagaccggccacacaccgccggtctgaccggccctcaaccggcggtctgaccgcccaacacacagcggtcagaccggcccactcggaggaaaccggtagacttccaaattttggcaatctttcctattttaatcctaggtgccaaatttgggtgtaaacactatgtatgttagaagtataggaatagattatctttctctgttcttcccaattagcttagataatatattatgagaatgagtagttaatgcttgtgtgtcactctacccttggattatttttaacccctgcttagaatatgattatcacaagtaatatataaattattagtcaagttctctctacatgatcttcccacgggataaaataaatacgatacccttggaatactctcgggtgaaatgctacaatggtatatccgtgcacttgcggatgaactctgtaaccataatataccagaagtatttatgcgtcattgctgggaattatatttctagtaatgtcgttaagaaataccaacaaacatttctggcgccgttgccagggaagattcataatagagattacttgaactaatactttatatttatctctgtataatcattttcctttgcaggctaaccttggttgttttcactttttgttgtgaaaacagggtagtgcatgactggtttcaacttgccggaaaacttcaaagaaaatccagaagctttcttctggagcgtcaggccgcgagtcgttggtccgcagaaaactctaccgacaaag

SEQ ID NO: 32457 - DNA, 1501 bp, Oryza sativa
caccacctgaactaaccagttccattaagctaatctaggggtgattctaatcacggtgaatttggtcgaccgcacataaccgcggccacaactattcaaatagtttttactctgatcagaggtgtacaactgtacccacaagacacaaccccacgacacgtcgtgtcatgcccagaaattcactagtaatttctgaagttatttgtgcataaaatcctcgtccaggaatcagccgaggtacacaaactgacaatttaatatacaagtccatcaaaataataacattgcatacttacaaaagaaaagaaaaacagcagtggattaatggtctagcgaagctccggctccactcccacaggaagctcaacttgggtataagccaaacgtcctcttctttgcgacttctcttcaactgaggtttgattgattattgcaaggtgagtacatggaatactccgcaagccacacagcaaatatgcaagtgcacaaggataccgaaggatggcataatataggctcatttggaaaactagcattaagcaaacatttaagagtagtaaaacagtagagtaattaatcatcaatattaatcaacactgaacagcacacccatgctgcttaggcccaaccatcctgaacaaacatacccggctgtacagatctaactccaaaccaggagctaagcaaattattaccagttatagcatcaataattattgtgagaggtgtgagactaatcacgaaaaatattgctcaacccgccatttaccgcgggcacggctattcgaatagttttactatggccagaggtgtcacgtcctgataaattcatctcgaaataaaaatcattctctaaaaggaataatagaattaattaaaactcgaaaagaaattggcaaccttaaaaagcaaacaagaaaaattcgaatgtggcccggagaatttttgttaaattctccttggtcaaaaaggagccctcaaattttacttgaattttcagaacaccggaaataactataagcaacaacaacctttatcaaagtttattaaaaagaaaactaaaaataatcctccttccgcctttgggccgagttcatcccaaagtctttctctcctccctccattttccctcctctctcgggcctcctctccccccccccggcccatctccctccccctcccttctttctcccgggccgcacttctctcctctccttcccgtcccactccctcctctcctcctcccgcctaggcctgccccggcccaagccgagccgcagccctcccgcgcacgcgcgccgcacgcgcgctgaccgcgcggactggtgggtcccacccacccggtcgtcgtcctcctcccgcccggctcctccttctcccatgaaaccctatcaatttcctccctcaaatctgcgcgaatcaattcccttctttccaaattgattagggggaattaatcccatttccttcctcttcaatcccccctaatttccaccttgaa

SEQ ID NO: 32458 - DNA, 1501 bp, Oryza sativa
cggtgagattcgatgccttaggccctcccggggggtcccttttataccgcgggtcagttgatctccaagtagaacttggagatatcggaccccacgcgatacagtaacgacccagttctgtccgagtaggactccttccatccgtggactctgtttctgttacgtgatggatttccttaacgtgtacgcaacatccgtatacgcgcaggtataccgtatcaatatacaacatacatccaagggtagagggtatacctctgtaaccctgaaagtagcccccgacttctgcttaaatgaactcatgtgaccgatcgcgacttctgatctcggaatcattatcgctctcaactggtcgatcttggtatgagaaccgtagagacgtagagttatcgataacattgcatgaagttcaacggtcatgagtgaatttaaattgaagtccaaaaactgctgcgggtaacggacccagaaacttctggcggccatctctctcctttccttggaattcgcaccatcggtagtgcgcttatttacgggagttttggggatccattttgaagtccgtttgctgcaaaactttccggccttcaaacgcccctcgtcttctccgcttccgtagaaaagccctagctttcccatcttgtcctgttctccggcgatcttccggcagtgatggacctcgacaaatccacatccaccaatgcgtccctgaagaagctgcaggacgacggtgccctccctggtcgtgggaccatgcagagggaaacaggaggtactgaccccaaacctgtcctaggccacatggttgcggttgaggattacattctttgcggttttcttcctccgccttctgagtttcttcttcttgtcttgaatttctacggcctttccttgcttcatctgaaccccaattctatcgcatttcttagcattttttcctatctttgtgggccctacattggggtagagccatttcttgatctcttttacttctactatgagttgcgctggatggaacctaaaaaggtatctggatgtgtcggtttctaacttcaggatggcctgaagtcgtgatacatccccttccagtgcccttcttctcgtagaaaatggcgagcgatgtggttctatcttcagatagaaaattcggatccagtctttgttgtccatgaggaacaaccagacaagattccggaatggaccgccaaacccgccctaactccctcccttaagtctttcatcgatatcatcgatgacctccgagtacgagagttgtcggggtatgaagttgctgtcaacttcatcggtaggcagatccagccgctccaggctcgagcccacccagcctttgactattctgggccggaggacgcgacccgggtttcttctcggggtatttttcttgtatttcagatttcattttttatgtgcatgttcctgctgacttatcgagttctggttctcgatcctacaggtttgaacagcaaaaccgtggagcgcc

SEQ ID NO: 32459 - DNA, 691 bp, Oryza sativa
caggcccttgatgtgaggtaggaaggtgggcctgaggaggagatacgttctatggggtagcgtgagggtggtgacaaataaaacataccttttcatatcttttgcctaatattagtccacatggtcagttggtcatggcagtttgcgagtgaactttcttttagatggagttcaaattttgtggtgtgtttattcttgtgaatgcagaatgcttctgtatagttttatgaaaaatgtgtttcatgggattatctaaagtataatagttacatatactctctccgttttctaatagatgacgcctttgacttttgtcacgacgtttgaccatttgtcctattcaaaagctttattgtgttgtgacatgctttatcattaaagaaatttttagtatgacttacacgttagcatattttaacagtaactttttgaataagacgaatggtcaagcattattctaaaagtcaacagcggcgtcatctattaaaaaacggatgtagtattttatttacccttttccttatttatcaaatgtgtaatatatcaactactcgtatttgttctcaaatgttttgtggtgtaacatgatcacaagctgttctatttataagctacgtgaccttttttcagacatgattcccccttattgcctcttttaatttgtggacatttttttttttactaaaacaga

SEQ ID NO: 32460 - DNA, 759 bp, Oryza sativa
agagctatcatttaacccaaggatctggtaatggaggccggaatgcagaaacaaactctgcaggacagaatagggagaccaactctggaggctccaatgacacctcaatggacatggtttcggacagcgctggtaacgaatactactgaagtggattgtggtgagaaggaatactactgaagtggattgtggtgagatgaatactactgaactggattgtggtgagatgctgcatgcaaaaccaggcagcaacacaataccagtgttgtctcctgttgctgtatgttatgtattttcctaaaaccttatcatctgtgcggccttgtagtcacagatgaaatggttctctttaaggcttttaagcttttgtattttctatttttgttgaagcctgattggagagaaatcaagttgttcgtgggttccatcaggaatactttatatccaactgtgttcgtgacttcgtgttaaagattttgaatgtaaatgaaaattgcattgtgatatactgatagccggttgatgcaagtattctgtaaagcatggagacctggagagaggaagctgtgcttggccatcaaagccgaaaagggtagggaaaaaaaagaaaggaaaatgccacccaactttggtaagggtcattctaccgtagcaccaaaaaaaaaaaaaagttcaaccaacgtctatcaataagggtattgattgttgtgcctaacttataagccctaaccaaaatttaaaatttaaattttaatttta

SEQ ID NO: 32461 - DNA, 289 bp, Oryza sativa
cacagatccactagaacacaggagtagggtattacgcttgctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcatctggcgcgccaggtaggggactctgcgtgtgtttttctaagctctcgcattctttcgtgtgcgccaagcttttcctgttcagcccaa

SEQ ID NO: 32462 - DNA, 1501 bp, Oryza sativa
cctttcaccatggttttccttcgccattcgtagatagagtaccagattgggtaggcttacaggcatccctgatgatttattcgttaagattgctagtaacagtccgttgcaaacattagttgtatatgctgcaaaaggaattcatctttcttggattttgtatagggttccattagggtaaaaaattataggaacaaagttttaccagttgcaccagatgtatacaatgcagtttaccgtactttacctggttgtcctttaccttgtactttacctgggtgtgtactttacctgcttatatctggtttgctatgttctatgcaaggtaacaatatttgcaggttaacagcgggtcacaggggtacatcaatgatcaggtcttggtggtgggtgcgtcttctgtctcaccaccctccagtttccagatcaagagagaagttttggttcttgtaccctagtcttaccattgttacgagcatcatttgccttgaagtcgtcaagccggtttctgaatatgtatacaatggcgtttttcctgtaatttgcaggttctgctctggtttgcgatgtcctatgcagggtaacaatatttgtaattttgtatatgcaactttatttttacagggtagcaatatttgtccgtattgttgagtgcggctggagttaggttcttcatcttagttattactgagctcaggcatgccattgcatctatctatgcggatggttttagcttaattcctacatgaacgttctgcctttttctatcgggatggaagctacttgctgctcttcgaaagcatggaaggttgaagttgtcttcaagcaatgaagttgaaatctatttgttgattatttggtgatgatgcctgttttgaacaattctcgttcaatttgtaccgatttgattatggttttactgcttattgcatctctggcccttgttttcatcgtattgagaggttgatgtgtggtcgctctctatttttctctagccctctgctatctcctgctgaattccatcggtttcgaaaacattaacgagcaggctatccaagaccgccgggttaccaccactgctcgccaccggcggcggaacgcttgcttgccgcgcgcatacctaaagcccaggctaaactatcgcccaattgcaccggcaccgcccttcaccagagcacatacaccggccgtcgggcggttgcgattttcggccgtgtctccatcatcagcgcatgcgatgccgccgccgttgccccttgctggtgccggtctccgtgtccattgccactggactggacgcctgagagagatcgaccatgcagcaaccctacgtcgtcttcgtccacagcgccggcgccgcaactccagtctccagattgatttaattaccgcaggtgatctcgatcccctatatatatatctgactgcaagaacaaacaaatgaccagtggggtgccaagctcttgcgtgacaggacaactaggcgtccctgcgggcggga

SEQ ID NO: 32463 - DNA, 1501 bp, Oryza sativa
aagggcaagcgtggccgacctaggaagtacccgctgaatgagtcaaagaataaattgccagagttgcgtgtgaaagaaccagccaatgtgcccaagaatgagccagctaaacgtatatcaaaaagattatattcaaagtacatgaaaggcaattcaaatatatctgagcgttcagcaaagaggaggaggactgcttctcattattcatactggttagatggccttcggtggacacaaaacccaaatgatgatcgggcaatatcttttaggacagaaagagttgtctttccctgcgaagatgctgatctgtctgaagtttttccagtgtgccgtctatgccagaaatgctacagtggagaatctatttatattgcctgtgaagattgtggaggtaattttttaaacctgcattctctgtatagaatgactatatttggccctaagagatggggacagtatgaatctgaaatttgcttggacctcttgaaacaaattaacagattttactatccttttcctgtggattatgtgctttctacttattacttttaggtcttggacatactgaggagcatcatttacttatcacttctttatgtaaccatattttatcatttttgaattttttgatggttgtgcagtgacttgtgttgcttttcctgccactgcaaacttttgtatttcacaaattgttgttctaattagaattgtttattcttgtagattggttccatggagacatctattctattactcttgagaatgttaataatctcataggtttcaagtgccatagatgccgtttgaaagatgtacctgtttgtccgtatgtacaaacagataatatccttatggctcaatctgataaggatgacgtcacaagcagatctatagaggacaaggaagacaggagcccaacagatctggttgcccatgacagtctggaagggtctcatggtcatatcattgagaaagaggttaatgatcatagttttgaaaaggaagttggtgatcatatttgtttgcaagcgcaggaagatcataatgaaaaggagctcgacagtcatagcactgagaaagagctcggtgatcataacaagacggaagagtttgatggcaatatgaaagtgctatttaatcttaacagtacaaaggagcttgatagtactagcactgagaaagagcttggtgatcataacaagatagaagagtttgatgtcaatatggaaatgttcttcaatcttaacaatacgaaggagcttgatagtactggagaaagcatatgtgctggtggagaagcacactgtctgcatgagctcaacaaccatgaaattcttaaggagtgtcatagtcttgacaataacctgggtgaactcgataatcaagactgccaaaaagagtgtcataatcaaaatagtctaaaagagcttgaaaatcatcgaagttcacaagagcttgatagtcataaaagtccagaagagcttgataatattataagtcc

SEQ ID NO: 32464 - DNA, 312 bp, Oryza sativa
ttggttatcatggatcttgagcggatttaaagacatatactttattcatatgtgcaattcgtcacgtttaggttatatatatacatatgtcgtatctagtttctgggatatggaaatgtttgttattcttgtgcgcctacttgtggtcttcaaatgataaggatgtgcttttttttgagtgccaaaagagtcaacattcataattgatggttctacattttcaacaaagttatcttctccaatttatacccgtgatagtttcaatctttttgtggcagatctgccagcagcatgaattttttacaaataaga

SEQ ID NO: 32465 - DNA, 463 bp, Oryza sativa
agttgaaaggctgttgccaacatgttggtttggttaaccacaatttggattagctctggtgaggtttcgttgatgcttttctcattcccattggcttgggttcttgagtcatcggatccatcattcccatagcctttgttaccagtgttatccatctgtcacaaggtagagattgagaggggaagcatacaaggaaagaatagaccagaactagggataagaccttaaaggaactaactctttttgttgatgtgttgtttgttttgcttattctgcaggttgattaagcaaacaacctagcatggttacatcaccacccaccgatgcaatccacgcgctacacacacaagcaaaggaacacacgacagacgaaacactagagggtggcttaggttctgcgacgggttctccaagatcttcactccttcacagctggcttcactgcttcctgcacttctgaagc

SEQ ID NO: 32466 - DNA, 1501 bp, Oryza sativa
acggttatcacgagaattaccgtggtttcaaacctaagaaggttgccacgtgttataacagtggttctgtaaaccctggtgagggcattatcaaggcaagcaactcatattgtgagtggcctcaagtgctatataagctggacacacatattccagtacgatgcatgttagctgtaggttagtatctttgattttgtatattagccccttaaatattttttatttaaacataagcccaaaaattcaaactttatacactcaaaaccagaaactattaaaatgtcaccgttctcccccttcctccttttggcaggctagagttcatcagccggccgttggagagttgagacctcaaccctatttgttgtctcctctctccttccttttatcgtcgggtgttgtattcgagcaagaggcgaacgatgagcattttgtctccatgcagttgaaacctcacctctaccatcgatccacatcttttggctcatgcaaaaggagctgcgcgacctcgtcttcctctcggaggtactgccaagaagaatcgcgagacctcgtcttccttgcctctcccctccattctccaacaacgagatcggagcaacacaatcgtaatctagttgctcctccccttttccccaacaccaccatttctttcttcaatccggtgctgatgcatatcaatctagcattgccggtcaacgttctcgagcaaaataatggttagagttgggggacaagcagatccaaccagatgtttcatcttcttcttgttgttggttcttgacgacagtagatgcatcgtcctcgtaccacttcctcatgtcggttattttcttccttctttctcctgcttcacgggcccgacctatgtggcttggtttttctttacgagactatccttgcatgtagaagctttgtgaagtcacttcaccagctaatgatgttactcatccgtaggtgtattgtaaatgaaagaactactctcacatgggtcgctgtcttgctgaaatatgggctaacaagctgtgggggttcatatgtcaaccaccggtaagttatatgatccgtttccattgtgaatgtcgtaaagtacaatcatgctaaatgtcaatcttttgaaaactgaatcccctagcactaaagactactaaaggaaggggcgtacataaatcaagtctaaaaatacagcaatctatagtttctatattgggaatgccatggctaacagtacaaatacggtacgaattggctgtccgctgcaaattggagtctcgtacataaaatctgtcaacagatttataattagtccctaaaataagtccaaaactctccgaaaaagtcatcggatcctaatccattatttagtacagtggaaccaaattgtcacatgccatttcaccatttttttctataaaaggagaactcgtacttttggtaacaaaaaaaaaatcaaggacaaatcattctctcccatctctagccgccgcgacgcgagcgagca

SEQ ID NO: 32467 - DNA, 1279 bp, Oryza sativa
caccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttctggattcacctaggcatgagaggggactgcccgctaccttgcgaggagtgggggtgaaacctgaggtgtggtgtgcttggttagagggggttatacgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgagcccgcggttatgggcggtcaaccagattcaccgtgattagtctcaccctagtgtaatcttttgaatttggatagtttaggtggatggttgggcctgtcgcaacgtggtatagcgttggacagtggatgattaatattaattaattattataactgtttaaatctttcaacttctgtttataaatgctcgctttatgcaaatgaaccactctagctcttctttgataattccctgcatcatacccctattccggtatgacttgctgagtacagtgggtagtactcagtcttgctctatttttcccaaccccagagcacgagtatgtgtcagatgaaggtttctccgaggagtaggcttcgtccgtgtagtcgaggatgcctgtggagtggtgttcccgctgcagttctagtcaaggcttagctcctgttgtcttccgttttcccgctgcatttatgtaagacttttatgatgtttgtaagacgtggatctgaatgtcaacattgtcgtttgtgtaccccggccggtcctggatggggattttaatgcacattctgcttggaattctattcgggaatttctgggcatgacagtgtccttctggtattttttacaaaaaatcagaagagaagggttcagagattaaggaaccgggaacgttttcaggaggttgaacaggaaatcagtcatcggttaaagaaaacaaagccaaggcaggagtggcgtgttaaaaatcaggttcctgcagccgatgaagccacgaccgatgaagcaaagagattggccaaaggaaaaagtgttgtaactg

SEQ ID NO: 32468 - DNA, 854 bp, Oryza sativa
caagcaacaagctgtaggaacccttcccattgatgacaaagaacgttgtagggatggttttgttgccgactgtcagctccacattcaaaactcctttggtctctgatggattgccaccaaaatccttaagcaccatatttgtcttgatgagatcctgagcgtttctgcccaactttctgaatatagcataaggcatcaaattcactgtagccccaccatcgaccattattttggacatcaacttcccattgacataaccatttatatacaatggcttgagatgccgattctctgtaccctctggcttctcgaagactgcttgttctggtgacaaaatcaatttagccgattcttcttcaacatcatcgacatcggcttgcttgaccccaaactcggtaggcaacatgaaaaccatgttaaccgatgcagttacaacactttttcctttggccaatctctttgcttcatcggtcgtggcttcatcggctgcaggaacctgatttttaacacgccactcctgccttggctttgttttctttaaccgatgactgatttcctgttcaacctcctgaaaacgttcccggttccttaatctctgaacccttctcttctgattttttgtaaaaaataccagaaggacactgtcatgcccagaaattcccgaatagaattccaagcagaatgtgcattaaaatccccatccaggaccggccggggtacacaaacgacaatgttgacattcagatccacgtcttacaaacatcataaaagtcttacataaatgcagcgggaaaacggaagacaacaggagctaagccttgactagaactgcagcgggaacaccactccacagg

SEQ ID NO: 32469 - DNA, 399 bp, Oryza sativa
agtagtcaagctagttaaaattgaacttaattaagacacatgctcatcatatatctttgtggtcagactaattaccatttcatccactcaactagccttttgcttgccatcatagtaccctagctagatccaagagataaagatttttgcggtaccaaattttatattgatgtacatcgctctgatctcaactttcaaattaaccctcctatatatcggtaaactactacaaatctagccatccatgcccccacatctatgacgagtgaaagatccccatctcgaatgactacatctttaacgggtgataaagtggctatagcattctgacaccacccctcgcagatgaccgttaccacactgtgagttcttcactcgatcgacacatataatgcatta

SEQ ID NO: 32470 - DNA, 1501 bp, Oryza sativa
gcgctctccagtacctgaccttgacgcggcccgacatcgcctacgccgtccagcaggtgtgcttgcacatgcatgctccgcgcgaagctcacgtcaccctgctgaagcggatcctgcgctacatcaagggaacggccgcgtttggcttacaccttcgcgcctcgacgtcgccgacgctcaccgccttcagcgacgcagattgggccggctgccccgacacccggcgttccacgtccggcttttgcatcttcctcggcgactccctcatctcctggtcgtccaagcggcagacgaccgtctcgaggtcaagtgcggaagccgagtacagaggtgtggcgaacgcggtggcggagtgcacttggttgcgccagctgctcggtgaactccactgccgcgttccacaggcgacgatcgcttactgtgacaacatctccagcgtctacatgtccaagaatccggtgcaccacaagcggaccaaacacatcgagctcgacatccacttcgtcagggagaaggtcgcgctcggtgaactccgcgtcctaccgataccgagtgcccatcagttcgcggatgtgttcacaaaagggcttccttcaagcatgttcaacgagttccgagccagtctctgcgtcggtgatacgacggctgcgactgcgggggggtgttggcgaacggcttcgtcagactctcgcggcgcgctccacgcgcacgacgcgcaccccgcgcacgacgccgcgctcctctcgcaccgctcgcaccgctgcacgtcccttagatcaggggattagttaggcccaggcaactcccaagccttgttgtacatgtataaatataagctccattgatcaatgaaagttacggttgatccaaatctccttctacaatatttatctaaggttatttgaaacatagatatgagattttgtaaaaatagatctatgatcttgtaagaagtatttgagcctataaataatttcaaatgaaaaggttgtcaagtataatgttatagatcttgtccagatataaactttgtcttcgtccaactttatatgaaaataataggtgtagatatgtgttttttcattgattttcacacaagagtggcttaggccgcccacataaaagaataaattttcacatgtggaagcttaagccacccatgaaaatgatgtcatcttcattagcaggcggtttaatcatctgcatgtaaaaattggtaattacaaacaacgatggacagtaagacgcatgcggtgactttgtctatctcaaaatatatcgatttagtctcacagagttgctcatagtgatagtaatggtcgatataacccaactcccgaacaagtcatcaagattccttctatgcgtctccactactaactactatgctaactattgtcgatgcatgtaaaacatggttcaccacttaaagaacggtagtccaatagaaaacattatgtcattcagtcacaagatatcgtaagggcatttctaacagact

SEQ ID NO: 32471 - DNA, 1501 bp, Oryza sativa
aaattttgatcaaattcataaaaaatattttaaaaagggaatttttttgggtggaaatacgtgctttctggtgggtggggggagggcgaaataactgaaatttcataattctgttccggaattgcaatccctgatatgacgtggtgggggatgacatgctggcggttgtcgatcggtcaagtgaatccgacgtgcgttgccacgccaatctgctcaatcctcacgtttcactcattcaaatccaacccgagcttcatcttctacatctttctgactgtttgaaaggcatttccatacgcggttgctctcccagatatgaaaaattaacatttcaagttttcaacacaagcgatcgccgatcagaagcggttggctaaacatctgtcagaaaccattttagccacctattaaaatggtttttttatagtgaatcataaaaacaccgccacttggcaattaatatttgcatatattgcttgccagttagagtatccgatggtacgaggcaccggccgcccttctggcccacatatatctcaacactgcgaaaaaaggaaaggtctcttaatttatcagtgagcctgaaattcatccatgaatcgtaatacgagacatgacgcgtccctcaattcttaaaactagtgcaaataaaatctcaagatggttagaacggtgatttcggctaacatgatatggcattgacgtggcacttaaagtaccaaaaacagtataacccacatgtatgtaagtgttggttaaaaataaaaaaaaaattgcaatgggacccacatcaacattccctcttttttccctcttctctcccatcctcctctctctccctttcctcgtccatgagcacccaagggggagaagaagccgccatggttggcggtggcggtgtcatgcaccttatcactttccgcctcgtagtcgtcgaagggcgcagtgataaagggcgagactaggaagccggtgaactcctacaccttgacacggatgttggaggtgttggtgatgagcacaaagttgggtggtcggcaggacactctccagcgcttcttgggcttcttggatggcaccaaaaggggatgtaacatcctggcccaattagtatttggcatgtgtggcccatgagggctttacggacatgtttagtaccaacttgctagtttaacaagggtggaaccaacttacaaggtctattccctccaaccatgccactcccaggttaatccttttacacgaagtaataacgaaagtgtaaatggggtggtatgtgtaaagtgggcccgcctatcggatgggctggctacacgcttatagagggagggttgttacagtgttgttaacacctaatttggcacctaggcacgaaatagggaaacatagccaaatttgcgagaggactgggtttcttatggaaggccggtctgactgccaccatcgagacggtcagactggcggttggagttggtttgaccagcagcatatggtcggttag

SEQ ID NO: 32472 - DNA, 268 bp, Oryza sativa
tgaaatgaaagaaagggctccggtgtatagagagggcctcgccgtttaaaagggacccatagaaccgatggaacccactattttttagtattgtgcgaaataactaaaggaagtagaagagaaaattgtggttgggaaggttatagtagcaaaagccattggaactaatattttatatatgggaataattcgttttgttattaatgggaaaaaggatggctaaaagaagagaaatcattagttattcattaaggttaatttgattcaa

SEQ ID NO: 32473 - DNA, 380 bp, Oryza sativa
tctattaatacgtagattgaaataatacatagattgaaagattattcatataagtagtataagacagattgaataaagaaaaaagaatgggtgattcgaatactaatcaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggagtatttcca

SEQ ID NO: 32474 - DNA, 1501 bp, Oryza sativa
tgttagaaatgcccttacgatatcttgtgactgaatgacataatgttttctattggactaccgttctttaagtggtgaaccatgttttacatgcatcgacaatagttagcatagtagttagtagtggagacgcatagaaggaatcttgatgacttgttcgggagttgggttatatcgaccattactatcactatgagcaactctgtgagactaaatcgatatattttgagatagacaaagtcaccgcatgcgtcttactgtccatcgttgtttgtaattaccaatttttacatgcagatgattaaaccgcctgctaatgaagatgacatcattttcatgggtggcttaagcttccacatgtgaaaatttattcttttatgtgggcggcctaagccactcttgtgtgaaaatcaatgaaaaaacacatatctacacctattattttcatataaagttggacgaagacaaagtttatatctggacaagatctataacattatacttgacaaccttttcatttgaaattatttataggctcaaatacttcttacaagatcatagatctatttttacaaaatctcatatctatgtttcaaataaccttagataaatattgtagaaggagatttggatcaaccgtaactttcattgatcaatggagcttatatttatacatgtacaacaaggcttgggagttgcctgggcctaactaatcccctgatctaagggacgtgcagcggtgcgagcggtgcgagaggagcgcggcgtcgtgcgcggggtgcgcgtcgtgcgcgtggagcgcgccgcgagagtctgacgaagccgttcgccaacacccccccgcagtcgcagccgtcgtatcaccgacgcagagactggctcggaactcgttgaacatgcttgaaggaagcccttttgtgaacacatccgcgaactgatgggcactcggtatcggtaggacgcggagttcaccgagcgcgaccttctccctgacgaagtggatgtcgagctcgatgtgtttggtccgcttgtggtgcaccggattcttggacatgtagacgctggagatgttgtcacagtaagcgatcgtcgcctgtggaacgcggcagtggagttcaccgagcagctggcgcaaccaagtgcactccgccaccgcgttcgccacacctctgtactcggcttccgcacttgacctcgagacggtcgtctgccgcttggacgaccaggagatgagggagtcgccgaggaagatgcaaaagccggacgtggaacgccgggtgtcggggcagccggcccaatctgcgtcgctgaaggcggtgagcgtcggcgacgtcgaggcgcgaaggtgtaagccaaacgcggccgttcccttgatgtagcgcaggatccgcttcagcagggtgacgtgagcttcgcgcggagcatgcatgtgcaagcacacctgctggacggcgtaggcgatgtcgggccgcgtcaaggtcaggtactggagagcgccggc

SEQ ID NO: 32475 - DNA, 1501 bp, Oryza sativa
gttaagagatgggagttgctcatccatttaaaattgatacaaacacttgggaaaatctttttcatattcattgccaaacaacttgaaaactccatttacctaaacctgttattccatgactgctgtgaagcaagatgatagctactataactacagtaacgtactgtgacagccaaccatacatctatgtgcctcctaattgtcatgtaacacgaaagcagaaaagcaacaccctatttggagctcaaactatgtaagaaaacaaaaccaagaacatgctgatatgtgaaattatagtattataccagcacggataacgctcaacgattgcctgcatttggctgacaacccagaacaagtctcgtttactcatctctggcgttgagccaaaaccatctcctagcagcccagcgctcttcacatgattcagtgcggtttcctgcatcaaaaccaaaaacatttcaatgttctgatgcccagcccgagcaatccgacgcctgaaaattcacaatatttcacctgcaaatggttcatcagcgtttctatagacgccgtcctatcggccccgatctcataggacctaatcgagaagttctgcctgaacatgagcccctcatgtatcatcctgccgaaaccgaacgtgtcggtgagcatgtcgggccgcttcggcttccagtccagcagcgtccactgcttctccgcggccaagaagatggtcgtgatggctgcgaggagcatgctccagtcggggagctggttgtagaacgtcctcggcgccgcggaggaggaggaggaggacatcgtgtcgtgctccggatccgccagcgccgaactgccgccgttcaccttggggatggcggcgtgggtgcgcgtcttgccggccctcagggcggcggccgacgacgaggagcccggcttcgcggcgatgccgcggacgtccaggctgtccgggcgctcgcccaggacgctcttgggcggcgcggccgccggcgaccccggcaagaacgccgaggcggcgattgagccggccatccggagtacggattacaactttacgcgccaaatcaaagacgcgcgcgaatagggaggatcccaacctgaatcaacacgagcacaacattatcatcaccaggaaatcacaaattccagaaaatggaaacaaacgaagagtgagaagcatcttttatctaatccaagcacaaaaatcattagctgcaaatcatagcttgctcacgactcacgaggaagaataatcgaggataaaccgctggtcaaacgtcaaagcaggcgaagcaaagcaagccgcctaaaataaagaaaaaaacgagaccaaaaatctagagaaacttttaccacggccgtagcccgtagaccaccactagaccgtacagacgaaggaacgagagagaagatgcggagagaagaaaaaaaacacccaaatctcgcggcaaataacacgacgcagattactcgagatccaaccccgcccgaaagaagaact

SEQ ID NO: 32476 - DNA, 1501 bp, Oryza sativa
gcatgctaaaacaagaaaaacagatgaataaaacaaagtcaacaataaagaaaagcacagataaatacagcaaggccaaaacaggcctatggcttagctgcaagcaatacatactacgtaagattcaataatacttttttacctgaaaattgtcagaactaacttattcagaagtataacatcacattatcgcaacaatagtaacctacaatgatacatagagatgtgagcataacctcggacatggatgtgcgtaatctcctattctgtcctgcattctttatcctctcttctcctctcggagataccagttctgtgtcatctgcatttagatggccttgggggggcatcttggatataagtcctccagacaacaatgcagtagatcgttcatttgatgaaccatctcctctggaacgcttccgcaaaatattcgggcaacatctctcaatctttgttacagcagcaccataagctctagatctttccctgcaaagatactcataattgaaaacatgttctaacagtttcaagcaaatgtagtccacatagccatccatatgtactgagatttttttcccccaataatcttcccttagaagggtaaaataaacattatcaaagaatagtaaatcacaaataaaagttgcctctacatatataatacagatggttgctcaatcaagtacgtagtgatgcagttgtttgcaaccctatcgcacaacttaagttaatctcacaagacaatgtagagagtagtaaaataatacctagctttgtttgagatgtcactaagattattcttcatgcgtctaatctcttcaaaaggaagagatgagttccgtcctgtgcatggagttgatgtagactcttcaggggaaattccaagaatcaaacttattgatttttttacatccaaccgagatgtctttggctccaaagttgttgtccgcaagtccatggcaagtgattgaagcagagtagcagagtcaactgctggtgaccttgatgaacctgatactgggaatgctgcataactatcgccactctcacgaaaacttgctgacctttccaacgaagcagctgaatacagtccacgttgcccactgaagtatccatgcccatcaggactaccagacatcaagtcagattttgtactagatgccatcaccctgctggtgacaaacttttagaccgttaacaagttcaacatgtctccagaggatgtcaacagcctcatcttgcaaccatagaactcaaatgtccaaggcacagtggaaaatctcaaatcaaacaaatacctgtcattatagaaggcacagtaagtagcagatgaacttgaaatcaatttttcagaacaatccagagttgtctgtatgaccagagtacgttgcaaaataatagcttttaccaaacaaaacatctggcttttaaaattgtaccaccactctatttcaatgtaaatgttcgagtacgtgataacttgttttgttcatatttt

SEQ ID NO: 32477 - DNA, 1073 bp, Oryza sativa
caaagcatgggtaattgttaaccttttataatttattttgacaagtgaaatatgtacataattaaaataaagcctccattaataaaataataatacaaatgattcacagtaattatttgaccgatccaaaatccatccggcaacataacctctagtgtataaccgttctatttagatagatgcatgtgtaaccataatccttccttagccattagctagactgaaccaccatgacaagagaaagactaagaaaccttagctcttagcttgattagagtccattagcaagcgcgaataatatgagcaaccctaggttcgacctcagcaaatatattttgtttgtgcatatttgattgttgtttgaatattggtttttctcgcgtattatagaccttgtgtatcggttagtcgtgaggcaacgtctgcaacttccaggaggtgaaggttgatcaagattatatcaataataaggattatcttgagcaaggcaagtcatcacatattccttgaacatgttgatcctaattgcgaaattgtcttgtttacaaataaaattgcatgcaatgatgaacgtcctacttgtgattatgccatgccttgattattgtttacccttaaaatccttgtacccctgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgtttttgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggta

SEQ ID NO: 32478 - DNA, 460 bp, Oryza sativa
ctttttcagttgaaatcatttagtatttgaaaatattgtttgaagttttgaaattcaaatttttaattgataaaacaaattcacaagaaaaaatggccaaaataatagcagtaagaacataagaacatcatagagcatgattttagaaattttttggaaaaataatcgtccaatttggagttcatatgagtgagatacactagtttcaaaattttcaaaagtttcaaaattatttttgcatacggctgcttaagatgtccgtatgggaaaatggccctcgatttttgcagacgccactagttacggtccgcatggaaaaatgatggggcctcgtacagaaaaatcacttttgcagtagtgagtgaaaacggtccgaaacaatcagaaagcagcctcaaccatttccataaccatattttcttggaaacaaaatcgaaaacagtaaaatcagaaatgaaaa

SEQ ID NO: 32479 - DNA, 288 bp, Oryza sativa
agtccgagtcagactgggttaggtgatacagccgattccgacaatacgacttggtgtacgacatcatgtcgagttgatttgtcttccccgccaaaaccttcgccactttccccaccctcagctacaatgcaaaaccacaccagcgaaagctagggctcacaaatccactccaatccatctctctagaacttcacagcttccacaaaatcttccgtgcaaccaccgcatcaacctcccatccattcctcgccacttccaaatcaaatcgcatcatcccacttgcatcca

SEQ ID NO: 32480 - DNA, 525 bp, Oryza sativa
gtgaacatacggacataccctttgacattcctagaaaaataatctatattcttagcctataccatcgaaaatttgtttgctgtcttcaaactagttcttcctctctttttttttctttctgggtttgatactaggaatatactggcttgttcttcgtgagatgcatacagacaaaattattagagattcgtagcgtaaaactgaaagtatgagaaaggatcatcacaatgccaagaacaaaagatgccaatgggttcaacataattgatgaaaataataaatgcccaaaggttcatcacattgctgaaaatagtaaatggagtttcttctttgaccacctttaaaaaagttcatagctgagtggaagaaaaaggatttttcaggtcaaaaagacttgaaatttaggttagaaaccatttttttagctgcttcctctagttgtataaagagccttccctctcaatgcatttcagtgtattacaagcagctttcaagtttcaacacattttcaattagccatagcaa

SEQ ID NO: 32481 - DNA, 1501 bp, Oryza sativa
tgtgcaccacttgactaattgcaaacatccatgtactgtcatttcatattctatttcagaagttgttaaagtttcaaatactccaataccaagccatagaaggaaaccatggaacaattctttctcctactacccattggattgactctcgaccataaatgcttatcttttgttaggttaacttcaatggtaaaagaagaagccggtcagatgaacataaaccctctgtccaaaaatataaagcttattttatctcgtaggataaaactttgaccaacaattactctacatcacttgtgtgctacaaaagcataatcataaatacttttgaatatgaatctatggcatcaattttatgttgtatgaattatatcgtattagagtaattgttagtcaaagtctattctagaaatacgtttatatttttggatggaggaagtacttgtcatctaagcaatcagaaagttttctatagaagcttccaatgacacatatgtccaagtcttgcagtcaatggagctttctggccattttttcctgcaggaattttatatttcaagtagaaaaaagggtttttttttatctatacctagacacatttattttgtagattgttcatgtgtatgcttctgttatactgccgagtatcacagtacattggcattaattaagtaaaactaacttatcaaacatactaggctgcgttcattgctctgactgggaactttcccccttcggcatgaaaaacaaagcaactcattagatgattaattaagtattagctaaaactaactttaaaaataaattaatatggtattatcaagtgactttcctatagaaattttttgcaattttttgcgaaaaaaatacactatttagcagtttgaaaaacatgtgcatgaaaaacgagggtatatgttgggaaagctcactaccgaatgcagcctagtatatgtctgttagacaagcaagcagatgaaaaataagaagaacctttctttcctattgttgtcgattttgtttataatcagtgaaaaatactttcaactacacgggaggtacagattcagatttcttttggattgagaattttgatgtgactacaagtactaatgctacttttaatagaataagcgagcagaaaatcacattgtaataggcatgtgtcttacggtaatgaattttgattttgtttttatatctattatgtctgtttgtactcatacttatttttatccatttactttgaaaaacatacaatgagttgtgaaaggtgtccttcagtttcattaagtaccttattattttctagaaatataggtatcatgcaacgttgttatgctacttgctttgattttttttatttaacttgtaagagatcttttcatgtgaagatttccaacaactgtagcaaatccattgttttttggtaaacaataaaatttattacttatttccttttttttctttcatttttctaatttttcattttccccctagt

SEQ ID NO: 32482 - DNA, 1501 bp, Oryza sativa
cacttattcaaaacctgatctttattaaacaaaacaaaaacaaatcttggcaaacattggggttaacaccaatgagtcacattatttatagcaagtgcttacatgattggaaaataaatgaccaagcaccaattacatttattcatgagaaaggagacatttaattagcatcatacttattctccttccccatctctacgaatgcacgcttgatctagcgcatgaaccgcgactaagagtatcaaaattattcctaagctcagcaagctctacccctagttctgcgttacggtccctaagctcaatgttctccttgcggagcttcttcacttgtgccgctagcttatggaccgagggttccggcgacttcacttcttcctcttgaaattggccaagcgcccttacaattggagggggcgtcaaatgacgcttcaccgtcataggtggagggcaacgggattccgctgcccctccttctccgatgccgtcaacggccggagcaagcctttaccatacctaccgccgggagttcgcactctccgaatgcaaaaccaatcctccttgggggtggatggagtggcggtgggtgtgatgtagttgtggagctcctcatcccctgccttggtgtagagggtgcccacataccgctcagcaggaggcggagtggccttgtcatcgtcttggaaaagacgtctcgctttaataggctgagttcacccgtcgttgttcgtcgtgcaggctaatacccccggattttggtcttggtgacatgacgaggggagagggatcgtgctgccgaacggggagccgaacggggccgagacgggttcgaccgaacccctggtttggccgaaccagtgagtttgccggccggctccatatttgctggggagctgggcaccgtagcaaggggtgaatgcccccttccattgtgtagttttccactgggatgacttgattcgccggtgtttctccttcaaggttgtaggtggagtttgaggaggagccaatgtatggcatcagggatttgccagccattggtgagttgagggtgtaaatcaaggaagtgagctaggatggagagaagagttgcagagatggaggagaggaggaagaagggtcttatggtgctgatccaaaagttctacctccgaatgcgcatctagacaaactcgaacgagcgcggagaggaagctattcaaacttggggccgatgggtgctaccctggtgggagcaggagaatggaatatggactttgaaggagaatggaaccaggggttcggccgaaccctagtgggctcagctggctaccaaaattttcacacgctcaagcaaacttattctaagctcagaaatgacaattttacaggaaattaagcatgctttagatgagatcattatggttcataatcgattaattcaataatatccacttcttcatctaaagattcattaggctcatgaaaaatttttaaacgttaactgtttaccttaaatatg

SEQ ID NO: 32483 - DNA, 375 bp, Oryza sativa
tgtttaaccattcgtcttattcaaaaaatttaagtaattatttatttttttcatatcatttgattcattgttaaatatactttcatgtacacatatagttttacatatttcaaaaaaaaatttgaataagacgaacggtcaaacatgtgctaaaaagtcaacggtgtcaaacattttgaaacggagggagtacaagagaaggcatcagtagcatgtgcacgcacatgcacaattgcgtctgtacattttcgttgaagattcagagcttttatcttgaaatgttcatacaaccgctgaaatttaatacgccataaaaaaaagccaagagatactttatctgtaaatcttgtgcagttcaaagtgaacataattgtt

SEQ ID NO: 32484 - DNA, 1501 bp, Oryza sativa
cccatatactcgtagaatatcgaatgcaacattttgtgaaaatgcaacaaaatgtgttccggaaccagcaattcccccatctcatcgtcacaaagcccaccccaaatcacagaaaacattcatcgaatcgccgatacaactcagacatttctagctacgaggcataaacagcgagcatttcaattaatctctaaagcatatcagaatttcctaaaccaaaataaggcgagcaagcaaatgcgtcgatccaaagcgagtacctggatccgaaggtacaggcggcgcacgtagaaatcctccaggccgaggcagatcggcgcgtagccctgcgtccaaaaagaaaaatccaaatctctcatcaagaattacgaagagaaacacccggatccgaccagagagagcccgcagcgattttcgccaggccctaccttgacgttcttggccttgaaccaatcgatgagcttgcggaagaaatccctgagctggccgaacgcgaagagcagcccgtagctgaagagcgtcgtcagcgccgtggtgtacggcagcctcaccatctcgcccgcctcctcctcccccctcaccgaatccccgattgatagggtcctggagctccctccctcgcggaaatcctccggttcttggctgttcttggcgggcgattcttggattccaagatgatggatggttctcttgggaatcttgcttgcggtgtggatggggagggaggtggggcggggagaggagggatttaagggaggggaggtggaggtggaggaggaggaggtcgccaatggcgactaggcgacgggaggaggaagggtttgaacgttgaacaggacggcgatggaagaaggagccgaagccaatctggaaaaagaaaaaataaatcagttttttctttcattttctttggggcgattttttgagttcgttgtttcatttcgttgtcaaggcatgtcgttgtctccggatatatgtttttttttccttttagtgaggtacagttttttaagcgttatattcatggagaaaatgtaagaaatgcacgaaataccattggccatcatgacttttagaaaataccgttgtaaaagccatataaatactatgatcttggggtctcatacagtcatacattcctctgcgttcaaaaggtttcgtacaattctacgtattaaaatgtgatgggttaatagagtggaatggttgaaactctaacgacaatattatttcggaataaattgactcgtataatggtatttttttgaagttgtgtttgtcgatggtcttaacgtttgttgatgatatttattagattttttttcatatttatatggttttggcatatatgtttatttcagaatgtggtcttggtggtcgtgtaagattagctattgacattaggttatattaaatttatttttattagatggcgtcattgagttttttaaaacatttaattgttagttttatatgatgcttaaataacttttagtgttaa

SEQ ID NO: 32485 - DNA, 709 bp, Oryza sativa
cccacttgattcgtgccctctaacacccggaacggccgcgccattcccggccgccggccacatactccaccgccgttccccgctcctcccctggccggctccctccccgcgcctataaaatggaatccccatcctccgttctatagttttagcctcatcccgagcctccccatggtcgtatcacccctccccgccgtcgcccttctctttcccccgcgccggccgcctccaaccgcctgtgcggccgcgcgtgagcgtcggtcggccgtgccgtcgcttccctcggctctgtgacgccgccctcttctccggcctcacctcctcctcgcccgaagctcgccagagcggtctccttgtcggtgtccagtaccttcctgcctccggccggctactgttcctcatcggtgcggcagccgtcgtcgtcatctccttccccggctccacggcgtcaccctccaccccgaccgctgcccgtcttcgtccggagcccgccgccgccgtgccggcctctctttcctcctcgtcgacgtcgccttcggcagccccttctgccatccccgtgcgccgtcggccgtgccaccaccacctccggcatcgcagcggcgagccagcgacgtcgtcctcggcatcgcctcctctccatcctcgtcatcgccgacgtcccttcggtcggccgctcctcctcgccggctcctcgtctcgttgtgcc

SEQ ID NO: 32486 - DNA, 1501 bp, Oryza sativa
gcgctcggtaagccctagagcttcttccccccatcaacccccctctcccctttcggcccccaatccgattcggccgagcttgccgggccgattccggtgttcgcgcttgtgggggcggctgctggagcttcggggaagggagcttggggtctatttggcggcgccgcgtggcggtgggtgtgggggggccaccccgtccccgaggttggggggtgctgatccgcgcacggggattgggcgtgggatccggctggggaagcttggggatttgggggagggctgtgcctatgcgagaggtcgtggtgcgtgctgggttgtgccggaattggctggatctccgggtgagatccgtgaggagggggcgatggtgtgcgtggatcggccatgtcgtgctaggggtctcgtagctgcaccgtggagccgtggttctgctttgaatttaggtaattctcgatcgttctgtgggcgatgtaacagttggtggtggtggccgcttggtttgatgagtggagagcaattctgattgcttcattttgagctttggtagctttgttaggttattgttggtcgtgccatggatcatggctttgaattggttgttcccagaactttggatcaattcggactgctgtcctttttctgttgtagcacggtagtatactagtatgtgtcatttgtgggtgcatttcagttggcgatggaggtggtcgaatggtcttgtttggtgctataactagtctgaaggagatgctagtatctttgttgatcgttgctcggccatatgtgttgtcatctgtggcatgattaagcagatttggtggaaggtgacaatgaagtagatatctcactgagatgtttgccgaactttatatcctctagtaattcacgcgtagttcatcagattttggaagaatagaggttgtcgcatttcacctagcttattgcaacttgtttgagactaaatgctgttgctgcttttgctgttgtagagctggttgcatatattaatacaatgttattgcattaatgtaacacgtgcactgtagaatctggcaacttcaattgtttcctgatttatgtatatttggtttactgaatgcatttgatgtctttgcaaattatgttaattgatcaatacctgaaaacaatttttggtgtattaatagcaaaatatgaacaaaacaagttatcacgtactcgaacatttacattgaaatagagtggtggtacaattttaaaagccagatgttttgtttggtaaaagctattattttgcaacgtactctggtcatacagacaactctggattgttctgaaaaattgatttcaagttcatctgctacttactgtgccttctataatgacaggtatttgtttgatttgagattttccactgtgccttggacatttgagttctatggttgcaagatgaggctgttgacatcctctggagacatgttgaacttgttaacggtctaaaagtttgtcaccagcagggtga

SEQ ID NO: 32487 - DNA, 1501 bp, Oryza sativa
atttttatgacaaaattgcttgtacgatggtatttaatgggattcacgctagtcgatgatatttttcggacttgatcgtttgtcaatgtcattctttagattttctctcaaaaaattaaagccttataatataaaataaagaaaatagtactaaatgcggttgaatttggtaacgtttcctggaatcgcactttctttcattttgaaaggtttgtagacttttctttcgactttgacgggtttaaaagaacagtagtgtactttagagtgctggagaagttgatagaaattattgcatatttaaattacgttatcacataaaattcacgatgatgaaaaaaaaagaaagaaaaaacaatttgattcatggattcttggaattaaaatatagttttacgaagtgaattagctcaactgtttaggttgtttgtgttaaaatatagtttgaattacgaagtgaattagctcaactggtgagtacgcacgtgttataagcatctacgtttctatattgtgtttctctaagaaaagtcaaaaccgctactaagagtctattatgtaaattgcaccttccattcatatcgaaacctacaaccacgcttagcttctgaagatctcatactccaagagcagatagcgagatcttttttttaaaaaagttcacataagacctgaatatccaaatcaaaacatcacaggtattcaaacaactgaaaaaaaaaagctacgggctcagttcaaccctccagatgttttatgaaaaaaagtgtgtttcatcaactttcaaaggaggaaaataaattcataggtgatagaggtttactaaacaagctgtcactttttttatagtactggctgaagataaaagattaagtaccgacaaagctattaacgtgtgattagtgattttttttattttttttggacttttttaattttttaataggccttttcaaaaaatatagaaccttttggccacaccagccgagtaacttgtgtagcagctttgttttgtcacgccaaccatgatgacgtgacaatagactggtgtggcatgacaacactgatatgccagctgcacatggcgtgataaagtgaattggtcagacggatggcgtggccaaaaggttcagatttagaaatacttttcggaaagttatattaataaaactaaaaaatatctaaaagtataaaattaaaaaaaatcatgattagttaggtgtaaattattctatacttaaaaatagttttatctaatattttaaatcaacttatagaaaattttcttacgaaatatactacttaacaattaaaaaacatgctcacgaaaatcgagataaaatctactatatcttaaaatgaattgactagtaaaagttgagatatcacttaacactatgaatctggacactaaacacaatctaaactcgaccttaggttcataggctgtatttagttcacgctaaaattgaaaatttggttgaaattgaaatgatgtgac

SEQ ID NO: 32488 - DNA, 1501 bp, Oryza sativa
aactatttttatgtgccctagaggattgaaggaaagagctaaaagttgccggagcctttaaactaggatattatacttcacacatatattttagaaaaatcatgtaattttgttcaactctgccttcaattgctgtgtacatgcacaaccattttttcgtttcaagttcgctggttttttagttcttttctgtgcatagattgatggattgtaaggaatttgcatggtcataatgctattgacctgtacagacatgatgttttgtagttttgtgtaattagagagcatgttgagccttttctgttaactctcttttagagttcatgctgcattcatgttttgactcatgctacgtacatgaaaagactgcatatttgatctggaattttgaaacccactaataggtgttttaattgcaacgcctgcgtaagttttacgacatcattattggtttgctaatctctggtcttttattttgatttccaggtaatctcaggaacttgaaatggcagacgaggagcatgctccaacgtctaggaagagggttgcaggtacccaaatcaacaaggataatcctgagcctgatgatgactcaactgagcaagagatggggacatttaagagagctagtgaggaagtgatggcaacacggagaattgtaaaggttcgacgccagcagccctcatcagctccttctaatcctttctctgcaatcagatttacccccagtgataccagcgcccaagcaactatccctgtctcagagcctcaaccttctgatgtcattacagcgaatgcaaagcatagttcaagtgagaaagttaataaggagccaatggcagtgggaaaaatgctttacctgtaactgacaagagtgcaggttctagtgaggtaggtgagacagaaaaggatggatcagatctgacggatcagatgaaaaagccaagtccagtgactcaattgaaccaccttctcaacctgttgagaccactgacgaagcaaaagacttggggggcggatcagtggtagctggagaggccaaggaagataacagcaaggcatctgatatcgaggacaaaacagcaaaagagggagatgctgaagaagaggatggagcaaatgaggctggagctgaagacaaaattagcaagggtgatgatgagaagaaagatggagatgaatcagagacaaaggatggatcgtctgaggagcagaaggatgctgataacaaggggcagtcgtcatcaccaacaccccttttctctttcaagaacctgtcgagtggccaaaatgccttcacaggactggctggaactggattttcaggctcttcattttcatttggatcaggctctaaagaaagctcgagtgctcccctgtttgggctaaagactgatggctcatcattcccatcttttagtattggtgcttcgaataatgggagttcctcccctgcgcttgcgacttcggcagaagctcccaagaaatttgctatgccaga

SEQ ID NO: 32489 - DNA, 252 bp, Oryza sativa
ccccccgggaacccgcattgcggtttgacgtcgagtaggtagggttttatctgcgtgcgaacgtgtgctgatgtaaccctagttttggatccccctaggtggcgtggtgcgggaacgggcagggcgccgtgatggagatccccaagcaggggcagccgccgcgggtggcggggacgccgccgacattgcctggggcgattacccacactacgcaggttgggtacccggccgtgttctacaatggcaactggg

SEQ ID NO: 32490 - DNA, 1501 bp, Oryza sativa
cgatgtcgaggaccagacttatgtatgaatgggccaagaactcagaattgacacgatgaattgggccaaaattcacaagtctgtggagtggagcaatagaggaggccaccagccgaaattgggctggattgggctagccccaggttcggccgaaccaatccaggcgccgatggatccaggttttggcaaggacgtccaggattgcatcccaatgacggttggagggcacttcggacaattccccttccacaaccgtcatacctacctctatataagaagctcactctcttcacttcaacacacacctcaagcaagagctctctcattcctctcaagtttagtttagtagtatctagatggtggaatagaattagaataggaatcaggagtccggaagcctccggaagagttcgggtatggctctagtagctttcctttcctcttttgtaagctttgtacttttattagaatactcttttaaatacatttctggtattgaaatactttccaagtatatgagtaccaactttacattatgttcttattatactgaatatactgctagcttatctgggagatgctttggtgagggtataatgtttgcttatgcaattactctatgtcatgacgatgatattagagtagtatctggtagtttaggcgtggtgtctagattacgggatatcattatttagggttatatattgcggatgagaggtgggccgcttatggtgacagctcagtacgggtattccctctgcgcctatatataatcctaagttaatttattggggagggtattcctccgtatttagccccggttggatggtcatgacgggctgtcgtaaggaactcggcagtcaggggtggcttctcgaagtaccaggagggcatcggatagagggtattagctagtatatcagttaactagaatgtatgtatactatgtatattagaagtataggaatagattctctttctcttttctttccacctagcttagattatttattatgaggatgagtagaaatgcttgtgtgtcactctacccttggattatcttaatccctgcttagaatatgattatcacaagtaatatataaattattagttgagttctctctacatgatcttcccacgggataaaataaatatgatacccttggaatactctcgggtgaaatgctacaatggtatatccgtgtgcttgcggatgaactctgtaaccataatataccataagtatttctgcgccattgttggaaattatatttctagtaatgtcattaagaaataccaacaagcatttctggcgctgttgccggggaagattcataatagagattacttgtagtaacactttatatttacctctgtataatcattttcctttgcaggctaaccttgtttgttttcactttttgttgtgaaaacagggtagtgcatgactggtttcaacctgccggaaaactccaaagaaaatctagaagctttcttccag

SEQ ID NO: 32491 - DNA, 1501 bp, Oryza sativa
ggagcagttccaatacttcctcaaggaccctgtgaagtatgacgtcaaataccaggtgcgcttctgttagcttcttcaattcattcatctcttccttccccattctgaaactgccaagcagtagaaactggagacaaccaacgcacagtcatctgatcagtgcaatcttacatttgccaaatgcaggcaagcgcgcaaccgttcttcgtcttgggccttctggtgaccgcccttgcaaccagccactgatgaaagcagcaatcgccctggactgtgattctgtgacagcgaagttttgggtggaagatgcagattgatggttctctgcaactgttggtggagctaggttcagcagctatgttcgcgagtgtattagcgctcttttggcggtgctgggtagtagaatgtagaatcgtttcttgttgattccctgaactgatccagatcaaacatcttctaaaggttctgcgatgcaatgctagctgcagacgggagatggtacagggggtcgttttgctactttgccgccgatgttgtagggtgtgtagacagactgtagatgaataatgtcagtaacacctgtggggggttcagtgctagtgggctgcaaaacttgagcactgcttcgatcaaattgtgtctttgattatgaaattatggaatccagcacaggcaggtaataatttcgtaatagagcataaacaatttgtgaccttaggtgcgaagaacataaagctgaccaaggtgaagtaatattgatgcattgtgcgctgcatttaatttggttgttgaattcagagtacgtatttaaataggtgtccggaggggaaaatgtacacaaatgtttactccgtttgctgtgcatctcgcagtgatacaaaaaaatacaaatcaaaccacgctaaaaaatttagtcagttgctcgtcttcagaattcagtcctcaaatatttttaatgtttcctccatggctgctcgtccgttcattttgcactcgttttgctctctgtgaactggagagccccagaggttctctttttgcatgtaatctgagtttctgatcaaccattcagcctggctaagaaaaccatatggtggtggcgttcttctaacttgtgtctgcgcggctgttggcttcatccaattcatcgatcgccagttactacttacttactaacagcgtccgggaacaggagttgagccaaagaggcaggtttatcttccattaagcttaagagaactcggagatatctcgaagttcttggcacggcacgtcctgttttcactttcaaacttgagcattcagtttagacgaggtacttgattttttttttgtgtgcacgccccagcaggtgttttaagaaaaaaattaggcaacttaaaattgttgtcccttctcctgtgttttgcgctaataattccatcctgcacatggcatctctgaggaatcaaagatcaactagcaacagcaacaattagccgcgatagatcagacatagaca

SEQ ID NO: 32492 - DNA, 1501 bp, Oryza sativa
tagctagtagtgaccgatggaacggctttgcatgggtaggtgtttctacgagagagggagaagagagaaaaggctcgtgctcactctggcgactcatagggctagtttgctttgtgacctaaattgaccttaccaatttttgttaatgtcaaattttggtaagttttggcatagctaatcttggcaaggtaaagttatttttggattgaagccaaaacagcctaatttcactaatgaaatggcctatttctttaggcatgccaaaatttagtttctaaccaaatagacactaaacactattaaaattgataaatattggtaagaccaatttaggccacgaaccaaaccagtccatagtggctactgtcctcctaaccttgaatgaccgatgaagccacagttaatatattgaccaggtttaatttgcacacgtacggcttgatcatgcatcggcagttgattttttagttctgatgggagtcgggccatgccgggttggcacggtctggcccattcttcgtgcctaatgggccgtgctagcctgtcacggcctgattgtctatgacattccagcacgccctcttcaatgaggaaaaagttcactccaagtcccccatctatggtcgagtgcgtccctcaaccgcaaaatcagatataggacgtttttcaactagaaaaacagtgtaaatcaagtcacaacagttttggatggtggttttatcatacgtggcacattggcctagtcttcgtccgacatggccttacgtgaaatttcagtcaatggaaaaaaaaacatatgtagtgggacccacacttagttgtaattctagaaaaaagatttaaaattgtgtacccacatgtcagtcaagaaaaaaacctctctctccgctctgttagtggctgaggcgtggggacggtgtggacgcatgccgaggatagcgactggcgaggttgaggcggatgcggttggtagcatcaaagaagagggagaggagtagggcatcgtgggagcttggacgttgtcgctagtgtttacaagggtgaggaggagggtgtagcggaagcaggcaggcagggcgagacgcgcaaggacgacccatgtagaccaggccgatgacggcatggccaacgagaacgaggtggatacatccaacaatgtcaaagacaaggacgaggaggatggggatcgtgggagctggcaaacgtgggtattggcgcaggaaaggaaagcccaaggacagcgtgtggaggtaggcttaggaaggagagagggcagagatatcaagggggtgatgacgtggcccccctgcatttttttttaatttttatgcaaacaccactgtattttatcttactccctctgttttttaatagatgacgccgttgactttttcttacatatttaattattcgtcttattcaaaaattttatgcaaatgtataagatataaatcacacttaaagtattatgaatgataaaacaactcataacaaaataaat

SEQ ID NO: 32493 - DNA, 1501 bp, Oryza sativa
taaacctggtaaaataatacctagtttaaaactagtaaaatacaacagttaacttactcagtggagattatgggtaccccatacccacacggcatggttatccgaccggtgtagggggtaacttatatctatgaaatatgtaacggatcatgacttgggtattacgtttccttgtatattacggaacggtctaaagtcctggtttggtaatattgtaaaatagatttaggaaaccaataccgtattggttaaggtttctatcttgtaatccttcccaccatcctatataaggtgggtaggaggccttctagggggcatgacataactagatcgtcagatctataatacacccggcggattcaaatccccaaacaggattagggtattacctctcatcgagagggcctgaacctgtctaaatccctgtcttcgcatccatccacttttaggtctcgtgcgctacccccttttattattgccgaaatcatgtttcgatagttagcgcgccaggtaggggtgcgtcgagtttcctatcaagaagtgcggtggaaccaatctccgacgtcgccggattcatattcaccccaagcctctcactttgggagtttcgatttcttcgtccaccagtttggaattttccgcttcttcaattcagatgcaaatcagtcgggaaggctcaagacctctttcatctcgtttgatcgccgtcatgtttactggttttattgaagaaagttgacatgttgtgttcatcatctggttcaatctgcttggcgataccatgcaacggatcaattctcaactgccagcgttttttatagacgatgtcaaatttcctagcgatactcaattaccaatccaaatcggaatcagcctgcacttggagccaaccgatcagagcagtcgtcgccgagttatttccctgatcagcaatactcgaagacaatggctatcatgagtctccacgaccaatcatgcaagtgtatgtttccatctgaatctgatacatgtgcaaacgagcgtgcatggcaatttggtcaatcaaccaggagctgtcatgtcatcaacaatttcgaccagggggcctccacttcatcagcaccgtggacgtcgccgccagtcgccttattcaacaacaatcacacatgcataactctccgagcgctggtcacggccactggacctttgcaatttttgtttgccacgatgatctgcacctaccacggcctcgacgcgcacacacaggcggagattttgccctcttgggtagtttcatctcttctgtccagatcaattgcgccaaacccgacgccatgcaattttttgaggaacaatgcaatacatcaagccatgtatagtatgttcatctatatattcggcacggctgcctattcatgttggctgtcatccaggacacctcgctgggatctgccttcaccgatggccgtggttgctttcgctaccgccgcctagtgtcttcgtatccacagttggatggtca

SEQ ID NO: 32494 - DNA, 350 bp, Oryza sativa
tttaatgcagtttctcttgcaaattgtcatgttactgtgatggggatgttcattgaatacccatgcttagatttcaaattttagctattgcaacatcgcttggtactgtagactgtagttggcattcatttttccatcttgcctgtactgccacatttgtactgatgaacctttattgaaagaaaaacgtgaacagcctgaactaactgaatgttgatagggtgaaatggacgttgtaacaaaatagaagtaaactcacgccactaaatgtacttcgagttgttcagtgctggttgttttgtatatttaatgttactatgcaatctgccttgatttttgttgcatgcagt

SEQ ID NO: 32495 - DNA, 1323 bp, Oryza sativa
acatcaaccgtaaaacgatgcactcaagaatagcttactgttggaatgtgccatatggcgtgtaagaggattagaggaatcccatattgctttatcacagtttacttaagaaaagaattgcattttctttctatcagatattagctagttaaatgcaactaatcattacatggtactccaatgttactaacttaaaaaaaaggtactaaccttgtattaatggtttttcttaatacaagcccatcttttgtggcttagttatttaatactaaccttgtcttattattattattattattattattattattattattattattattattattattattattattattattattattattatttctgtggcttgatttaacactaaaagttatttaagcatcatataaaactaacaattaaatgttttaaaaaactcaatgacgccatctaataaaaataaatttaatataacctaatgtcaatagctaatcttacacgaccaccaagaccacattctgaaataaacatatatgccaaaaccatataaatatgaaaaaaaatctaataaatatcatcaacaaacgttaagaccatcgacaaacacaacttcaaaaaaataccattatacgagtcaatttattccgaaataatattgtcgttagagtttcaaccattccactctattaacccatcacattttaatacgtagaattgtacgaaaccttttgaacgcagaggaatgtatgactgtatgagaccccaagatcatagtatttatatggcttttacaacggtattttctaaaagtcatgatggccaatggtatttcgtgcatttcttacattttctccatgaatataacgcttaaaaaactgtacctcactaaaaggaaaaaaaaacatatatccggagacaacgacatgccttgacaacgaaatgaaacaacgaactcaaaaaatcgccccaaagaaaatgaaagaaaaaactgatttattttttctttttccagattggcttcggctccttcttccatcgccgtcctgttcaacgttcaaacccttcctcctcccgtcgcctagtcgccattggcgacctcctcctcctccacctccacctcccctcccttaaatccctcctctccccgccccacctccctccccatccacaccgcaagcaagattcccaagagaaccatccatcatcttggaatccaagaatcgcccgccaagaacagccaagaaccggaggatttccgcgagggagggagctccaggaccctatcaatcggggattcggtgaggggggaggaggaggcgggcgaga

SEQ ID NO: 32496 - DNA, 859 bp, Oryza sativa
ccaccacctgctgccgccggtcttcgccgaccgaggcgcgtgcgtgcgttcgcgggtgcgcgtcgagggaggggaagcacgccaccaccacgcgcgactcgctacttggcgacgacgacgccgaggccgaggaggcggacaagcgcggttcaccaggcgtacggcgccgccgaagggggtcgagaatcccgcgtcgctcgcgggcgggcgctgaggaagccaggaaggccgccgaaacatagcggccacacctgctgctctgctccctctgcgtgcggcgcccggtgaggtagtcggggtcgaagcgcgtcaagtcgagggaggcgaacctgcgcccgcggctgatcgatcgaggccctcgccgccgcgcgcccgcctcgatcgagagcccttctgcatttgatcgtctgaactcagctcaggtacgcactaatttggttccgcatctagcatggtgtccaccacccacgcacgcacgcacgcactccgctcgtccgcttgccgcggcgcacgcacgacacgataggcgccgccgcgcgcgtctcgccgccggccatttcgcgcagcttctgagtgtcgtgatgactgcgtgacgtgcaactgtgcgcttaccatgtcaatgcagtgccgcgtagagattggtggatggccatcgccaatacatggattaattagttagtgatgagttaaactaacacacgcacacaaactgcagccgcggcgcctacttctgagcactaaattaaccttgaaatccattttagccagcactaaacatggattagttagtgatgagtaaattgatgtagttaattttgcttacaaatcatcattaattagtcctctccaagtaattaaa

SEQ ID NO: 32497 - DNA, 1501 bp, Oryza sativa
agatggagatggacgaagtcgggggtcgatggacatctctaggacaaatgaaggctacacgagccgcgacccggtagtcgagatgtcatggcacagggccggtgtcctgctgctagggactcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgtgccctcggttatgggcaagccgagtaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtggcttcacggccttgtttaataatcttgtatagctctaggatcgtatttacaaaatagctttgagcaactaagtgtcttttaatgctgtttactgcaaaccctaaccctttatattacaaccccccttgtactcccttgcatttattctgcacttatgggtgtgtcttgttgagtacggtggttgtactcagtcttgctcaatttttcccaaactcagaagaggaattcctggaagatgaaggctttggtgtctagctcgtgcctgccgtcaagcgcctgtggtcgtcgccctagccttccgctgtttcccatttgtctttgtgtgtgctgggccttcgccgcctatgtaataaattaattaattacgcttcagcttgttaaactctgagttgtatcaacttttggtgtaccttgcctcctgggacaaggaataatgcacgcacgtaaggaacgcccgttgggttatttccggtcgtgacatgtggatatgcctagctctagctctagctcttgtgtttctatttgtgatgcctcacttgttgttgagaacaatgagcgtaaggagcaagtggccaagctcaacaagagtttggagaggtgcttcaaggataagaacactcttgacaagattttgagtgagcaacggtgcatccttaacaaggagggacttggattcatttcaaagaagggtaagaaaccttctcactgtgccactcgttttgtcaagagcaatggtaagtattgctccaagtgccgtgaggttgggcatttggtgaatgattgccccggtggtaagccttctatgacatgcatgtttgattctcattatatgcttaggaaggctcatgatggtagcattgttgctagatatgtgggttcccctatactcagtggtaaaaagaatgccatttggttgcccaaagttttgatctctaacctccaaggacccaaacaagtttgggtacctaaaagaccttgatcttcttttgt

SEQ ID NO: 32498 - DNA, 175 bp, Oryza sativa
tcctgcaccccttggattttaggacaagaaatgcttttcagatcttgtagatgaattcaatgagagagttttttctgggcattcccttcctaagcattacatgatcagaggaatcattgtaggtcttctgtagttctaattttgttattctcatctattccaaattaatatttca

SEQ ID NO: 32499 - DNA, 1501 bp, Oryza sativa
tcatatcatttgaacactatggaattgttggattatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggctggtgtcctgctgctaggggctcaatcctgcctacctgtcccggaggttccgatcgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctcggttggcttgggacgagctgtgacccagggtcgggttgccagttcggtctgaatcatcgtaggccttgggttaaggcaggttcgtgagggttcacgaccttgattaataatactgtgtagctctaggatcgtctttataaaatggctttgggcaactaagtgacttttaaatgctgtttactgcaaaacttaacccctatattattatccccttgtactcccttgcattaattatgcatctccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgaaattttcccggtcgcgacatcgagcttttcaaaaagtttgcaaaaagggcccaaaatgaatttaattgcactcttgtgaaaattagaagtgacaatggttccgagtttaagaataccaatatcgaggactattgtgataatcttggtataaaacacgaactttccgctacctactcacctcaacaatatggtgtagtggagaggaaaaatcgtacattgattgagatggcaaggactatgcttgatgaatatggtgtttccgattccttttgggcaga

SEQ ID NO: 32500 - DNA, 812 bp, Oryza sativa
taagtggcagcagatgagagtgctatcatttattaaagatcagtttaattcagatacaagagtcactaatttataagaccaaattagagtggttaggtttatgaattatgaagtacaggaagaagcttgtagccgtaggaattgtctgtgcattaacagcaccctgtcaatctgccacatgctgaaatactgaccattcgtattgcttatgaaacaaaccattgacttttaatatacacctaagctttgtcaattgaaacatactggcttaaaagttagaatgtggttatgtgaaacttaggcttcctattaccgatgcagtgttgtttaaagaagggttagataatcggatgtaaatccaatatgaaactattggttctatcttattcaaaatgccctcttctttagttaaattgtgatgtaggctgtctttcatacgttgacacaaatctgtttcgttaggtcattttgtttcaatctcagtaatattctcacagtaacatgtacaacattgctgattgtctatccacattataacgtgaatttgtttgcacaatggactttcagcatttaagcgaacaaagtaactgatttgataatctacacttgcaggttgatttttttgacctggaagttctatataagaacttgaggcctgaatttagatccaagtatgctattgacagtagcaagcacccccatctaaggatcatgtcaaatatgcgagaagtatgcgcttgttatgatttctgataatcagcttgtacatatgttcatatatgctaattaattatttcttctttttttgaagc

SEQ ID NO: 32501 - DNA, 1501 bp, Oryza sativa
atcagcttgtagggttccccgtaaggaaaaaagagtacaacaactattttacattttagcatcaattacttcggatcgactattttacccctattttgatcttcaattttgattttgcccctgtatttttttaggttttcttttttgcctctacttttttgaaatgaaagccaactttgcccctacttttttttagaattacatagtacaacgtagacacttacaatgcacgcgcactcacccatatgaacgcacacacataaaccctatccctatgagcatcttcgaagactggactgtcaaatccttgagattgacgaagtcatcacagacgtctcgctgtcgacgggtacgttgactaccactaaaagcacaacgacgttaaatcctggaaaatccgctcccatgaggagtcgaacccatggatggacacgttgacggagttaaatctttggtgaaaagacgattatgctcttatttgatattgcatatttgtctcaatgtttattcaataatatctgcccccattttacatgaaacttgcattttggacaaacttttacaaatttgacaattttgatagaatattaaaaatgaattggaataattttgccacaaattttttgaaaaaaaaaggacagaatttgggcacaattttgacatgtttttacatagctaacaaaaggcatgtagcaatcacaaaatcaagcaaatccaaatccaaatcgcctgctctctgcatcaagccgtcgccgcctcccgcatgaagccgccgatgcctaattaagtcgagacgccgccgtcgcttgctcctcgcgtcaagccgctaccgtctggacaagagcctaccgtcgtctcgtcccctcgtcgagccgctgtcgcttggcttgcgtcgacacgcgcagccttctgcttgtcaccattgtttggttatcggctcaccaggggtataaaggtccatcaacgaattaaaaaaccattattacttctttatttctctacttctttagctccataatcccatgtcgactaattacgtctattccattaaaaaaggaaaaaaaattaaaaaccctaatttttagggtaaaattaatattggacatcaaatagggataagaacgaaattttcccatatataaaatacgtttttcaaaagtagtaaaatgtggcaaaaaaaaatccagccgtctattgggacacctcctaaagctaggaggaggggccccacggtgcagtttctcaggtgaccgcgaacgacgcgaaagcgcaggccaaattagggatggcaatttaacccgtttgcatgtttacccgtgggtaaaagccctaatagtgttggatttgttctctatgtaccaataggcatacgggcacgggcatgggtagtcactacctacccatgcccgtttcacccgtttacccgaaaaaaccaactaacatgtgatccctcggtcaaattagtatagatgccaccatctagtattgatgaacttatgtt

SEQ ID NO: 32502 - DNA, 1307 bp, Oryza sativa
gaacgaacatgagtgttagtgaacgaatgcaaacgaaggtgaacgaacgcgaacgaacgcttaacgaatgcgaacgaacgtgaacgaacgcgaacgaaacgttaaagaaacgtgaacgaacgcgaacgaaacgtgaacgaacgcgaacgaacgcgaacgagcgtgactgaaacatgaacgagcgtgagtgttagtgaacgaacgccaacaaaggtgaacgaatgcgaacgaacgcttaacgaacgcgatcgaacgtgaacgaacgcgaacgaaacgttaaagaaacgcgaacgaaacagcgaacaaaacgtgaacgaacgtgaacgaacgcaaacgaacgtgactgaaacgtgaacgaatgcgaacgaacgtgaatgaaacgcaaacgaacgtgattgaaacgttaacgaacgtgaatgcacttgaactaaaagtgtgagaacgaacgcgagcgaaatgtgtacgaacgagataattaaactattgttgaacttagcatatatatatatgattatatatacttgaaaacgtgaaatacattatatgttcctttgcatttagactagtacattttttttgcatgttgcagagaagacgtcgctgtcgttgtccctcaagccgaagtggtagctagccctcgaaggaattcgtgcaggcaagtgatgtaaagatgtgattgttacagatataatataagattgttagatttctaatataagattattagattattagagttagcatatgtgagtgttagagattattagattattagacttagcatatttgagtgttagagatagttagagatttaatataagattattagaggtttaatatacgaaacttaattagacttagcatatgtgagtgttagagatttaatataagattattagagatgtaatattcgaaacttaattagacttagcatatatgattatctatcgtacaaatacacgacacttagacatagcatatttgagtgttagagatagttagagatttaatataagattattagaggtttaatatacgaaacttaattagacttagcatatgtgagtgttagagatttaatataagattattagagatgtaatattcaaaacatatttgattgttagagatttaatataagattattagagatgtaatattcgaaacttaattagacttagcatatatgattatctaccgtacaaatacacgacacttagacttagcatatatgattatttgagttttaatacaagattagtagagtgttaatattacgcttagcaaatatttcttctatgaacaga

SEQ ID NO: 32503 - DNA, 1501 bp, Oryza sativa
catgcatggttagtttattcgtggttaattctcaaaaaataaatattcatggttaaataggttttactcatttcacgcttcgttaaagacgtgtttctcactatcttcgtcaaagatggttaaataggcacattggcacgtttggtgtgaaaaagagaaattgtgttatctgttgcaaggcagtaaataaaattggagtattcatttacaggaaagaaaattgtaatttcagccatcaaactgtctacagtattcatttggatataataaattatttttttttaaaaaagatatagccttcggtctctgtaccaactaaggatgcacacgaccaacaacaggatttgaatcatagtagatggagtcaatggtgctttgtgatatactccataattaaatggtagttgtagtacttccatttcaaattattgtagaaatattataattatgcaatgctttctggaatacattatttgttttgaggacatagtactcaatgtttcttgaaattagtcctagataaaatctgttttggaaaccacacccttgcaccaaatcttgatcaaaggagtataaattcttcagtacacaacttttgatcaaaaaaggaagaaaagaataatacataaatgcacccaagtgaaaatgttgtccgaaaattccacatgaatcccacgtgtccgcctcattttcctttacggcctgtttggcaagagaagggaagaggaatgggagcttgaaggagggagttgatggtgggattggtcatgggagttacttttttactcctcatcccttgtttggtttcacatcgaattccctccaagtctcacgaattaacaggccttccctaggtaagagatgggtgggaattggaccccttaattccccatcccaaaccccctcgaattcccaagtcctccaaccaaactacagacttaaactcctagatatcataaactcctattccccatcaccaactccctccaaccaaacagaccgttatgccttgtcaaggcagatgtttaattttacttgtcatgccataaatcgggttaaaaatccaaaagagttaatctaattaacctaagatccatgcaagcaattgttgtacattgaatttgatatacattatttttcgaaacacagtgtagacgcggatgctcatataaacacgtgtgcaccttacccctatgagcatcttgaagactggggagaccgtcatatatatgtcttaagattcaaaaatgaaaatcatcacaggcgccttgttgatcatatcgcttatcactaaaataatactaattagtcataaatgcaagcacctatgtcaatttaggacttaactaatctgggtagacaggttccaatgtaatcaatcagttgaatgttaagctcacttcgtaatttaattagtagcaattaatttttcttatgtgtaaagctattatatatatctatatatatgcgtgggtggtaggctggtagctatatatcttgc

SEQ ID NO: 32504 - DNA, 668 bp, Oryza sativa
gaggagctatctacctatgtaatgacagtttattcgcttataaattagagtaatagattgtactctattatcgatttgttattgtgtgcctcggctgattcctggacgagggttcacgcacatgtaagcgtttggaattttggatagaaattccgggcgtgacaagttggtatcagagcccccttgaccctaggttatgccaaatggttatccatagaagccctctaaaaatattggaaaagtagaactgttctcctccccttctcttttaattaaaccgaactaatggcacatgcacttcataatctcttttaatggttctcattcaaaatttattccagtgttattagtactgtacatccattactgtactaatggctcattttaccagcaaaagttttacaatattgttttatttaatcttgctgcaataaaataaatttagcatgatgattttataactttcttttatttcttttgaaacctgttgttcaaaagtacaaaaattgtaactttgtttccaactgtttcaacttattttgcaagcttggtttattttatttacttacctatttactttgattttctaactttattcaaattaatccaaaaacttgtgctattaattggataaatgtcttaactccctcctttcacttgtctttaga

SEQ ID NO: 32505 - DNA, 1501 bp, Oryza sativa
caacattttctatctttttggataatttccacccttttctattgggaatatgtacatatcactggtggagaagtgctttttactcccggttcgtaacccctatatagtctcggttttccaaccgggactacgaagccgggattaaagatcgctatctttagttccgggtgaaataaccgggagtaaaaatacatttttagtcccggttggtaacgataaagcatttttagtcctgactaaagagactagatccggttgcttctttattcttttattttcttcattgtttttaatatattgatttcaccccatcccatccccaaaatcccaaatcaatcatcctcaaattgcctccaaatccacaaatcgatcatctcaaatacatcacaaaatcttaaaaaaaattacatcacaacttctacaaaattcatcacatattcacatcacacacaaatcaaatacatcacacaccaatctcatatccaaatcacaagttctcccaaaaaaaaaagaaagaaaaaaacgttggcgcagaccgccgcctcgtcgtgcgccgtgccggccggctggccctccacgccctgccgccgcgaggccgccagccgccggccctccgcgccctgccgctgcactagagaggagaaggagaggaatagataaggagaggaatagataaggagaggaggagataaggttgaggagaggaggagaggagttaacgaagaggagaagatacctcgatccgatcgcgcacgcctctccaatctccgcgtcgatctttttttcccggttggtgttaccaaccgggactacaaatagatctttagtcccggttggtaacatcaaccaagagtaaagcatatggcgatcttttttcccggttggtgttatcaactgggactacaaatagatcttttactcccgtttggtaacaccttaccaaccggtagtaaagattgaaaagtaccctggagcttttaaatcgggactaaagatgtttttagtcctagtttttaatacaaccgggactattgtgaaatctgatggaccaaccaaagatggtttctccacccgtgaatggaatccttataaaccccattggtcatgcacatatgccttttcactttacactttcgttcattcacaaccccatgtgtaaaatattgtcccaaaaaaaggccctggcaacacaagtgtttcatgccacatcttctcactacttttatgccagacgcaagatatatagctaccagcctaccacccacgcatatatatagatatatataatagctttacacataagaaaaattaattgctactaattaaattacgaagtgagcttaacattcaactgattgattacattggaacctgtctacccagattagttaagtcctaaattgacataggtgcttgcatttatgactaattagtattattttagtgataagcgatatgatcaacaaggcgcctgtgatgattttcatttttgaatcttaag

SEQ ID NO: 32506 - DNA, 1501 bp, Oryza sativa
gaaaacgatgaactcctcgaaaaggcgtgacacgaagatacacataatctccttcttcaaaactcaaatccctacggcgattgtcggcataactcttatgacgagattgagccactcgcaatctttcctgaatgatctttaccttttcttctgcttctcttaggatatccgtcccgaaaacctgccgttctcccgtttgatcccacaaaagcggagtgcggcacttccgaccatacagcgcttcgtaaggagccatctgtagactagcttgataactgttgttgtatgaaaattctgcatagggtagattcttatcccaacttccaccgaagtctaaagcacaagctctcaacatgtcttccaaaatctgatttaccctttcggtttgtccgtctgtctgcggatgataagcagtactaaaattcagcttagaacccatctcttcctgaagtttcttccaaaaatttgaagtaaattgactgcctcgatcaaacactatcttcttagggacgccatgcaaacacacaatccttgccatatacaattccgccaatcgacttccagaataggttgtctttaccggaatgaaatgagccactttggtaagtctgtcgactattacccaaatagagtcatggcctgatgacgttctaggtaaaccagtaataaaatccataccaatttcttcccatttccattcaggaatcttcaaaggctgcaacaaaccggcgggtttctgatgttccgccttgactcgctgacaaacatcacatactgctacgtactctgcgatttcacgcctcatacttgcccaccaaaatctttccttgagatcctggtacatcttggtactaccagggtgaatggagtataaagtatcatgagcttctttcagaattgcatctttcaaatctttgttatcggggacacagattctttcacccaaccatacagttccttgctcatcctccaagaaaccgatagcttttcctcttctcatattcttcttgatttcttgaatatcaggatcattaatttgggcttctctaacttgatcaattagagtgggcttcgcttctaaagctgcaacgaaacctctattgacaattcccaaatttaatctttcaaattccttgcataacgccaatggcaactgtcgtccttctgtagcattgcaataacctttcctgctaagagcatctgctacaacattagcctttcctgggtgataatgaattcccatgtcataatccttaattaattccaaccatctccgttgtctcatgttcagatccggctgagtaaaaatatactttaaactcttgtgatcggtgtacatctccgtacgagtaccgaaaagataatgacgccagattttcaacgcatgaactactgcggctaactcaagatcatgagtagggtagttcttctcatgcggacataactgacgagatgcataggcaaccaccttcccatcttgcattagaacacaacctaaccc

SEQ ID NO: 32507 - DNA, 174 bp, Oryza sativa
tgatacaccctctgttccatgaaaaatcacatcgtaatattatgaatctggatataattctattcagattcgttgtcatattaagttctagatttttttttttagacaaagggaatacgacttgcagctagatgcctagaacttcacctgtcatgctgcaaataattctgcagc

SEQ ID NO: 32508 - DNA, 1501 bp, Oryza sativa
atcggctgacaagccgatggagcagttccagccgatagccgataatagccgatgccggtaccagccgatagcgatagggtttaagcaatcggctatatgtccaatgtagataatgatataaaggcaatcggctgatggtaataaaatataacaataatatccagtagaaaccaatcggctaacaatatgatatagtagaacaagcactgatccgaaggttaaagcacacatcggctagcggtccgatgccatgaaatctacaagattagattaaacagtgaaacctttgttgtcatcggctaaatccaatatgtatgtatatgcaatccttacaagccgatgcaacgtccagataactcaccggctgaaaccccgatgaaacccttattggcaatcaagaagcaggctagggattatggttctaagcacgacttagtagatcaaacttaactgatgcagcactaagtatgaaaagaaacataatatctagacaatcaagccgttgactgagttttcagggtggtagatgtctaaactaatctaatctagcaacgcgatttagccgataccggcagaaactctaaagcgagagacagccgatagagctaaatcgatatgctacgactagattaacagagacatatgataagtaggtaggcaaatatatcatccaaaccagtgcaatccaagaggtcaaatgtactgatgcagccttgaacgacgccgatgtagataagacaattgcctgggccgatggaacattggacttaccccttagccggagatcgaacaccgatgcagccccgcgtcgggtgccaagttccaccggaacgtagaaacaaaagtaaaagtaaaaagggtggcgatgcgccgaattgtgttgatcgtagagatagattacaatgaccccgagtgtacatatttatacccatgggtagatactagtccttatgggacaagaaagaaactttactaaagataaaaggaaaacataaagtccttataggacactaaacacactttcctaaaaataaaaaggaaactaacaaactattcctaattaatagataaactgccatgccgcattcttcttgaactcggactcttctggataaattccctttaattgatccgattccatcgagaacacggttgttggcgatttgtcgactcccatcggctgatttcaggactctgaagccgatattgactctaagccgatgatgactttgggcttaccaaatttcactgtcaacaagtacctacagaaaataataaaaatttaagaaccactagctattgagtcctgtttcacataaaaaatcgatcgataggtaagaccattgtttcaccaataaaatcaatcattatttgaagactggttatataaagaacaactagctaatgcatatggtttcttgctgatttcttatctctaccggtgtttattattcatgagacagcgagagattaaggtttagctcctctgtatctggcaaca

SEQ ID NO: 32509 - DNA, 442 bp, Oryza sativa
tttaacatatttttggtgtttcttagttcattctctttatctccttctctctttgtttagcttaaatggatttatttttcttggccgcaaaaagtgttacataataatcgtaccgactcaaatatatgtattttctggaaacattgtgaatgtgcatttcaagcattgaagtttttttttagagtgggttttataaaactccaccagttatggacaaagttgtacaaaacaaaagggattttagcacgtaactcatagccatgaatattattgctcaaaagtttcacatgaccacaccattaaccaatttaacatacttctatatcaaaatttaaaaaggctatacttgcatggatataacatctttatgatggataaataaaaactcatgaatttgatataataaatctaaaactcagaagttgttgacgagggatactcg

SEQ ID NO: 32510 - DNA, 833 bp, Oryza sativa
tttcccctttgtctacaccaatagttcaccagcgtgatcaccaagttttcatcttcatcattatagtttgaggggccatgaattgaacaactgtacgtctatgtattcatctcttatcatcaaatcagttgatatcatcacttagattaaattgcttactctttggttttcgcgtgtttccccatatagatgtgagaccagtacgtccggagtcctttcggccaaagttttgtaaatattatccatcatgggtttggatatcaaatgagcattagcgattacaatgaccagctagcaataagatcgaggtttgtacggttgtatcaattccatataatcgtaatttaatcataatatatctcatatgccctcttgtcaaaaatatttgacttttaacacaagatttagtcaaaattttaaaacttttaaaattaattttgtgttataataaatttgtaaaaacctatagaatttatagtatcatgataatacttttcaagacaaatctacctgcactctttgcgtgttttctaaacttgccctctctagttataaatatttgatgtttaggataaaattcaatcaaattgttaaaactattacccccaataatttctcaggtgcttagttaaagaaaatgtatgtgcaattctgttttgaaatttattactagattttacaaacacgagattatggtttctttcaatggtggagaaatgtttttttactcccagttggtaacccccgtagtccggttttccaaccaggactaaagataaaaaagtagctctaaccttttgaactccccattttttttacaactgggaccattg

SEQ ID NO: 32511 - DNA, 1501 bp, Oryza sativa
tgcagcttccatccgcgccgtgagaaacaagctgttgtataaactcgtcaatgtacctctcatggagttccttgtcagctacaagctcttgcagcctgatggcgtttgctacaaacaccctcctggtttcttcctcaaccatgacggcccggaccgcggcggcgacgccatggcggtcgaatgacccgtccatgtcatcccgcctcacctgcgatcctaccttgttaccctccatgagccgcgcgttcggcccttggtccccgaagatgggcaacatgatgagagggttcccaaacagaagcccctcgacgagcgagttgcggccacagtgcgtcaagaaggcgcccaccgcggcgtgcgccagtatggtgatctgcggaacccaccccatggcaacatgtccatggctcttcgtccgttcttggtaacccggaggaaggacatctgaaagatcgacgccatggggctttctcagcgcccacagaaatcgtgtcccggcgagctccagcccgagagccagctcgtgcacctgctccaatggtagaggcacctcgctccccagcgccacgtacaccaccgacttcgccggctgcacgtccagccaccgcatcgtcgagttgtccgtcatgccggcgcggcggcggcctccgtcgggcgacggtggcacgaggccgagggggatgagcggcttgttcttcaggcccgccgccacctgctggaaggcgtcgggctcccactccgggcagctccgcatggccgccagcgtgcacctctccatcgccaaggagcagcgcttcgcgacggacatgcccgacgcgccatggtcgacgaagaagcttgccttctgcgcccactcttaacatggcacgccctcccggcgttcttctaccacgccgagcacttggaagatggaagcgccggctggctccgacgaccgggtggcccatccggccatcatggaggcgctcgggagaagcatcgcgcatggcaccttgtgctggagggcgaccaggggtgcccagtggtggaacgtgtcggcgatgatccaatcaggcctctcgccggcggcgtcgcacgcggcgcccaggaactccgcgaacggcgcggcgagggcgtcgaaggccttccagaggagctcgaacttgccggagggaacgtcgttggtgcactcggtgccgtccgggaggcgcgcgaggttgcgtggcgtggagacgaaggacacgcggtggccacgcgacgccacgcgctccgcgagctcgaggtaagggagcaggtggccgaacgcgagccatgggaagatcacaaggtgcagcctcgacgaggatttggaccggccggtgtccatggcgatgttgccagatacagaggagctaaaccttaatctctcgctgtctcatgaataataaacaccggtagagataagaaatcagcaagaaaccatatgcattagctagttgttctttatataaccagtcttcaaataatgattgattttattggt

SEQ ID NO: 32512 - DNA, 1139 bp, Oryza sativa
tccatttcacaatgtaagactttctagcattacccacattcatatagatgttaatgaatctagatacatatatgtctagatttattaatatttatatgaatatagacaatactagaaagtcttacattgcgaaacggaggaagtacttgttttagactgtataatcttatactgcataatcttgtacttgatactgtatagttttgccgtagcctgtaacacaggacacatattggttacttgtacctgtatatattgaaacaaggtattgtgccgctgtttgtatttttacaaatgggaatgatgttttactttatctttcatgtcaatcacttgaaaactccgaaggcagaaatttattagtgtccttgtttaagtcactgttagcagaaattttgtaggtaatttggtcctgtttatacataacaagtactccatcttaaacttaccggcttgcttgcaatgctgaagtggatactacaccagtacacctcatacaacatcgtaaaattatagctatcgatgtttcataaacttttccacctttttttaaaatttgctagcatgcttttttatgctttctcaggttacaaaggaaaatcccacctcagccactttatgaaaattagttgaagcagttacctatatgtcaaataaacgagtgatgacctagaagcaatggtgatgatgctgattacctatcctcgtcgcaataaatctgcagtacgatgttgagtagctgtgctttcttctcccgtcttcagacagtgtaaataccttgctactctgttttcatggatgaattttatggcaataaatttgatgtacgatgtagagtagctgtgcttttttccccgtcttcagacacaagtcacacaactacgctgctactctgtttccaggggtgatatttatgcttaataaaatctatctccagttcttaatgttaccaaatgccgacagcaaatcagcaatgctcgtcatattttcaaacagacgctgattgtctgattagcccactgttcgatgaatcgtggaagcggagcaacatttctttagatttgcttctatcccctcaaaaaaaaaaatatttgtttcaactgctgttcttgcctgatttttaccatgtggtcagtagc

SEQ ID NO: 32513 - DNA, 586 bp, Oryza sativa
tccatttcacaatgtaagactttctagcattacccacattcatatagatgttaatgaatctagatacatatatgtctagatttattaatatttatatgaatatagacaatactagaaagtcttacattgcgaaacggaggaagtacttgttttagactgtataatcttatactgcataatcttgtacttgatactgtatagttttgccgtagcctgtaacacaggacacatattggttacttgtacctgtatatattgaaacaaggtattgtgccgctgtttgtatttttacaaatgggaatgatgttttactttatctttcatgtcaatcacttgaaaactccgaaggcagaaatttattagtgtccttgtttaagtcactgttagcagaaattttgtaggtaatttggtcctgtttatacataacaagtactccatcttaaacttaccggcttgcttgcaatgctgaagtggatactacaccagtacacctcatacaacatcgtaaaattatagctatcgatgtttcataaacttttccacctttttttaaaatttgctagcatgcttttttatgctttctcag

SEQ ID NO: 32514 - DNA, 959 bp, Oryza sativa
cctattaacttaacattttaagtcagttttttatatgatttataaattaatggatttaaagttttaagttaattggtgaagtcatatctctatcttacataaacaaaaataattttttcaacccagtttttggcttaatagtgtataagagtgacttatagctttagaagaccaaacaaaaagctattatttgtttagatttggagttttcgactcataagttgatttataagcataaataagagggatttgtttaaactggatctaaaaatacaccacgattacaagcggcgtcccggtaggcaaaacaacctaaaaaggcgcctgcgcacattgccttgctggacgacgctggtgcatgcacgcacgcacggcattgcagagcccgtgacgtgagggcgagctagccaacaacgctcacgagccgaatacaaccaaacgccgctccgtccggccacctccccttcctcctccatcatctcaccgggtgcgcttcccctccccttcgtacaacgaagatttgctattcgccagggcccaaccacagttatagctcacgtagccgctacaggcttcttcgccgcctcgtctcctcctcgatctcccttcctccctagaaaatctctcggatctcgccgagagctagcggctggctggcggcggtggcgcggtggcagcaaagtgtacgctttgcagttgctgccggcgcggcgcggcagcggtgacgacgaagagggaggaggagagaggctgtgtcgggtttgtgttgtgtttgtgtgtgtagtgtgagatctggagacggccgggaggatggcgcgcggcgggagcttctcgcggctgcggctgcgcgcgggggtcgttgtcgccgccgccgccgccgccctgctcctcttcgccgtcgtcgcgccgcccgccgcggcgctcaacatcggcctccagtccgccggcgacggcgcggt

SEQ ID NO: 32515 - DNA, 1501 bp, Oryza sativa; identical to SEQ ID NO: 32508

SEQ ID NO: 32516 - DNA, 1302 bp, Oryza sativa
tttttttattgaaatatttagaaaaataatttgtaatttcaaatattaccccctatcaagaagctcgggtgtagaatctttaaatctgcaatactttgaaaaatataaaaattatgtttataaatattttcataaataaataaatgaaaaatgaaaaaaaaaccttatccgtacggatcaaaggttccgatatactccttccgtccttaaaaaaaagacaaaccctgggtttccgtgtccaacgtttgaccgttcgtcttatttgaaaataatatgaaaaaaaattaaaaagacaagtcacgtataaagtattaatcatgttttatcatctaacaacaataaaaatactaattataaaaaaactttcatataagacggacacagaaacccaaggtttgtctttttttttaacggagggagtatgtagtaaggcccagcttcctgctaggcagcttagaagcctacaaaacaaaagcccaagacgctcgcaccacaataatctgctttccctccaaggaagcgtaaacgtttgtggctgaaactcgatgcccgcttttgcttcaaggaaacgtaaaaatgggacatttaactttatgccacttttaagatgtgacaattaattatttgccactcattgtctataacatgtgagaactcatatatctatgacatgtgggtttagtgataaataattttatcaccacattaaggctgtgttcggcaccctctcttctcaacatatatctcttgttttccgcgcgtacgttttttaaactactaaacggtgtattttttacaaaaaaagtttttatacaaaagttgcttaaaaacaaattaaactatttttgaaaaaaattatttaatatctaattaatcgcgcgctaatgaatcgctccgttttccgtgcgagcacttggttccgaacgccctaaagctgtgtttgcaatcatgggtttccaacatgtacagtgtgcacagaaaacatagtggtctattagcgcgtaattaattaaatattagctattttttaaaataaaatatatcaatatgattttttaataatttttgtataaattttttttaaaaaacacccatttagcaattttaaatagtacgtgtgtgtggggaatacgatggagaagggtgggaacgaaggattgcaaacacggccgagtggcaaatacggagtagttaattattccagctttatgcggtttcgtgtagtatcctgtagtccactcctgcaatccacccgccccctgtttcgtcaaacttctcatctccccttcccgtccgccgcca

SEQ ID NO: 32517 - DNA, 1227 bp, Oryza sativa
gttactctgttttaacttgtcatagtgggttactatactttcaaccgttgcgtctggctattgaattgtccttgagttgataaagtttattataaattaaaattcggtctgttactctgttttaaaaaaaagcgaggaaaaatctccagaaaaatcctcgttaggttctattactctgttttaggtggcatatataatacccagttttcaggttctattactctgttttaacctgtcatagtgggttactatactacgttaagagtccttgatgagatagtttctatccgtaaaaacttggtcagtgatataaacaggtggttaggatacaaatgaaaaattgcataagttttaggtgacatacataatacccagttttcaggttttgtagtaatagttcattcatttacaatgctgccatatgtgcatcttgttaagttgtgtgactatgttgctttgttttcttgattcaactccgtacattctgagttcatccttttaattatattgaaatatcttaaaagctgtacgtactggttttgacttttgtcaactattgaaatctagaatgctgttattcagacgtacccagcgggaccgtgcttgtttcaggtgctgacagatgacaatgataagtgtaagtttatataaacttgttcattcttgtagcccgtccttgttctccatattattactataccccatttcttgagacgggggcgctgtgatattgtacgaaaccactgtagtggtggttctgcaaccaagcgtcgttcttccatggggaaacattgcctggcggctacaccgcaggcccaggcccgctgcgacgttgtcttgatcttttgttgtaatgaaaccgattttccttttggcaaaattggttctatagctgagccggccaaaatttattaagaagggaagggtttatgcaaaattggttatagagcaccgaaagtcttatccaagtttttgtgagactcaaaaaagataaatgtctttaagacttttttgcaatgcggcttgctttgtgttcccgatgtgcttatgatcacgtattgtcgacaacggaaagccgtcagattgcgccatcaggcctcggcacgtagccctcaagacggagcagataacgagtagtagcagataagcctcgtgtagtagccgtgcttgttttgtgtggacacatttcgccccaaaacagacgctgcaaaacgacgcccaaaaaaa

SEQ ID NO: 32518 - DNA, 1501 bp, Oryza sativa
acgatcgagggattaattgtactgcgcatgttcgtggcgtgtgttgatttttgtatatatgcagtcgctttgtctcactgtcacgggtatccttcaacgcactttctttagctatgatccacatatcaaaatactccttctctagccacaattggagattaactctatgctctatgctctagcagtctagctctacgcctctaccatgcccactgggcagcaaaaccccataaacactgaaaagtaagaagtcagttgcacgcaggaaattttcgttctatcagactccccgaaatgatattattttggccgaaattttcaaattttaattatttttaatgaatttggcaatattttatttaaattttggttaaaagtgccaagtaaacgcaaatggatcctaaataaagttatttctaaatacgaatatgaacaaaatgaaactatttttacgtatgaatttgaacagctttttcagattcataggtagaaattgttttattttggaattggcccaagagactagaatctttttttattagtatcaaattaatggcattcaaatgtgagattttttttgagaggtcaataaaaagcaagatttgcatggattgtatttttgaagagatctcatagatttgatttggtttgattactgacggccgcttcccctctctctctctatatataagctacactgtttaccactgcaacaacagttccatcgcagtataagagcaaagagagtagaatcagttaaggaatagctatagcttgctagcctttttaatttccaatatccctagccacatatctcgatcatggagtttctaagtgtcaagggtgtaaaaagggctatgttgttggccatttttgtagtcgtggctatgatttatttgtgttgtgcacaaggtaattataagcattttattatcatctttataaaagcatatacacaagggctactctttctttctgagaatagatgttattgtagaatgcatgtagtcaagctcccgaattttttaatataataattaataaccccataattaaatatctggtaaatcaaagttgggatttttaataataggatggacgctgaagaataaagcgtccagatgtggacgctgtttgtaaaatcgtccagagctggacgctctggctaactacgtccagcatatgaccggtcgcctaggtcggtccggcggtcccagtacgaacataagcaaaatgaaaaagggaaaaaaaaaagaaaaacgggaagaggaaccgttcttggcgacgccactgcctggaaagtcctccatgcgcggaacaacgtcgcccatccatccgccaccgctgcgcgtccaatcgcacgaaggtgccggccgtcgcagccctcgttctcggcagctccgctgccgctgctctcctccacgcgcgagggcgacgcccgcccgtccaccaacgccgcctgcctcagacgcttgtggtggttcgccggcactgccacttg

SEQ ID NO: 32519 - DNA, 1501 bp, Oryza sativa
gtgtcgatggcgcggggcggacagacgtcgacggcgtggcgttgcccggcgacggtggtggacggacgaggggaatcaggatagagaggggatagaacctaatttagtgttctggagacaggggtaaattcgttatttcacgtgcccattcctcacgtgcccattccacgttggcaagcccatgtggcagtgtacagtgtgaaaagtggcaaaaaagtagaaaagtttctctatccaatggcatattattaactaaaaatttaagaggggtatttgagcaattgacaaatgtaaaagtggcaaatagttaaaatccccaataacgtgtgaaggcaattaacgtgtattccaattaaaaaaagttgaaccacctatattgaccaatgtagcataatgggctagggttaagtttctcttttcacttaacaccacctaattttaccatctttttcatgttggaccaggtttacgtgttggaccaggtttacggcataggctacgctttggcctaatccacgcgagcagctggtgtttaatttgctcatggtggcggtggtacgcgataccaggagcgtgtgcgacgcgtcgatggggtggtcatcagcgagggcgagcatttcgtcgtccagtggacgtggaccctgtagtgatcacgcgacacatctgattacgttgacaggatctgagactataccagaagtccagaactatcccattcagatcatgcatatgaagaaaaaaaagccaactattccatttagcagtaatcaagatcgatccgatcttttcttttcttgagataattcgacacgtttctagttaccaaccgaggaacacgtacgaattaattactctagttttttcgaagagtagagaggaatattgattaccccacaaaacccaaatctcatagaaattattgaatacattgctttgtttcactctcccaagtcccagggtcaaatcattcctccatggattgctccatgatcgaatagcagacgcatacctgtctacctcataaacccaacaagcatgctagtaacgagccagccgacgaccccagcgattccatcctcaggaagccatcgatcgaggtggcatgggcgtccaatacgcagaggcccttcgccctgacgctggcgacacgaccggatgatgagacttgctccaccttggcgccgacgaccacgtaccttttcgccccagccgtatgcaacgagggtcttcagccggtggacggtggacctagacggtggcgtttgtgcgccgattgttgagtttatgttgctgcacagcagtcacgtgtcaagggagacttttttgagttgggagggaagtactcatacggtcataccagagagggaggcggaaccgccgtcgagggagccctcgcagctggtgcccagagacggggactgtcggccgctagtaaacgtacacctacttgtgtgggtcgaaacccagccttacagtaaacatggtacaacttgtaaaggag

SEQ ID NO: 32520 - DNA, 1383 bp, Oryza sativa
ctgagtatcgctatcatcctcgtcaaccacagggaagtgaccgtggcagctaccttgagactgaaggaattgagaatgatgctaccacaaggcatttggttgagatgctgtgggctatggatgaaagtcgtgcggagactgtgttagcagctcaagatcgtgaagaccagaatcgtggtaagatttgcaagctcgaagacaaggtggatcgtttggagaaggaattagccgcgttaaagggagaagcaccgccgcagaaggccaggattcgtctcaccgcaaggaagagagctttatttgtcccacgctatcaattggtgccaaaggttcgtgtggtggagaaagaagttgccccagctcaagcggatcctccggtcatcatcataagtgatgaagaagaagaatccaagcgcaaccattccaagattgagtgggtagcaacccaagatgatgaagacgagccgaacgagccttcaatcgacctccgatgcttggaagaactagagtgacttgttaagtagttgtcttagatcattgtgttagtttgtttgctttaagtttgcttgtgtgtggctcgcatgtgatttacatcagtggtgggatgtaattgtgtcacgtcctgataaattcatcccgaaataaaaatcattccctaaaaggaataatagaattaattaaaattcgaaaagaaattggcaaacactaaaatacgtgcaagaaaaattcaaatgtagcccggagaatttttgttaaattctccttggtctaaaaggagccctcaaattttacttgaatttttagagcaccggaaataattattaagcaaaaaaaacaattaacaaagtttattaaaaagaaaaaaacctaaaaataaccccacaatcaacttattgggccaagtcaggcccaaagtcctaccctctctcccctcggcccgcggccgaagtctccctttcctccctgtctttctctccctctccttctctccctcctcttgggccccccttcccctcggcccagctccctcctccctctctctcccgggctgcctctcccccccccctctcccctcccggcctgcccggcccaggccgcctccccctcctctcctcctgggccggccgcccggcccaacccgagcggcgccctcccgcccgtgccgcgcgcgtgcgcgcgctgacgccgccgcctgaccgcgtggggcccacgcgccaggccgagtcatcgtcctcctcccgcccggccgtcctctctccctctcccgtgaaccctagcaccattcctcccttaaatccgcgcgaatcaagcttgggattcccaaattgattggggggaattaatcccctttcctcctctctctttcccccttaatttccccgtgaa

SEQ ID NO: 32521 - DNA, 1098 bp, Oryza sativa
cataacacaatccactgcagcgcactttcctggatcataatcacccccttataaacaaggcatggactccccagcgacccccgtgggcttatctccgccacttcacagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattatcaagttttagttggcacattatttaattaactaatcacgatcgaccatcgtgaactatcattaagccatcatgaaacaacagtgagtcattagttatccaaatagtgtgctaatgtttctaagcagggctaagcaattatatctagtatctagttgaaccaatataaataaagttcaaccagtcaaattataataacccaaggtatcaaggaataaagtaatcaagaacaaaagggctataacaaagaataggttgattccacccaatgacattcgaaaataaatgcaatagttgaaaagaaacaatagctttaaataggatcaacatgctcaaagggttgtttgggatctgtgtgacttgccttgctggccttggaactcttcaaactcttcttcggcgaaaacggactctccggaaacgacggaatctaagcagaaaagaaccaaatcaccaaaatagcacataaacaagcatgaacagtacatgtggatatttttaatgtgtagatctcaattttagaaaaatttagagacttgaaccaactaaatcggagctaagatgaattagttatgaatttttaaagattaaaccggattaaaacacttaaattggttaaaattgaattatgacgcaataatgaattaattttgaaaaggaagagaaggtttattgcgtcagcggctagggttttggtggaccgggcgcacgggcggcggttcacgcgaacggacggccgagatctaactgatccaagatggacggccgagatcgatcggtccacgaccggctcacggcggacgaccccgatgacgttagcggtgacgtcac

SEQ ID NO: 32522 - DNA, 1501 bp, Oryza sativa
accctagccctcttaaccgtttgtcgttttcttgttattctatggcttttattgaatttggatcttcctcttcttcagtggagtccgttatattttggatggcaacctgtgatatttcaaggatcggataatcaggttgcccatctcggatttatttgcgttggagcaaggcaagttattattcctctcctttgagcataaataccctatattctatatctctgttctatgcattagtcatacatgatttcaaatgcataacctgaacatagcaaaccagatatgctagattttgcttagccatgcctagttagattatgcataaaatttaatgaacttagattggaacagtacggtagaaatggttgatttccgggtggctagtactgttccaaccgacataagattgccaagtacatgtgaagaacatacgagtacgaccgcaattctcgtatgggcatagacctagctgattaagttatctagcaaaggtggtacctctgtatagtggttctttttaagtcctcgcgcaggaggcaaacttacgctgaacagggcaattgtgatatttaccgaggcgcaggtaaatatcttgattatctcgcgagctgtgtgtgtgaattatgaaaacctgattgagatgacgggggtctctcaaccagttctctctaaaaacctcgggaacgccagaactcctctcgctactgataacgttacgttcagagcgcatggggattatagttcatggaacaggtaccactgatgttagtaaccgaaaagctttgccatgactaagctaatgaatattagcatgtcatggattgcgggtaaagcgtacatctactgcagtatgaatattatcaaaactattcgaatagccgtgctcgcggttatcgagcattgggactcactatggcatcttggttagaaacataatttcaaactttattaaatactgttgcatatcaaacatttcaggatttctacttctttattctcagctttctgcaattaaacctagctctactcaaatattaccatttcatacatttattattgaatataatagcttgctgagtacgttgtactcacccttgcttcaacccccatttttcagagtctatcttggagttcttgccgaagctgggagttcaatcatataagttaatctcattttaacttagttctcaagtatagattagatagatggtttaagtctatagcaaaacattagagttgagtcattctatagcttctgctgtaatagttagccacaagcttgtaaatacccttatattttgtaataatatctcctttgaaaccttaatcaaatatatgcaatgaagatccagattgttgaacctgtatcaatctactgatccagggcttgatacagtctaaacatgtcggtttccgaatcattagttttgggacccgacatccttcgtcgtcgccgtcgccgtccgttggtcttccgccgctcctttggtcaccggtgagt

SEQ ID NO: 32523 - DNA, 1501 bp, Oryza sativa
gacagttgcagggagtagctagaaagacttccatagtggaaaagcgagattagtgaggtcaaacaaagcacgcagcagcagcatctttaacactaaacagaagagccctttctccagaaagctgtcaatgtcctggattcactgtggccgttataaatagccggaaaaatttttaattgtctctgatccacctctacggccgtgcatgaagaagttaataacactaaacagtgatttagtgcgttgagcccttcaccatggacataataacagtttgatttcactgtggcttgtctcacaatttagccaagcattgtgtcggtaagtttgaaacacagtggtctcaaaattcagataggagtagtccaattctggtggaagcatgacaaattgacaattgacaaatgctaatttgaacaacagtccggctccaattaattatactcgattatacaagaaatagggcaaaaaaatatgaacaaaccaatattggtttgtcccaatttcatcaaagcatgaaaaaaaaagctaaataggtaataataaaaataataataaactgtacatagggatggaaaatactaagatattcactctgagagatgttttgctcctcttatggctcaagttttggcatctccattaattttcgtgtccaagagtattgtccataattccttttgccggaaaactctctgtgattcctctcctttcactaagaaatagggaaagtcaagattttatttgaaaatattctaagattcttttgtgctggaattttattaaagcaaaactatcggttaattaaaaaaaaggaaaacatgttggcggcacgaaaatgtcacatgtgtggatttgtcaaggaaaaataattcagatcgaatttctcgaggaaaataaattcagcagtccgtacttcactgtttcgtcattccaataagtgaagcctgtttgttttctctagcacatattttatttatttttgttaggacaaaagcgttgtaattgcttgtttgaagtatatttttaccgtggggattgtgttaattatataatcataccttttcaaagaaaataaaaaaaacttctcatagttccctattcctatcggttgtaaaaaagaataagccaaagtaaagattttaattttaaaacataattttaaatttgatttttagatagttgtaaaaataattttttcggcgatactaacttttaagttaaaatttttcatacctaatactccctccgttacataatataagagattttgaccttttacttgtactgtttaattattcgtcttattaaaaaatattagaattattatttattttatttgtgacttactttattatccaaagtaacttaatcataacttttcttttttatatttacataaatttttttggataagacgagtagtcaaacagtgtaatcaacatatttttatcgctagtataccgttacggtttacaattaattttcgggcgacgcacga

SEQ ID NO: 32524 - DNA, 294 bp, Oryza sativa
tgcgggcgcgacggcgcgagcgagatcggcggaaggtgggggaaggacccgacaggtgggccccacctgtcggcgaccccgggagaggagggcggcgggcggcctggctgggcctcggcctgcggccggcccagcaaggaggagggggaaggaaaggagagaatgggccggcggcccattcgaaaaaggaggaaaaagagagaaaaagaaaaagaaaaagaaaaaggaaaaaggattttccctggaattaaaatattgcttgctcaattttaattggttaaaattatttctaga

SEQ ID NO: 32525 - DNA, 1117 bp, Oryza sativa
tcctgcagccctttgttttagccttcccccgtgagtgccttggtggcgtgagcgtcacgcgccggtaagagaatagcggttccggtggaaagttcacgtgtctgttctatttcggcaacttccgctttgtagtcttcctttggaagacatgagcttgtttcacatatttagttcaaatttctataaaatttcattcatggtagtattggtgtggaggtacattcgattattaggacatcaatttgacttaactctgtttaagtcatatacactcaatttgttaaatccaactgcccaaacactcattgcatcccaatcatcctccataaggacatgatccactcaagcaaagaaaatgcccagccccagccttgtggtttgcgtatactctctgccacagctttcgcaatggccggccggtcgaattaatgtacaccatgagttcgtgatcattaagccgctcatcttttaatcttgtcttccaagctacgtactggactactggtcacttggtcagtgcctcagtgggcacctatgaacagtagcattgtataatacagcacagtagaagtctgaaccttcacatgccacaacactcgaatacagaggcctctgctcatgatgctctgctaccctttggtatcgatgacgcatacacgctgttacgcatatactactaccgggatcgatggatcggctgcatctgtgcatgtgcgcaaacagttatactagtagccatctgcaagcaagatcttccgttgaatttcggtcgattttatgttgcagcggcgtgcacgcattacaggcgaaatctgtgtctgcatcccaaagctaaatgcacaggagaagctaggcatatttaagtattctaagctaagcgattttccgacaaaattaggccagacttgaccacaagctgaccttaaattacgtgtggttgccggttaatacagctccggcgtttgacggtggtcggagaaccgtggagtaattcacgatcgatcgaccagtgtaataatcgaagtgatgcttactcgacgcaacatccactaatccactcctgtcgactcccgtagtccatatcagcatgacgtgatcatgaagcaggcgtatatac

SEQ ID NO: 32526 - DNA, 1501 bp, Oryza sativa
  unsure (1)..(1501): unsure at all n locations
tgcagcttccatccgcgccgtgagaaacaagctgttgtataaactcgtcaatgtacctctcatggagttccttgtcagctacaagctcttgcagcctgatggcgtttgctacaaacaccctcctggtttcttcctcaaccatgacggcccggaccgcggcggcgacgccatggcggtcgaatgacccgtccatgtcatcccgcctcacctgcgatcctaccttgttaccctccatgagccgcgcgttcggcccttggtccccgaagatgggcaacatgatgagagggttcccaaacagaagcccctcgacgagcgagttgcgcccacagtgcgtcaagaaagcgcccaccgcggcgtgcgccagtatggtgatctgcgaaacccaccccatgcaaacatgtccatggctcttcgtcgtttcttggtaaccggaagaaagnacatctgagagatcgacgccatggggctttctcagcgcccacagaaatcgtgtcccggcgagctccagcccgagagccagctcgtgcacctgctccaatggtagaggcacctcgctccccagcgccacgtacaccaccgacttcgccggctgcacgtccagccaccgcatcgtcgagttgtccgtcatgccggcgcgacggcggcctccgtcgggcgacggtggcacgaggccgagggggatgagcggcttgttcttcaggcccgccgccacctgctggaaggcgtcgggctcccactccgggcagctccgcatggccgccagcgtgcacctctccatcgccaaggagcagcgcttcgcgacggacatgcccgacgcgccatggtcgacgaagaagcttgccttctgcgcccactcttaacatggcacgccctcccggcgttcttctaccacgccgagcacttggaagatggaagcgccggctggctccgacgaccgggtggcccatccggccatcatggaggcgctcgggagaagcatcgcgcatggcaccttgtgctggagggcgaccaggggtgcccagtggtggaacgtgtcggcgatgatccaatcaggcctctcgccggcggcgtcgcacgcggcgcccaggaactccgcgaacggcgcggcgagggcgtcgaaggccttccagaggagctcgaacttgccggagggaacgtcgttggtgcactcggtgccgtccgggaggcgcgcgaggttgcgtggcgtggagacgaaggacacgcggtggccacgcgacgccacgcgctccgcgagctcgaggtaagggagcaggtggccgaacgcgagccatgggaagatcacaaggtgcagcctcgacgaggatttggaccggccggtgtccatggcgatgttgccagatacagaggagctaaaccttaatctctcgctgtctcatgaataataaacaccggtagagataagaaatcagcaagaaaccatatgcattagctagttgttctttatataaccagtcttcaaataatgattgattttattggt

SEQ ID NO: 32527 - DNA, 328 bp, Oryza sativa
attatatagcatccctcttacatctacttcctccgtccaaaaaaaaaagctaacctaggagaggacctggatagacctttatccagatttgttgtactagaaagggcacatcggcagagggagtatagtagtagtatctcgctgtagctcgcattaataaaggagattcttacgaccgtataaaagagaatttgttggtacatttgggataaacgacacaatcgccggggactcaaaagttgctgacatttgggatgaaccttcatatatatgactccgtataatctaatactcctatactgatctactttacacaaagcagagaaca

SEQ ID NO: 32528 - DNA, 1235 bp, Oryza sativa
gggaagcggcaacggcgggggcagggggaggaggccggcgcggcgagcagcagtgcctaggcggcgagggctccgcagtgctccccggcgctcccctctcccctccccgtccagccctccccagcgctcccctcttcctctctctcagggacattttgggcacaaaaatctttaaagtggcatttcatccggtaggcaacgtattgggtggcattttatctggtgcattgtattgagtggcattttatcttaacacaacctatagagtggcatattgtccgctttctcgttaagaacagtgatatgcagtttttactgtagaaagtgttaaggccctctttgtttaggcttaggcttatcggcctagacttttaagtcagcttattggcttatatgatttataagccaatggatttaatgtcctaagtttagtggtggagtcatacatctatctcatataagctaaaaaagcttctccaacctagcttttggcttaatagtgttatagtggcttatggcttaaaaaagccaaataaaaaagctgcttgtttgttttggcttagacttttcaacttataagttggcttataagcctaaataaagagggcctaagtatactgtcaatatactgtttatggtgcactgtagagattagtcttgtccgttcgctgtcgatcggacggctgagaatacctcaaagtcgtaccaccgagcttctctaacttcactggatcccaaattcccaatcgaggaggcctagcgtggcctccatcgtttcgctttttttttaataagccaaaacggcttattagtgaataaaattgtatttgtaggtaaaacttttatatacgtgttctcggtgacttaaaagccaatgcttaaaaagaaatcacgttgaaaatatcttaaaataatctcaaaattaagtttgaaaattcaaaatttgcctttttttttcttattaggccatccgataggagtcgttgttaccgaagtactgttctagtaatacagaaatttatcagtatcctattcattcttaagttcttaatgatacccgagttggaccgatgagccggtggcggtgaggtacagaagactagaagagtagtggagtttacccgcggtcttgacagcaacgccgctcacctcacctctgctctcctccaccccgcaactcccggcagccgccacgcgcgcgcacgcacgccctgtcgcgatgcactcgcaggctt

SEQ ID NO: 32529 - DNA, 1364 bp, Oryza sativa
ccccgccgttgccgcttcccggcgaacacgcaggtaagcgtgcacgctgccccgtcctccttccccgcaccgtcgcctcctcctccctctgccgcattgtcctcaccgccgctcgcccgccgccctatcctcctctcccgtcgtccctgccggccggcgccgccaccacccggtgaggcctccaatgccgcctgcccggccctccccggcgcttcgctctccttctctctctcttatatatatagggacattttgggcacaaaaatctccaaagtgtcatttcatctggtaggcaacatattgagtggtgttttatctagtgcattgtattaagtggcatttcatctgaacccaatctattaagtgtacattgtccgttttctcgttcttaactacggcactagactcattttactgtgcacctttgccgtttgctcctaaagtcagaggagccgaatccaggcctgctcagcacaactttgatttactagagtacctctattttttttttaactatggctatgcaaacgagacttaagctaagactttgcttgagagcccgttcagcttttataattctctcgtttatcatgagcacgtctttcaaactttctaatcgataaagattttgaaacgctagtacatttgaaactaaaacatttcaaataaaggatggacagaacgagaagaagattaattctaggatgggaagaccaaagaccaaaggcatgttctccatttcacaatgtaaaacttcgtagaattggccacattcatatactacctccatattttaatgtatgacaccgttgacttttttttaacgtttgaccgttcgtcttattcaaaagttttatataattatcatttattttattgtgacttgattcatcatcaaatgttttctaagcataacataaacattttcatattttcacaaaaaaattgaataaaacaaatggtcaaacattgctcaaaaagtcaacgtcgtcatacattaaaatacggagggagagtacatattaatgagctagaaagtcttgcaatttgaaacgcagggagtagcaaactttcgcataatagaagtgtccataaaacaaaatcattgttcatataactcgtgttttattccagtaaatatatacacgcatgatgcatgtcttgatgtcttctcacactaaacataaacaatagtacaagagtacataaatcacttaaagaaaatgtagcggtaaatagtgaaatcgatagcacgggtgcctgcattattgattattgatgccgatcgatttgaagagttgcatgactggttttaagcagaaggagcattagagtcatcgtcgtcgtcatggtgatgctcgtca

SEQ ID NO: 32530 - DNA, 267 bp, Oryza sativa
cgaattcgagctcggtacccctaatacccttttctaaagttatatatataaattataatgtagttatataaagtttaaaaaatataattacactataattataattatattgtatttatgtttaataactttttagaagaagatttatcgactagtcctaaacagaagcagacacataagctaggggacaattttagtatttacaaagccaaactttgggacaaatgcgagcacacctcttaaacacacccttaactaaactttagg

SEQ ID NO: 32531 - DNA, 1501 bp, Oryza sativa
atgaccgggaggaagggaacaaggtggtggatgatggctatgccgacctcgtcgcctatgggaggctcttcttggccaaccccgacttgccaaggaggttcgagcttaatgcaccgttaaacaagtatgatggatctacattttacacacatgatcccgtcgttggctacacggattaccctttccttgaggagaagaaagaggactcagctacagtaattgtttgattatcacctaaatcgccgagtttttttttatggatcaataatgtgtacttgtgaaacacgcatgagtagatttctgtgcatgcatatttgtaatttaattaaggttatcttttgttgagtatttattgtattgatactgccaaatatatgggttacatgtttcgttgacttgttttacccattataatcatcatcatcatcatcatcatcatcatgtgacaaatcagagacctaaaaatgtgtacattaaatctattgatcgagatcacctccatggatccacctcccccgccctcccctatcctccctcgtttcaagtcggccccatatcttgttcctctctcctcatatctaccaccttggcgccatgccttcaaaaccctactctcctttgtcggatctagcctgccccacccaccacatcgtctagtagcgtcccccgcttcaatgagagtctatatcgcaatctatcaggagagcctctcctggctcaccggcgaggttgatgacaccgtggttgatgagggagtcaccgtgtcgttgcctacggcgattctggcgtggggtgaagatcacacccacatatcacccttgtcttggtggctgatgcagtacttctcccccgccctgagccaccttatcctaattaatgaggtcttgttggcctgtttcccccattccttgcggacctttgcttgagaaatggttcccgcagggcactttgtgtgtcaaatttgttggtgcgtgaatctttacctcagtagcttgggtgtctcggaagatgtgtcattttcctgtcctcgacataccactaatctatccatatatgttctaactaggagatttgctccggttcagcaaaaagtatattaaggtaccagtatctcatggtaccaagttttcgattattggatatagctagacaggatgggcattgttagatccaacgatcggaaatgatttggtaccgtgaggtaccggtagcttgatgtactttttattgaaccgaaacaaatctctctaactagacattgtgaagaagcttccattgctacgggatgggtttttccgtgcggtcaagaaaaatttcgcgtgcggatgaatggcccacatgcaacacttcgtctgcgaaaatcgtgatttttgcgtgcgggtggcgccccacacgagaaaatcggatttttccgtgcggttgcttatgtcgcccgcacggaaaaataaaaatccaaaaaaaataaaattcacaaattaccgaaccttaaccctagatccgc

SEQ ID NO: 32532 - DNA, 1501 bp, Oryza sativa
cagggagatgactagacgtggtgctctggttgatggcggcagaagcgattggtgatccaattggtgggtcggacacttcgagcgggtggctcggactttccggtgagctactctcaatagggagacgtgcggccgcacgctcgggttgattgaagctggaggcgatcggcgttctcggtgggtggatcgatcactctgggcggggtggcctgggcctttcgatgagttgcgttcgacagggagacggctaaacatagcactcgggtcgttcgcggctgagaagacggcatgcaacttgtcggcttcggctcgcgactagattgatggtgtttaatcggaagtcggagcgggtggttcctagaggcagcttttgaaggtgttgatgaggtaattgcgtgatggacatgctatagagaaggcgtacatacgacaagcgatggaatcaggcagaggggtggtcaattcagatcgtcaatgctttattcaatcgtgttagtacagcaaaggcattggttgcaactgaccggcgatattggtcgctggcgaggttgggcgggatgttggttggctgcgctagaggtcgtacgggtgcgtggtggctgaggaggtcatcagaggtggcggcgtgcacgtttgcatgtcgaagccgtagactacatgtgaccggagtccagaggtagcaagatggttctgttttgggccggatttacgcaggagaccgactcgggtttttgcaggcacagcggatagactcggattacgagtccttcctggctacgcatggaaaaagccaaaccggtgaccaactcgtacacggaaggggaacaaagagtttcttcgatttggttaagaattggactcgaatttctccaaataaaagcagcagaggaccacgggattgcaacaacaagcaatcgggcaaactaccaaagcaaggcgagatctgacctgttggatttcgtgggcggaggtggtctgcggtgtcgggctccggcggcgctgcacggttttcggcgagcagcaggtgcaggcggcggaagctcggcggtgccggctcttggagaaggcggcggacaccggcggcagaggaggcgtcctctcctgcgtcggggcagcgtcgtccatcaccgggggtcttcagaggcgtcgacagcaggacctgcaggcatgcactcgaggacgggcgttggcggcgggaacctaggcgattttcgacggcggcgcggtttggtggtggggtgcggcggctctggtgctcggctggtcagtggggagagaggcacggcaggcgctgggcggcggcgccaatcgggccgagaggagtcgggcagaaggagcaagaaacgggattcgatttggatctgtaaccctttgaccgcatcaactgattctttgaccgagtaaaggacacctgttccggttttttggagagagaaaaaaaaacggttcggtccggctggtactgttcgagttagtcggtggggtcaattaatcagggcag

SEQ ID NO: 32533 - DNA, 173 bp, Oryza sativa
agtcaatgccttcggaacagttaccaatgatttgctgttgttcaactcagtccctcattattgtcaggtttgtgcagctccaatagatatcagtcgttcctcagaggaatctttcaaaggagttactcctgactggtggattaatttgattgatctgatggtttttgtgtaga

SEQ ID NO: 32534 - DNA, 407 bp, Oryza sativa
tgtgtttcacaaaaaaaaaaggacttaaatttacattagttaatactactactgctcgtgttggttgtggagtagtagtagtgctccctccctattgactttttaacatatgtttaactatttatctttattaaaaattttatgtaattattatttattttttattaggacttaatttatcattagatgttttaagaatgatataaatattttttatttacataaaagttttaaataaaacgaatgatcagatgttggtaaaaaaaatcaagtacgttatatatcaatttatactcgtgttgatttctcaacgtgaggcggtgtagcacaaacgctgttgcatcacgccgtgcactggagcacataccagtgggtacactacaccccctcattgtttgttttgtagc

SEQ ID NO: 32535 - DNA, 384 bp, Oryza sativa
atccgaaccagttgcagcgagctcactcgaactctgcactggcctcacaagccaacagaatcatcatcagctgctgccttctccagctgcgaggcagcaggatttggactctcttctctttttagagaagcataatttggacttgtgttttggtcctatcaacacaccactctgaaatatcgtatgtgatacacatgcttaagcaaagtagagtgatcactatgtctgaaatctgaatgttattgtgacctatgagcaggttcaggtggattggatagttgttttttttccaacttctctgaacaaaagggatggtaaaatctgaaaattgtaactggaaagattatgcagaagtgagattaccagtgtctagattgccaatga

SEQ ID NO: 32536 - DNA, 296 bp, Oryza sativa
gagtagtagcactagcactctactagcaggctagcagcacagttcatgagctgtgtgagcagtggcgttcgttcagagcatcaaaggagaggcagctttcctacgcctgcaggctgcggctgctgcaatgcagcctgatgcctgtggccgccgtacgtgtgcaccggcggcgacagggaatccccgaatgtagagtcaaatccctcatcggcgccattgccattgcttcttggttggtttacagtattcgcagggccatgctctcgcgtgcctgtgagcatgtgaaattaacaagg

SEQ ID NO: 32537 - DNA, 180 bp, Oryza sativa
ttttctattttccccaaccaagccaggcatgacgggggtggtcagcaagcccctccgagctcacctcaagtccaccatgtcgtctcctgcgagcccctctgcgacggtgcattgtcctcttcgcctctattcctatctcctttgttcgcgcccacgctcactggcatcattactattggt

SEQ ID NO: 32538 - DNA, 1501 bp, Oryza sativa
tttcagctcaaattaatagttgttgaccaatgtgtttcagctcatagaaatagccaatcatgatcaaaactgatatctagtgccacataactttgttgcttgatatttaaatgttatataaaagatgatacctttttcttgtttgaattgccccagtcaacagcgtgctttatggagctgcacttattgtcatctcgaactggccaataatgctgagtgggcatcagcacccttgaaaagaaatcatagtattttggtgtaacaaccagtgtcattgaattacacgctagaatgtacttctcactgactgaccatgctgatccttcaatgtagatcttgtacctgtcaccaaacacaatggtcagtactgtcaacaaagcaaaatgactcttatattccttttaacaaaagaaaacacacctgtgtgtgcattgactagccaaatctgactgtttgtatcctgccttactctctttgatccaatcctgtatatgagaaacatgcgcaaaatagctaatcaatcataaacatcatcataactgttttcttgataaataactcacatactaaaatataattattcttttaaaaggaatatgaaggactaaacttgcgagaacaggggactattaaacttaattgaagtgcgactaggcacagtaaatcataggcacaaatacttgcctgtttgtaaattcgtgcattccactcatgcttactggagacattacacttaaccagctcttttcttttagttgcaacatctggattccctttccagtaagcataaggctctctatccacccatttcaccctcttattgccaatatccaaatccttctgcagtgcatcccacggctttatgttgatctctggcctatcatcacagacagtctatttaagctctggtgctttgtccgaatgaaagcgtaaaaagaacatacttaattttggtgcagtcttaggaatgatctttaatctaagcactgcaatggtcaagcacatatatttactgtgtcagaaacacagcagcagacataaacatgtgcatcctcccacaatgcacactgatggtatgcttactggacctgactatcatgaagaacacaatcattgtgctacttctagtaacagtagcgtagcaataacagcataggaaataacctgtgatttgattgtgggatattgggattcattctaatgttaaccagtagaatataatgttaatctgcaagcactccatcaagaaaaatacaatgatgtgaagaccaggagaagtagactaaccaaccccagaaggaccagtccgggaagacgacgtcgagcgtctcgtcgtcgccacagtaccggaagagcggcggcatggcggtggcgttctccccctggtaccgatcggcttggacgacgggccagtcgacgcagtcgaacatgaggtcgaggtcggggacgcggccggggtaccggcggagcagctggaggatgccccagatggtgaagaggt

SEQ ID NO: 32539 - DNA, 1501 bp, Oryza sativa
gccatcttagacgccgggatgggggccgctccccgggcctatgcggcggctgtgacggtcggggaaaggcgacagcggcgctcgccgccggctgccgtgcacaggctggccgtctccctccgctgcttgagagcgaggaagaagagacatgtttacacccaaatttggcacctaggattaaaataggaaagatgaccaaaatttagaagtctaccggttttctccgagtgggccgatctgaccgccgtgtgttgggcggtcagaccaccggttgagggctggtcagaccgccggtgtgtggccggtctgaccggcaggtccaagtccgactgtgtttcgtcgggtctcgaggtttccttgctcgggaaagcatgtttcgggtttcctttggtttctatcccgagttggacgtggaggagggcctgtagagggcaagatcaacccctatataagagacatggccggttctattgtaactaaccaatctacagtcaatcaattgaatcgtttttcatattgcttttagttttctcttagtttgtctatctttctcggtttgcgccgtaaaccgttcgccaccgctgcgagagtgcgacatctctttgtaggtacgtcacggtgaacgagacggcggagcgcgcgctgttctactaaaggcgaggccgacggcggctccactacgtcgtccaaggcgcccctcctcctctggctcaacggtggccttgtctgctcgtcaatccggtacggcgccatggaggagctcggcccgttccacgtcaagagcgacggcgagacgctcagcgcgaggatgaggtggccaccagtgttatcgcaccacgtcgtgctgacctcgccccactgctctctgaggccgtcatgccgttcccgacgatgtcaacgggaagggggaaaagaagaaaggagaaggagaaaaagaaggaaagagaaggggcaatccgggtatttagaaaactatctcacctcttttatccctggaaataataaaataatgcgaccggtgttctacggccaattatacgcatttttagtgtccattagctgtgttacgttttttagtgttttctagctaattacatgttttttacgtgtcctgtagcaaattttgccgaacaaaagaatagggggtatagagaaaacgaaagaaaaaaagaaatagagaacaaggagtgtgaaaatgaaaactagtcagctagataggagaagagaaaaaacagagaaaagaatatgggttacatttaaaatgaaaaaaaaaagaaatagaggataaggagagaaaacgaaaaaaaaaagctatataagggatacagagagaacgaaaaagaaaatagaggattaggagacaaaaccaaaaaaaaaagaaatagaagataaggagagaaaaaaaagaagttatataggggcacaattggggctcgaacctagcacctcttgtctcatactctctccatttttataacgtaagactttctaacattaccca

SEQ ID NO: 32540 - DNA, 1501 bp, Oryza sativa
cataaaaaattgcaaaaaatcaaaattttcgggcgagatgtgagcattttagtgggggcgaaattttagaaatttcgaactgaaatttcaaaccctgcttcacagacgcgggaatgataacaatccggcctaggtggggttggccgaggcccaacaaattaaggttgaccagaccccaacagttcttagggacacccactcagggaaaggcccaatctctctaaaagactagtccaataggggaagggtggctctctcttttaaggtagcttcctcctcccaagctaagcaaggtgggattatttagagcctcacacggtcgctgtccgacgttggtgtctttgccagcgggtaatagtggaggatgtcctcatcagggcagcttggcggcatccgcgttgttgtcaacaagacctcctgaatcggcatgaggcggcgtccgcggctactctgacgatctccatcacgatatgacgaggtgcactactggagaaatgctttgtactcctaattggtaacccctgtagtcccggttttctaaccgggactaaagtttagtctcggttagtcctgttggttcaaatagtcccgttgcttttataaaccaggactaaaaattgttttttgtcccgatttttaatggagcctggactattgtagaatttggtcgaccgaccaaaagatggtttctccagtagtggtggcgtcacgatggcgattagtcgacaaaggcgagcactgcttggcagcgcttcggcgactcaacgaaacggttgatggcacggatggagtagatgacaccgtgcgggcgtgagtgttggcgctccggctgatgttctcctcgagcggctcgacgatgagtgtgaggaaaatggcaaagccgacgagggcaagcagacgttggtggtgtcgcgaagaggaggctgcgaccggcaagttgacgacgtccagcgtctcgatgacatatcacatcgcccagctagagacgtcgtgaggtagagattgcggccggcgaggcgaggacgtcgcggcagcaggtacatgtgtcactggtggccggcgtctccgacgagagggaccaacacgatctccggcaggcagcaccggcaactcgtctcgtcgccatctcgtgcacgcatgatgaactgaactgaaagagaaagaaaacaagaagaagactcaagaagctatatatatccatggcgatggctgactacgtacgcgctcccctccgtgttctgcgcagccgctgtccacgcgttctgtccggccaccggcgtgcagcgccttgtcaccaggacgatatatcgatggctgtgctgtcgcgaggtgtagatgggctgtagctgaatatcgatgaaggtgtggatgattctgaatcggaggtggatgttgtggttgtgcacttgtgctgtggagtgtatgtgaaatggctatgtgtagtgtgaggagatgaaaggaatggcagtggatgatctgtgtggaatggcgcctgtcgatg

SEQ ID NO: 32541 - DNA, 687 bp, Oryza sativa
gtggatctccggtgtagtctccgtggcatgcctacatcggcggcgcgaatattcagcaccggcttagatcgatggcgcccctcgccgccgggcttccgtggagagcaggtatgcttccgcctctactcctaggtcggtctgcgccgctgttctttggctccgactgaatccatccaacaattagttttgtaccatatcgccgattctgagacaacacgacctgtttattagctcgatttgattccattccatcgccaccccagaggcacccaccccgactgcaatgggcagcggtagggcgtgtatccgcactaccgtttcagctgcaaaaaaaaaaaaaaagcagtgaaaagatcccctactggggcacggcaggcgaccccctgccaaaaagatgccctatagaggcacacagtcgggtctctcggtggaggcagcgctagacactagcgcttggctttttgaaatttgtaacattagatttttttcccctgttgaactcatagctactcatgggataattgaaccaattgcaaaaatagttcgattacttcgtaacactcctccatatacaacatactccatgcgcacaataatctgaaaaccgtttcataagcagagagagaagcttaatgtcttcaaacattattaagatagggtaggagaggagatgtgatagtatataga

SEQ ID NO: 32542 - DNA, 520 bp, Oryza sativa
tctgggcctggggctttatctgcaggaataattctaatgagagtatccatttcctgagtgaagaaaggatccacagggttgtccagacaaacatgatcagggaaaagctcattcaaatcaaaccccattgtgggcgaattagagacacccattctttctctaaaacttttatagaacaaagctgctttctgctcatgcagggtgaccacctaaccatcatggtcctggatttgggagattgagttagctctatatatttatgtagcaatggactgaaagaactttgtgttttcttcacccagcaacatccatctattggtgcatctttttttccagtacattttcctgaactctaagagcttaattatgtggcactacacaatctccctgaaactcctctcttgtcagagacctggcctcctcaacaaggtctagaaaatcaactgctcgattgcaatttgcaagcagaacatttagtttagataaatttttgctccagcttaacaaccttttcctaagc

SEQ ID NO: 32543 - DNA, 412 bp, Oryza sativa
attgcaccacaatggccaaagggatcctaaaactcttttgtcatcataacataagccttcagcaacttgcttgagaaccaccttagcttgtcagaagaccccgtgggacggctcgcagatttggagccaagatcgaaccctagaaccagttagtcaacttgatcaccattctggctttaatggaagccactttcatcaccattttttacacaacttattcagcagccagacgattctcttcagtttcttacatcttccaagaatcaaagtcactggcaagctagatattgtttagttgtttagacgcgctcgcacaaccaagtctcccttcacctcagtctataaagggcacaccatttgagacacagcacacccactcactctgctcactctcccataccaccaaaagcca

SEQ ID NO: 32544 - DNA, 1501 bp, Oryza sativa
ctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcatcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggaatgttggaaatttggtcataattcggcatattttaatccaaaataacaagataataatcatgatatttacaataggatttgatccagtgatagtggtgaatgtaatcaacatgagcatgcttaacgttgaataagcatcaacaatcatgaattcctagcataatgagccttggaatttatttgatttaattgatttaaatggattaattacccaattaaatctaacaatgtgtacctagaagttacatatttaggttaacaagttcaatgcagtacttcacaactttcagaataaagttgtagtaatcctttttatgcttgtactgagatcacgagcagaatatatctgagctatgttagtatatatagtaattcaattagagataattaaggcacaaaccgcaactcctttgataggatcaccatcaatatatatattgcacagtttggtttgatcctgtccactcaatactcagccctaaccttatctgaatttacttggagcagcaaaactgttggtttgatgcaatcatggaaccaagctatcgctgcttgctgcccactgttgtccactctcatgtccatatagatatatatccctaattgtggaccatctgtttatctggtatatattgatctgcatttaattatatagcctctctatgatgtgcaaacctataagaagcaacaaaataaacaagacaaaaaatcctaaaaggttaatatactcgcactgcgcaacttactatgcctatatatatatgtgtctaattcaaatgtttaggctattgaatgagaaggggtacctatcgatgaataaatgtgctcgtaaatgataatcaaaaagagaggaatttctccatggtaaatacccttagcctaataatagatgcttaattccgtggtttatggttgtgtgttgatgaaattacgctaccatatgaaagttggatatttttggattagcatacaaatctacgtctctaaaccacggccctttcaacttattaacttttttatataaattgag

SEQ ID NO: 32545 - DNA, 542 bp, Oryza sativa
ctcgccgcccgcggccgtgtccgcgcgcgccgtggccgccgtcgccaacctcctcgccatccgcgacacggagatgagcaggtggagggggctagggttctcagtttttcttcttcttcttctgcgtgcttaattctcgaatgaataagactatttgttctgccattcgcattgccagtgagagatatgaacatctaacaagtcgatctgtttagcatatgcggttttatcctcggcattgggtgaacttcgatgaagttgtaattccagtaggcagttctgttatgcgtaatgctgttagtttagtaggccaaatagcaggaacatgtaatatgtctggagcacatgctagtttagctttcatgtttggttctaatgcagacaaaaacttagtttgggatgcattattgcaacaagaaacaaacaatttgatggtggagaacagtaatgttaggcttcatactttcatagtgagtgttctggtgattctttccttttgttttcattgttctctgattactttgaaatggtggttgtgcagc

SEQ ID NO: 32546 - DNA, 1501 bp, Oryza sativa
cagctcagcattcagctttcttataactctttattatacttgctcttatatttttatagtacaaatttcaaatgttataaacgattatattttagaacggatggaaggagtggctttctatgctatacctagattttccacttaaaatagactagccatccgattattgtgtcgaattatctatgttatagagaataaattaaatattttaataaataaatttaacaaatagaagaacattttttcacaaaaaacattattttaaaacaaataaatggataacaagcaggaacttaatatttattactagagaaaagaaatgaaggtgaacacgcagatcaatacaaattggcacgcacacaagttggcgcctgggcagcgacgccacgagtagtctaaaaaataacatatgtttagaagcatggaacatataatttgtaacaataatccaatgaagtaggtaaaaaaaaccatgatcctaattgaagcggttgaatatacctctatactccatcggtccctaaaaactctcttaagcttgaaaatttgttcattaaatccgttaaatactacttgatctttttctttttattttagccatcgaaccaatggtacttcctgtcacaccccaattcggtaccgtcgtacaacggcacctgacaggagcgtgtcgtaggaaaaacggtgcgaaccgcttcctacgaaaccgcaatctcagtaccagtcctaggatatagcgctggtacccacggtgataaatatgaatcattgcaatccttaaattaaatagaggacttatttaccttaacttaggttacagctcagaacagcccgagaatacaaccgacgacgcggacgaggaaacaccaacaacaacaacagcagcagcggaaccaacggtctaacacccaacaccacaggcgaaggctgggaactaggatgaaaccctaatctttgcttcaacttcatcttcagagctggcagaactatgtttatatagagagcaagggtgagtacttacgtactcaacaagccaggggaacttaggtggttaatgcaagcttcaagggaaggctgttatttttcaatcagttttatttgcaagcattttgacaatctaagtgtgtgcattccgcgaccagagcaagacaagtctcaactcggccgggggtgaggagtgaacaatattattttatcaagatttgcacaactcccagagttggcctcaaagctggtttcccaaaccaaaccaattttctagactttcagagttttggttgtctccaaacaaccagtcacttttagggactccctgtcccgctgtctccctgacagccacttgccttccaaatatcgggtttcccaaaccttatcactttttcataaaactgggtaaaacgaaaaactacgctaaggaatcacctcacatccgtccatgaccgtgagcacggttgttcgaacagtttgttaacctctgcagagggggtacactttacccaca

SEQ ID NO: 32547 - DNA, 1501 bp, Oryza sativa
cgatagcaggtaaattattcatcaatactcttgcatgatctatatcgatggccaaggtgtatatattcatatataaattcaaaacaaatactacaattttagtaaagcatatatctcaaaaggctaaatacaaatgagattgatgtctaaatgcactactctaaaagtatgcttcacctggacatctgcaattaactgtgataagcttgtctgattaccttagatcgccagtgcagagcatacgaggagtggaacagatgaacactatttttggggaagagccttctatagtatgagcttgccaatccagcaacatagtattgaggcagtgtagttgcttgtctgttttgatctttagcaacaaaattatcaatctgttctaaagatttaaacaggtgattaaaatcattgctaggtagatcattcaggaaaaactgaacatccacggggcactgaccgatcctgttataatattcagcgatctctctaatcatggtagagagagacaaacattagggtatttggccccgaggagcatcctaggtcagctacaagtatcatcattggttgaagagcagtgtgtacttttttaatggccttttcaatcatcggttttgtctgaagcagagcctttccctaacattcaaagcaaacataaatacatggcattgtgactaactgtgggaaaccagtactgcaagctagaaaaatatatgcatggtacatgtaattaatttaatctgaagataatttcactttgagttaaactagtgatgagaacatatgactgctttggatacacacaaaactctctaagttgtcatgaaaggtccaatcactagagctcgcattcataaattgcaataacaggtgagctcattcctaagtatttcttcatgtgattttgataaaatactaaccaatgatttaattataattagaaactatggagaagaccaaaaagagaggctagaaggatgatgtcaggcgttgaagtcaagatggagggccaactcatatcaagtttgagtctaccttaggctctaggagtagtctgcgctaaaaacatcacgcagccgcattcagactcacatatggaaagctaacgagaccacctttccaatgggtctggtctcacgtcaaaaattcttctgaaagaagtggcgtccagaatctatctgagtgctgcatcaccatcttttgggccgctgggccatgtatcgtattgaagtccaataatgatgcttctagaggtccttgatcgacctagctagaacctatatttgttgattgaaaaccagattgtgtgtaccaagtttctgccaaatcgataatctctacttgatggaagatcgggcaccccattaccgtcaacaaaatttgtaccgttgacattaacatatattacaacaacatagcctatataactagtaaaattgcattttttccctatctttatagcatgtctctcattcatattcatatagattgccactttttc

SEQ ID NO: 32548 - DNA, 195 bp, Oryza sativa
ccttaattgagctaggtaccccaaaatacagatatgcctcataatcttcgtccaatgcaataactagctaggtggtaaccaggtttgaactgtagttacgtagtttttcgattttgctatttgttaaaacaccattgttaagtcttattccttttttttgcaataaaaaagaaggagctgtcaaaacatataaat

SEQ ID NO: 32549 - DNA, 1501 bp, Oryza sativa
tcatcctgtacataagactggaaatgtgaagtatcagcgtagaaaacaaggtgtaataatgtttggatatagagaccggattttaatccatttttttaaaaaaatagtagtaagtgctaagtggctcattttagattgaaacaaatctgcattgtcctgagtaaattgtcatttcaattaatcaaattggtttgaaaatcttctttttacagaatatgtcctgaggaaagcccaaagtttttttttttgaattggaaaatgtgtgtatgttcatatatacacggacctctaaatttcatggcttccatatccaccaatatagaaattagttaagctataggaaaatgggagtgtataatgctagttcgtaattagtagggttagtggtttagtgtacctccataactagagattgcaatgcttgtgagattaatccgtaaagaacacttaggtttccatcatataggtcatctttcttccttgcaagaaaactaagcaccatctgaccaccagacacaagttcctggtagcgcaactcaagaaactttgagaaatcatcgtaaaatagctcttggtatagctttatcaccgatttaggggtagtcttggcgatgtaaatgttcccttcatttaggaattccccattgttgctctcctgaaacatctgtgcacaaaagcagtggaagatataaacacatattaattattggtgctatgaactcctaatgctggtacagaaaatgcggtctctctttttggatatctcatgcattgcagcaaaaaatgcattcactttactactttcataatatcactgttttgtatgttgtatgaattgagtgaatagagaaattattttctcaaaaaaagcgacaaattatgggagtatataatcgatgggaacttacaaaatgtacatatagaaataactactttatttgttgtagaatactagaattcagtagaaatctttagcaactaataaccagtttatttgtactctttcgatcagtaaaaaaaaatgcatggcctatttaatgagttaccactcaactgggataggttttcagagacagacttacttgagatctccaatgtagggaataagatgaatggaagaggtgaacactcttgtcagggaaaactcttgtatagtaggatcttggcaagcctacaacatagtacttaggcagtattgctgcttctctgttttgatctttggcgaccaagttatctagttgttctaaagatttaaataggtagttaaagtcattgccaggtagatcattcataaaacaacagggcggtgacctatcctttgacaatattcgctggtcgcttttatcacctcgaagataaagtttagtgtatttggtcccgaagaacagcccatgtcagcgacaagcatcgtcctaggaagaactgcagagtatagttcttgaatggccttctgaatcataggcttagtagcaaccaaagtcttctcctaaaattcatgtgc

SEQ ID NO: 32550 - DNA, 188 bp, Oryza sativa
gggcgaggcctacagtgacatgcctatatgcattcattcatgaatatatacatatatattcgatcgatcgatcttgtcacattcaacccgtgcagcctgcaaatcaatcacaagctgcttttgctttggtctttttctctctattgcatgcatgtatccctcacttgagaacccatagctagcatgca

SEQ ID NO: 32551 - DNA, 1501 bp, Oryza sativa
tcttttgttagagttgggaactctccgttcaaacatgcaaaaaagaacagtccattaacatgtgattaattaaatattagctatgttttttaaaaaataaatcaatatgattttctaaaacaattttttatatatttttttagaaaacataccatttagtagtttcacaagccggcacgtgaaaaacaaggaatgtgagttgagaaagctaacaaaaaggacttggggcggctatgtagacttggccatgaccactcgtttgttcgccatcaattaatatcaaccggcataataagtaccgccgtgcctgtcatgtcaccctctttgccttcccctctctctactcgtcttatcatatcatactgagcacgctgagcacatgaaatatttgacttaggtgcaatatcaattaagtattagctacgtatttttttgaaaatggatcaatatgattttttaaaacattttttatagaatttttttataaaaatataccgtttagtagtttcagaaacgtgaaaaacaagaaatgtgagttgagaaagctaattacaaaaaggacttgggcggctatgtggacatggccatggccactcgtttgttccatgttgcaatcagcttgccatgccatcaattaatgtcaactggcataataagtaccgctatacctgtcatgtcgccctctctgccttcccctctctccacttgtcttatcatatcaaactgaacacgctaagcacacgaaatatttaacttaggtgcaatatccatgtgcttcaaacaaatgtaagtttctgaaaaaatataaattcaagttaaaaatatttaaaagaaatatgtaaaaaaattaactttgaaaccgtttctctactacttcgaaaatacgaactttttctgtcggtggtccatcttggtcatttctatagcacaataggtttggctttgcgacattctggtccaactaggatttgacctgtatgacccataagagctatctgcatatgtttaaattcaccttgccaggcccgtcccggccccatcttcgaggggccacaaaggcccaataccccaagtacatgcgtgtgggcagctcaataaaaaattaaatcgactgctcatccgtctgtcgtttcgtcttccaatttttttgttgcctcttcgtctccttgatcgctcgtccgtctttctgccttaccggtggagtcgacgtgttacgtcgctgcttctggcctcctggttgcatatgttatttgatgataatgtttctcaattttggtgcataggttatttggtttatctactatgtggactaaattattttttttcttttcatgttgtatctatacgtgtataagtttatctagtattttaattttcaagccacatcgtctacaaatcagattacaaaatataacttcggtcgtgaaaagcgtaagaagaaaaaaaacaatagaagaaaggagctatgcaaatatattaaaaagaagatccatcaattatt

SEQ ID NO: 32552 - DNA, 1501 bp, Oryza sativa
catgcctcatgggaagtttcattaaaccgggtgtaaaagcctttcctctaaaagaagttgcacttggtctgatatataagaaagtctatactcggttcctcaattcttcattggtttaattttcattcctcaatgcaataccaaacggaatccatcccccaactatcaaaaccatgcaaataatatccctatgattgttttgcaagtgattttgagtgtggtggcttgccacatcatccttttttaccatgtcatctgccacgtcctgtgtgttagtcctttctcttcctttttaatagaaaacaaataatgaaaaagaagatgcaaataatatgcctagtagatggatgatctaacaggttcctttgttttatcatttcccctgacatcttcatagtgtactgtggtaaacctttgcagggagtaattactcaagatgttaatgcaatatttgttttccaaaataacaataggaattgatcaagtacaacttcaaaagtgtgtatgccttatcaaggaggattgttccataccttaattatgtctagctgcctctcaactacctcttgatctaatgacgtagtaaggtttccagtccaagtgaatacagtatttccatcatgtaggatgtacgaataggatgaattcaaagacgatgccgcctaatgaaagagcatgatcaagttaccttggaagcaatataatctaattccaaaaggagttcaaacatatctttaggaatgaaaatgtgagaacttacagcatcaacttgaattgcctgcatgttttctggtcctgaaccttgaattcggaagagcgcaagtccatcttccaaataagtgtcatcatcaataccattttcagcaataaatttcttgtatccagagcttagaccaccctataatgaaaaagggaaagaaactaagaattggatgttgtgttcaacctgagctaacagtattttatagaagggaaccttaaacacttggaagctttgaaatatgacgaagaattgaattggttcttttccctcatatagtcgtgtctgcatgtaaccaagaacaattagatacacaaggaagtcatgtctggttcactaatgaaatatggagaaactagtaggttacctggacagcctgaaatttcgcagactcaaccatcttgcttgcaagtgaaatagcagttaccctatcctcctgaatccaaattgaaatattttttaacacctacattttctagtatgcactaacagaacatgtaacaaccgcatgctgttatccaaaatgccacttcttaacagaaacagatagatcattgtggcttccagttcataaatcaaaaggatggaaaacagaagcatatgctgtccatagaaccttctaagttctttcttcattgtcctaaagtccggacttcattgataacttaattaaaaactaattgtgagctataaggtggaaactctaaatacaatcttataactatgaacatgaaatcaaag

SEQ ID NO: 32553 - DNA, 236 bp, Oryza sativa
ggtttttaaagttaaaggatgtgatatactcgttttatggttgagagatgcgatatacttgttttacggttgagagatacgtttgacgaaaacaatagttaagggaggccaaacatagacttattaaaaaaaaaacaatggaccgaatattcgttctcttggaccgtgcgagatgaacagagcactacaccacgtatcgccgttcgatgtttgcgtcctccgtggtccggtgcagt

SEQ ID NO: 32554 - DNA, 423 bp, Oryza sativa
aagaaccaatttttattttgttttgctcaagccaagatcagatcagagatcatcagactgatcagtgctatacttagtgcacacaccaacactgcaacaaccaaatctgttctttgtacaaaaaaaaatacaaataaataatgtttttttaaaaaaaattgcagtagccattagccattagcagcttgactagtggtcatttggatccagatctcctaaacttttcctgtataaacaaatcatggggtctccccctctacaatcccaaggctttgcttagttagcagcagcagacgccaccgccgccacatcaccaacacatccaccgcattgccaccctcgcctcgccgtcgccgtccacctcgccgtggcgcgcgccgccaatgccgccgccgccgcccgtcgcagcagcagcagcagcag

SEQ ID NO: 32555 - DNA, 1501 bp, Oryza sativa
tcataatgtttcactgtgtatggatcaaatgttccagtgaattgaaacattctttcgctatttgctaaaatattatttttatatagggtgaaacaacgctcggttttttttggaaccgttgtttcatacattgtagcaaaatatttcatgaggtgatttggttgtgtttcagctttttaaaagactgaaatattttcgatctatttagtgaaacatgttcgatccacttgtagcaaaaaaaaaaaaaatcggacgcccgatttgtaggcgcctatcaatgctttagaaaagctcctagtgttagttttattaggctgcgttcagaatacccgttcctatcttatagtctagtgttttcacgcacgggctttccaaacggttaaacactgtgtgtctctataaaataatatatgatagttactttagaaaatcatgtttatccattttttaaatcgttttagttatacctaattaattattatgtactaaatagctatcctgtttttttgggaaatggatcacggacccttaaacacaaacacacactttaatcgggagaggtccaaacaaagaatacatggaggatatggcggactaaccggcgatgggagcttccttggcgagccttggcactagtgataaccaaactacaatgtacatagaaggaaggctttagacaaatgacggcggtggtggaagaccgataatgggtgagatcagcggtggaaaacaaaggccatgtgattaagaggtggagagcgacgatgatggatcgaggtgggggagggaggggtgagacaagggaaggaggttggagatgataatattggtaacggtgatggtgttggaggacggcgacgatgatgatgaggaagacggtggagcggtatcacaatggtgtgagacgggacaaaaaaaaataggagagataaaaagatcaagggcatgtttgatgagaaagttctcaacttatactctcgtttttcacacgtgtgcttcctgaactactaaactataatgttttgttttatattttcatatagtaagaatttacattaaaaatcatattaatttattttttagttattttaagctaatagttaactagtcatacgctaataattcacactgcattcagtgcttagggcacccacaatggttatctataggctctctacaagagatccatgtcagcatattttcctacttggaaggtattaaatgaagagagagagcaaagctatctactaacttagagatagtctatagagaaaaacgaggcaatgcatgagagaattatagataccaatgtagacatactattaaggtggtttactattaatcgagtctattgctgagatgtacatgttttatagatagcaccttactttaccattgcgggtgctcttagagtgtgttcttttctatgagttgggaacccatgtcttgtgcacggaaaacgagatggtctattagtccgtgattaattaagtattagcta

SEQ ID NO: 32556 - DNA, 1501 bp, Oryza sativa
acaactttgttgttgatggcttttttagttgaaatcatttagtatatgaaaatattgtttgaagttgtcatattttcaaattcaaattcaaactgttcaagaaaacgttatatagaaaaatgacaaaaataaaacttatagatcttgatgagttatgcaactttgttgttgatgacttttttagttgaaatcatttagtatatgaaaatattgtttgaagttgtcatattttcaaattcaaattcaaactgttaaaaaaaacgttatatagaaaaatgaccaaaataaaagttatagatctcgatgagttatacaactttgttgttgatgacttttttagtttaaatcatttagtatttgaaaatgttgttttgaagttgtcatattttttaaattcaaattcaaactgttcaaaaaaaaattttatatagaaaaataaccaaaataaaaatagaagttgtaaatattggtatgttatgtaactttgttgttgataatttttttcatttgaaatcatttagtatttaaaaatattgtttgaagttgtcatattttcaaattcaaactcaagctgttcagaaaaaaagttatataaaaaaatgacctaagtaaaagttatctctaacgggcatcaacaaaagcccgataccgatatgaatcatcggtgacgggctttaaagtcatctcaatcgggccatatttggagcccgtcaccgatgaccctcatatctgatgggctcggtgtctaggccctattgagatatgcgaggtcatctcaatcgggcctaaatctttgcccgtcaaagatgagtgttatcagtgacgggctatatgtacttgggcttagagtgagtacagatataattgagcccgtcacagatataattgagatgacttcgttctgacggcccaagtagtacagatataattgagcccgtcacagatgataggatctgtactagtgattacacagggctttccgtaagattttaataagataggggttgtgatgatggtttctgtcttttatagcgtgtgttaggagatacattcatgagatgtgaatgtcatgttgcgtgtatattggtatgtgcatgtgtctcctgtatatagaaagaaaaaaagaaaaaagaagttatggctgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacatggtatcagagcgttgatcaattccctaagagat

SEQ ID NO: 32557 - DNA, 1501 bp, Oryza sativa
ggtcagtaactactaacaactatgacactgaccgctactacgtgacattcaagactttctcatgcagagcctacctaaacaccccccaattggcgtttactcacgagcacaatagcttacttatttacaaggacaataatgccagaagtgatattttttgaaaaatgggagaaactctgcccatttagagtcactaacaactgaattcatatacactcctaagtactaataatatcatgctccaatttctatggttgcatatatagcttttcttttttcctttttgaattgtacatagttgcctagttggtacggcggtacagccgggatagaggcaatcaatttagcaaagcccatagattcttgatcaggtatcaatacaatgcaggataggaggaccagatcaagatggaggaggagcatgttgaacttggaagtcaacagagctgttatactcgtattctgtactgatgaattgcttggactaatggactttaatttgagattggaacgaagtacaactgtttgcagattggaataggtaatgctctcagggcatcctggagattttggtactactccaccgaatagtcccgagaaattcaagtttgctttcggtataaaagaaacgctaactttatgtgaaaaggaggaatttcgtgaaatactactagtctgaagcttgaaaaggaaaatgccactctaagatatttgctccggtccaataaaaagtatctcgaggtatcaatacctcaccgtaccaaatcgtttctgatcattggatctaacaatgcccatcctgcccagctagatccaatgatcgaaaacgatttggtaccgtgagttaccggtactttgagatactttgtgctggaccggagcaaatctctttgaatagaattaagtagtttttaacatttgtaaaacaatgctcgctctgtcccactcactaagatacatttaaatttggcacaatcttctaactaatctttaaatttaaatttattactatactacaatgtttgtagcaacaaaatcataatcatataaaagtaaatttaaatgataatcaatgatattattttcatcaaataatatttaacttataataaaatattcattgatcaaatataaattaaattttaaaatacgtacatgacatagtgagtgggacgaagggagtaattatttacagcgaaactctgcttataccaaaaccaaaggacttattagatcatcagatgcaatcatcaggaacatatgcagttccacgtaaggcacaagacacaaatgtcccacaactcaataaaacgacatcgagaactacaaatggagggtaacaaacacagaaaagacatcaatattatctatcaccgtcctatcttctggttttgagggcattttccaccgatgcaacgaatagactaagcatttttagcagcaaaattttacattaaagcattttaataatttaatgggcccaaagtaactgtgcatataa

SEQ ID NO: 32558 - DNA, 1501 bp, Oryza sativa
aacaattttgtgaaaaataatctatgtagctttctggctagaactatatcagcaacgttgtacgatggagaatgacatatagaatggatgttttcagccggtaacgatcaagataaagatatagctacaggttcctggatttagctagcgctgattgcaagtgatttgtagggtccaggctagttcagtcatgggttttatgtcgatcgtcagacttatcttcatagttcgacacgacttttctttggctgcagtgcaatgtcctagctagcttccaaaatacacatttcgattgagaagcagagatccatctgcaactagcatcacacttaatttgtacttttatatatcctcaatttatataaaaaagttaataagttgaaagggccgtggtttagagacgtagatttgtatgctaatccaaaaatatccaactttcatatggtagcgtaatttcatcaacacacaaccataaaccacggaattaagcatctattattaggctaagggtatttaccatggagaaattcctctctttttgattatcatttacgagcacatttattcatcgataggtaccccttctcattcaatagcctaaacatttgaattagacacatatatatataggcatagtaagttgcgcagtgcgagtatattaaccttttaggattttttgtcttgtttattttgttgcttcttataggtttgcacatcatagagaggctatataattaaatgcagatcaatatataccagataaacagatggtccacaattagggatatatatctatatggacatgagagtggacaacagtgggcagcaagcagcgatagcttggttccatgattgcatcaaaccaacagttttgctgctccaagtaaattcagataaggttagggctgagtattgagtggacaggatcaaaccaaactgtgcaatatatatattgatggtgatcctatcaaaggagttgcggtttgtgccttaattatctctaattgaattactatatatactaacatagctcagatatattctgctcgtgatctcagtacaagcataaaaaggattactacaactttattctgaaagttgtgaagtactgcattgaacttgttaacctaaatatgtaacttctaggtacacattgttagatttaattgggtaattaatccatttaaatcaattaaatcaaataaattccaaggctcattatgctaggaattcatgattgttgatgcttattcaacgttaagcatgctcatgttgattacattcaccactatcactggatcaaatcctattgtaaatatcatgattattatcttgttattttggattaaaatatgccgaattatgaccaaatttccaacattccaaaaacctgataggtcattttcggtagttggctttgctgctgcactgaaaccacatgcttttgatggttcaaactataagagatggaaagcacgtgcactattgtggttgacagcga

SEQ ID NO: 32559 - DNA, 264 bp, Oryza sativa
accacagcagggtttttatttttaaataatgacctcagcagggtttttttttttgttgtttaagtaaaaaccgctcctctcagatttacaaaaaaccaacaaaagggacaaagcttgacaactttcgatcaaaaccgtatagaaaccaactaatataataccgatcggcttccacaaacagagaatcaccagtttcacgaaaaccgttgaatcctggacctcagtccgtttcttagtccactccctcttcgtctcattactagg

SEQ ID NO: 32560 - DNA, 1501 bp, Oryza sativa
ctattaaaacgtcgtatttcgcgaaaaaatatatatgaaaatagctttaaaataacaaatatatttatatttcaagttgtagtacttaaatattaattaatcatacgctaatagttttttgttttacatgcccgtttttaatcttaatccaaagcagaaacgaacgggaccaaaagggtgggaagtcagggagacggggttgatcttcaagctatctaaggctgcgttcgggaggaggggacgcaaaacggagcaggcattactacatgattaattaagtattagctaatttttaaaaaaatatatatattaatttgatttttaagcaactttcgtatagaaactttttataaaaaatacactgtttagcggtttgaaaagcgtgcgcacggaaaacgagggagaggggttgggaacttgaaggaaagaacacagcctaagatgtagagtagggaggaagggatatgcatgcataatgaatggaactggataattgactataaccactatggttaaaagaatcatctatgctaagttgctacgtggttagaacatatgtgtatctctatttaggagagcctagaacatagttcgactctgagtcataatcatttacgtacatatattagatacaaattttaacaaactccacctagcgaatatgtcaagcaaatctgaatttactcaatgtgcaaacctccgtgtacctagacttaagttatttcctttcgccgctcacgtcaagccactcgacgaacctttgcctgcctcacggtcttcaagaacgtgcactgcaacaccaacatacccatcttctatgactccacctataaccgtgtccccatgtagcttgcacaaacatgagcctcatcctctcactagtcataacagtctttccgttattcatgatgtttatggtctttctatcataatccacctaatacgaccactctttcttatgtaggcaggctcacaagtgaaattgatctcttccttagttctgacacatgtctcacatttcaaagtagcatgttgtttctatcgtatatcgaagttatctcctcaatcttgatagtatacttaccgtacgtcgggatagtcacgacatgctcataagacagtaaaagtaaactcaaaagatacgctcacagaagattcgctactatcctaatatctaatataaatttaagttctaaactataaccgattatgtatatatattcaacacaacctcagagaaagatcacgaggataaactaggggctatagcacagctccagtgcttgaaggctgaagagtaatcagcagaagtaacgaggtccattgttggtctacagaaagtcaagggccgtagtttcctggtagataactttcctgaattcctctcttctttcttggcgtcaaactctctcttctcttggtttcctgctgagatcaaccaacacagataaaaccagctccatatccaacactgaaagatcgaacatcattgaatgtatta

SEQ ID NO: 32561 - DNA, 1501 bp, Oryza sativa
tcttctctcttttttttgataatttcggattttatttcatttttatttagaattttgattaatctcgtattgggttcttatatggactcctctttcaatattgcttacttttaattccgaatttcagttatttttagattgtatttctatttgcactcttctttttttttccgattaatgtgggaatttctagcccccacagcgaacgtggtgcctcctttcaaggctgttttaataatataatagatagattttgttgctacaactcttatagcatatgagaaattataagttaaagattaattttaaagaccgtgtaacttttaccatgtctaatattatgggatggagggagtaccttattatatttaatatctatgaattagagatacaaatggagacatgttcccaaatccgattcgaaggaaataatatgggataggatatgagatgagtgatatgttattcggcattatccgtacctggttccgaatttttttaaaaaaatatgggttagaatataggataataggaatgtcataatccaatcgtcccagtccattttcaccctagaaacaagtagccacaacgtaaattagcttgcggattgcagcagaatagctcattcggaaaactcgcggctcccctgccttccacgtctgagaggcaacgcacgtagtcaaggaatacacggacggagccgcggtacatcgcccgcgcggtacgcttggttgaggatggatggcacgaccgatccggcggcgagctggagaggacggcaccctgtgcgccgcacgtacgcgcccgcatatttctccagtcacgttactgcttactactgcttactactacttactaaaataagtacactctccgtcgataactataatggattttcagttttctctcttaaaaagattattcatcgaactatcccaacatgacttttacggctaaacttaaatttcgttccattgcattgttaagatcacgtattttaatctatctgtttagtttatttctcaaatttttaatttacttttataatcaagtagataatactatgtgacaataacctgctcggcttaataaatctaagttaatctaggcttctagcagagtttaatgtaaaaaagtaaaaattacgttgttgtccctaaaagtttatttgattggaaaaaatcacgttagccatgtgacaaccagttagcaataaatacgatgatcggatggatggagaaagattgtactccaaatccctcgtatttacggtcaaattcaaatccaaaatctaatgtattgatgatggaccgatcgcactcactccaggctcttctaggcagaagcccggccgggtagaagctgtatataaagagacccacagctcaggcctcagcgtatcagtcggtattcagtacgcactacgcagcagcccgtgagtcgtcgtgaccaaacgtatagtatactagctaccaaaagcagtacggtgcctggtttcatt

SEQ ID NO: 32562 - DNA, 1501 bp, Oryza sativa
tcactagacaaatctgaacaggggaggctaaacttattgactacttgtttaaccgtggtaatggaaggatgaccaagacgatgatgccaccggtccaaagatagtttgatggcactgtaggcttgcttcaaggaggagtgtggtagaggatatagcctgcgccatgatcttcccttaaggagagttttcctggtgatttgatccttaagaaagaaataatcacgatgtaattcaagaaaggcagagttatcattaactaagcgatgtactgaaacaagatttttcttagcttgaggcacatataaaacatttctaaggtggatattacgactattgggattatgaacaatagcatgaccaatatgactaatatccatacctgcaccacttgctgtgtggatttgttcaccaccgttgtatttttccttcatagtgagcttgtctagctctcccgtgacatgatctgtagcaccagtgtcgatgtaccaatttgtgtcaattccataggagttaaccgctgcagctgcaacatgcttggcgtcaggaacgtaatcctcgtcgtacctataccaacaatctgctgccgtgtgcccccgtttgaaacacacttggcaaattggtcttttatcaacgcctcctggtgtgcggcctcgaccacggccacctcctccgttgccgcgaccatggccgccgccgtcgccgccgccgcgcgaacctccttggccaccattgctgttgccacgccccccgtggctgaagcctccacggttgacaacattgacggtgacctcctgtgcgccgcggtagatggcttggcgagcttcaaagttcaacacttgagagtacagatcactcacagagattggttcaacccgagcgtagacagccgacaccacctcgctgtagccctcgccaaggccggtgatgatatactgaatcagctcctcttcatcgattgggcgacctccggcagtagccatctcatctcctaaggatttcatttttgcaaaatactcaggagttgacatgttacctttctttgtattggtgagagcaaaccgagtgttaatcgctcttgctcgtgtgtgggtggagtacatctgctcaatggcgctccacacttcagccgcggtgtcgcatgtagcgacctgcatcagcacctctcttgtcagcgacgagagaaggtaccccagaacttgctggtcggtggcttcccagtcttcatgggctgggttcggctccttcttggtggcgccatcttttgtgacagcgatctctgccggcggccgcttggttgcgccggtgagatgcccctgaagccgcgctcctctgactgcggcgcttacttgcaccttccagagcgcatgatttgccctcccaagcttctctgagattgggtggccttggaacggatttgtggcagccgtactggacgacaaggccatgagtattgatctcttagggaattgatcaacgctctgataccatgtgaattagtttg

SEQ ID NO: 32563 - DNA, 449 bp, Oryza sativa
acatattggtatgtgcttttaaatatgttttgttatatagtccttaaggagatactatgagataccaatttttatattgtaaatttggtatcacttagtatctaggtactatgaggtaccaaatagtacaatttggtacttcatagtaccttctcaaagatcgtaaaattgctcaaatttttggtacctccttaaggacggtaaaatttctcatacggtaaagttttcaagctttgaccataatgaaaaaataatttatatttatcgattttacggttctagagaggtatcaaaaggtaacacatttgacactttgattttacactagtaaatgtggcactttcaagtacctatgttcaataaaatttctcttgattaaatcatccatttacaagatattgcctcgttaattctacctatcatacccttaactattgatgattcatagg

SEQ ID NO: 32564 - DNA, 1501 bp, Oryza sativa
tggttagtgacctgtgttagtgagcctgctcgtgcgagtccaaaattttctcctaatttaattgagctaatctcctatatggaggaggttaagctgtctcaatctgcagcctctgacccggcaaagcagagtgcacacaagctccctcccgtgtcgaagccgccgtcgcatgattagacaaacgattcgtttatagctctcatgtccctttcacccggaggagcttgacaaaaagactcgccgccgcggcacagctcgccggtgatgagacgatgcaaaaataaaatgggggaacgaatctctcgcggtcgagccgcgagcgacctcacacaagcggccgcgtggagcgtgcagtgactgcagctctcacgcggcctgtagaagcagtttgtggagttttgtggccggcgtgtgagaagagaatttcaacagcaataatcaaagattagtctcttggctgatcttatccacagcgacattgcaccagattggatggatggatgcatatcatccctcttgcgggcgatgtggaggtcgccgttcttgattggcttggctggctttggcttccctgttcgatattgatttggtttgtactagtagaatactgctggtattagctaggcgttgatagtggccggggcttagcgtcaggtccactgaccactggggcactaatcaaagttgctgatttctttcgctttcttttttcgttgcaatgcgatcctcatgtcggcgcgggtatcgcgggggagatcaaagttcgtagcttcgttagccgcttagcctactagtgctctcattagtctataagagagaataggtcttttgctttgctttcaggacatggtcacctttctcaggcagcaagcgtaagcaaggcagaggagagggaaagaacctctctgcagtgctgctgctgctagcttgcagaaaaaaaaaactctcatcttttgcaggaagagacatcactgtttctgcattcgtgtgcatttggattaagctttgcttatccctttttagtggagattgttgagtatatcaggtaaacacatgtgcagtcttgctgtgctgtatgtatgtgtgtgcatgattttgtcgtttgttttatgcatgctgcgttatctgctcttattcaaactcttgttatgtgctggctggctgattcaattaatcaggttaggtacatgattgtttcccctgtaagtcatgttggttttcagcaacttgatgcgattggataaacaagtttgaaaaaccgaccatgttttgagtatgctgttcccttgtttctgttttgattgcaacctaagagactcttgagtcttgactattctaatgtttgaagatgttgttgttcaagcaagagacgtgcactactatgctcctatgtagttaccctcatactagcctgaaaagcttacactcatagatatgcttctctcacaggtctatatattggcagctctggttggagatagacactcacactgagccaaga

SEQ ID NO: 32565 - DNA, 1501 bp, Oryza sativa
gttttccccctaatctttgctctatgtcgcgtcttgtgggggcacttcctgttctttctcgctggcctctgtggccgccaccggtgcagcctcctcggactctttctgcttcgattgtgcggtctggatcaagtggttgtagctgcccttctccttgaacagctgcgagaaatggatcttgcagtagaggatcccgttgagcgccgcgtaggaagacgtcgtcaggatgcagcccccatgcgagcacttgaagcaactcttgtggtaagactcaccctccagagttagctgaacaaaaaaatagattccatcaaatcagattggtttagagcaggtacaatagcagactataagccagctataaacatattttaaagagataaaaaatgagagataagagtagcgggctacaaatttgttgccagttgtagcacatacgtaagaatacatgtgtgtatgacaggtagaaccagacattaattatgtagtacatgtttatgggtaactattgtatgaattagctattaaattgactatagatgatttgtagccaatagttagctatactattaaacttgctcttatactcgttcaatttcaatgctatcatctttttaaattttctttaacggttttgacagattgaaatttgtgtgacgctactttgcggtcgtaactaggcagcattctgtaccttctccaatgggtacacagttttttggcaggctgcacatttatcttgagttccagagaatgctgaagatagcttgctaggagctcttccctggaaaaagtttttgcagagtgaatagtttgcggattatcaaatttggtgatatataactaataaatgcataatgtgtgaattgggctataaacaggtctgtggggtttgtacctggtcgctcttctctgaagatttaccacctgagtaccgggacagagagagaattcagaacacaataacttctcaataatgtccaaacatctcgacagccactgtgtcttagcattaccttgcgagaatttctttgagaagctccccgtctctttgaagagctgctcaaagtgcgtcttgcagtacaggacaccatccatcgaagagtagttacacatctgcagatgcgtaaatgttttgaacgaaaaatgtgatagttgatttaattacctaataaaaactgaacatgttgcagggccgatcgatgccatatatacataccgagagggtccccttgcagtggctgcacttgaagcatgtcttgtggtaggagacgccgtcggcggtgaggaggtcgatgaaatggacggtcttgtcgcacgccttgcacttgtcctgcgtgccggtgaacgacatggcggccggggtacgtatactagcaccgggtgattcaccgatcggtcgatggaaaaccttcaggcctcggtctggtccagctcgaggaatcaccgtagctatagcttcccaactcccaactcttccgatcgatcgacggaggagatc

SEQ ID NO: 32566 - DNA, 228 bp, Oryza sativa
accaccaccaccaccaccaccaccaagaaccggtcgccccggtgcgccattaccccccaaaacgatcaagaaaccacaaaaaaaaccagaccaaaaaagaagaacaaatctcccccctaatctacacctcacgacatgagagagagcttgcttgctagtgagaagattactttgagctggagttgcttaagccgcaccccagctcgcatatggagctagacgaggaga

SEQ ID NO: 32567 - DNA, 246 bp, Oryza sativa
ttcaccgtcaccgccgtccacgtcaagcctgcgacgacaacgacgatggccggccgcacttcctcctcctcaacatcgaccgatcacatccctaaaccctctcactccctctttgttaattcatctattgttgttcatccatccaaagtgttctacctgactagatctaaacctaggtgatccaatagacaaccctaacagcgtcatccaacgtcatcgattgtttgttatttccttgttaaagtt

SEQ ID NO: 32568 - DNA, 427 bp, Oryza sativa
ttacaaatgtgcttacaaatttgtaacctttttattataccgaaactccaattgcgatgtgctagataatttatctaaagtatacttggactgcagattattgggtccctatgctcaagttggtgttctgtgtagcctactaatgtgcatctagcaattagtccacctttccttttctcctctgttctcatctgtacagacctctccccttctctcccctcttatgacttgtacaggtaaaagcatcagctagctaatccccttcttccttcctccatttgctgctagcagtggctatcttctccctcaaatccccactctagtactgttgctgctgccaccatgttgctctcggcaacctcaatgcccaggctaccaacaagacctgccctcctaatcctcctccttgagctctccaacccacagc

SEQ ID NO: 32569 - DNA, 1091 bp, Oryza sativa
atcgttaatgatttatatgtgatctctttatggaacactattctcctgcatatattgaaaataaataattgttccaatacatgaatgctgggattgggaatgctatagctaaatcctgtgaaggatttattttgatacggagagactatttgtggcatattgtttctcactactaacatgtagtatgtcatggaaggaacatgcatgctgagtaagcattactgccacctttagcatttttttctgcattttgcattgataggacctgtcggcctgaacaatgtaaatttgctaatttgctaagctcaacctatttatggaccttgttggtagtacagttcaattggcctagactaggttgggtacccagtgttgtcttttgacaatgattttgggcgagatggtttgatgatcatcagtttggcatggcctcgcctctttgctttcttatagtttgctttttgaagctcaacgtggcaatatgttcttacaatatttagcaaatttgttatgatatggttgactcaagagtcagtacagccagtaaagaatttaggatctgaaaaggatttccttagaagagaaaggacagaattcacagttagagctttaacacacaacaataaaaaactaactcacaaagttaccctgatttaactccatgtctccatgtaacgatggctgtttgtcggtttctatagatttttttttaactctcaatagtctccatgtttcctatttgtttcatttctaattcttacttgagacctccacatgcatcgaacttcccctgtatatcttacaacctcaaacctataatactgttggtaagtagtaacttccaaattcagagaaaccctggattaaaaggggcaatcctgagccaaatccgtgttttaagaaaacaagcggttcttgaattagaatccaaaggaaaaggataggtgcagagactcaatagaaactcttctaacgaatcaagttaattacattgtgttgatagtggaactccttctaaattagagaaagaagggcaattgatagattatagataattgttagctgtgtttatccattttctctgcaatatg

SEQ ID NO: 32570 - DNA, 850 bp, Oryza sativa
ttatacttatcagctaaaatttaaatttttaaccttaaatttagagttgattttgaggttttttcatcgaagtttattttttagtctttgctcatagatcgctaagaacatgtatataaaatccagtccacccaactgattttgcttttttgcttttaaatttggagcgaagtgagcgtagatcaactgattaggtttcttgtggtggaatcagcctacccccggttaaaatcctagatcatgagtgcttgcatttacggttaattattctttcagttataggcgacgtacccgtcaacaacaagatgcccataaagacagggtgtgagggtgctcgtatttacggctaattatttttttagtggcaggcgacggccataaggacagggtatgagtgtgctcgtatttacggctaattattctttcagtgatagacgacgtactcatcgacaacgagacatctatagggtgtaagtgtgcacatgttgtgagcgcttgcgtttgtgctgtgttttttttaaatataagttttatttataaattgctatttatctgtaaattacgtcatatttacaaacaaataataatttataaataaaatatatttttttaataaaagcacagtataaacgtagatgctcatactaccactagtgcatgccctcgtgtcactgcatgtgggacccaccccttcctcgggaatcccgcgagttttttcctccgggaggtcaaaagcatcctttcgcctccgccgccgcgtcctcctcctcctcctcatcctcacgcgcggaaactgtttgtactcgagcccactccaactccactccactacgccgatcgtgtcacacgc

SEQ ID NO: 32571 - DNA, 181 bp, Oryza sativa
agaaggagaagtggctgcaaactatgattacgttgcacgctacacggtggtgatcaatgatagttggttggtgacttggtgtgtatctttttgagaatttgacctgctaagtgctaaaaggatcagcatttctctaggatagaagaacttggcatttcatttcaagaggtgctgtgttaga

SEQ ID NO: 32572 - DNA, 1501 bp, Oryza sativa
cgtgcaatcaccttcactcagagtgtatcgacagtgtggcttgtaactgtgtatttcactgttcccattttttcttcggggaggtttttccagtgagccatgtcagatttggtacatagaggatctcatgtttttggaactttagagtcgccattcttttctttgtagtgtcgatgttaaattgattataggtgatagtgatattctgggccatatgttgttgactcggtatggattattggttattgaatgtctatgcttgtgccatgtttgttcttagcaatttaactgtcggtaattggaatgctcatccattggtagtgagtgttgttcgttggtatgtgttggcattgcttgaattctttactcacaacagcgactggttacttctgtagtggatacttaggcgccccttgatttaaaggaaattcataggaattttagaggattttatttctataggaattttttctatatagccctttaaattaaaggaatgaattttatggaatcctataaaattcctatggaatgcctaatgccatgcaaattttggaggaattctaacatgaggtagaaactttcctttgagtctttatctctcctctaattcctgtgttttgtctgcggtccaatcaaacggtcattcctttgtttttcctgtgttttgcaatcctctgttttacacttacattcctatcaaaatcctacggtccaatttccaatcaaacggtaattcctctgttttacacttacattcctaacttacattcctatcaaaaatcctatgttttttcatttcaggggcccttaaatatttatgactacatttggcacgcatctaaatgttgcttacttaaatcttgcactgggacttgaaaaatgagccgtttgccactttgcctgtttgaaagtcccatcgtatgctcctattcccgtcttattagggaatttttttacgtgttcttgtcacttacaaaatcaatgctgaaaaaggaactacattgtaatatcttaaaattaatctcaatattaagtttgaaaaattaaattttagttttttctttgacttatttgggcatccgatctatcaatgcaaaaagaaaagaaaggaggaaattcatatgattcttttaggaactgaactaaatcctgcaaaaattatgtaaatttacttcgattcagaaatcaaacatgacgcatatgcgtatatcctgccgcaatttcgcaatccgtagaacagaatctggactggaggtggtccaaagcatctattctcagcctctcaggaatctgcccggcttccgggattcccccacctcagaccttctctctctctctctctctctctctctctctctctctctctctctatatatatatatatatatatatatatatatatatatatatatatatatatatatatatatatatatatatataactcgctctccgcctctacttcgcgccatttccaaatccatttccctcgcctcac

SEQ ID NO: 32573 - DNA, 1501 bp, Oryza sativa
aaatgaactttaaatttaggttttaaaactcaaattttatttgggcatataggctgaagagcaaacaatagagttgcaaaatgtttaggatttaaggttttgtgtattttagaaaaaaaaactgatctactttcattttatatttcaagaaagcatgggtaatagaacatttaaagggatataactaaaagcaaaatatatattattacaataaatacatatgttgagtatatatactcctttatttaaatagactgcaaaggtggtgacagtgagtttgccaccctatctattcctatatattgtagttttatgtattacaacttgaacttcttaatatgacaagatagctaaatctaaatggatagctatatataaaattaaattaaagtgagtattctctaaaacaaaaggctggtaacatatttgatgaaaattatgccttttagtttcaggaaatattatgatttttttcctttaatcatattaaggcatggacatttagatagtgctacaaatagataaacgataaattacacttactttggtcttgaacaaaatgttttaaacaatcatgatttcagtggttgtatttgtattctactagtatatcctacgactgtaagtgtaacagaagatatcgtaaaaacaactcttccacaaccatcaatctgctagtacaatacatttgtctcggtttagaaattcccatgctatatgtgagatcatagtattgattatacggactacccacacttataaaaaagagtaaatttcacaaaactacaggtgttttgaccaaattatcacaaaactacagatttaaggagttgtatcacaaaactacatatttagcactaaatttatcacaaaattacagattttagattaagtatcataaaatgcatatttaatattgaacttatcacaaaactacaacttttggagtttaaatcctagcaccattgttatggtggagctataaacatcattactttgtgattaaattgattataaacctgtagtttcgtgataatttagttactaaatatgtagttttgtgatacttcatcttaaatgtgtagttttgtgataaatttggtgttaaatgtgtagttttatgatacatcgagttagatctgtatttttgtgataatttagtcatagtatatgtagttttgtgaaatttactctataaaaaaataatgcattcgctctaaaatatagaatattaataatatagttatatggataaattttctttatatttcaaaatggagatagtaacgaaagatatatactacgtgctcaatccttatttaatcttttgaaccgtcctgctttttgccgacccttagtttgtgtttagttcacgttaaaattgaaagtttggttgaaattgaattgatgtgatataaaagttggaagtttatgtgtgtaggaaagatttgatgtgatggaaaagtttaaagtttgaagaaaatgtttggaactaaactag

SEQ ID NO: 32574 - DNA, 1501 bp, Oryza sativa
catgaattatctttcaacacgtaattagccacgcgttttcctgtgaagactgaagaatatccacaaaccataattcgaggaggaatatatttttttcaaagaaattcaaggagaaaacttcgtcttaaaatactacaacttaataggttaggtttagatttactgttctaagatgattaaatattatcatactccctgtctagaaaaccaaactcatataggatattaaaggttaatttattttagagcgaaggaaacatgtcgcagtatgctggctgagacggagaaaatatgaattttagtagggcctgctcgccagcgagagagatggcaagatggctcacgtcagagcaggtacaatagcatgctataagctaactgcaaatatattttaagcagataaatgaggagagagaagggcagcgggctacagatttgtagccagctgtagcatggacttcaagacgcagtgtatgtataataggtggaaccagatattaaaaatgtagtatataactattgtatgaatgagctattaaattggctatagatgaattggagttaatagttggctaaactattaaacttgctctcacatgcaaagaatacagagctcttgtcatcattccgtggtgggaagcagacggcgacggatgtgccacttgacccccgaccgagctggccgtgggcccaaccaacgaccgttccatttgcacgagaccatatcacatcgccctggggggcccacctcgcccatcagattagattaaccccacggccccgcgccaaaattaaacaccggttttataccactcactaccccacactgacggtgactggagtgtgggcccagccgctgccgtgtcattattaggtcacttaatacagtaatcacccgaaaaaatattaattaatttaattatactagtaagcaagactggtcttgtttacaggtcaggagagatggcgccgccgcgaagcaaactcagcagccagcatgtctcacaagtaacaccccgaccctgcgaaaatactattttacccctcgtaccatccatgtgggtgatatggccgtgggcagaacgggtattacggcctccgaggtggagtttggttcgtgtcgcgtaaataactttctcggcgatcagcgaagcgaacagctcgagaaagaaaaagaaaacgtagaaaagtttttcgcagccgcggcggccagccaaccaaccaacccaaccagccaacgcggatcgcctctcgagcaccaaaccctacccggatcgccagcgcagccactcaccaagccttcccccccaccctgcttctgctgctcgcgccgggattcttggctcgtctgctcttcgcggtcggtgtcgcgccatcagcaaccatggaggtgagcggttcttggttttttcttttcttgcgccgcggcggcggcggcggcggtaggaagaggagtgatcgtgtgagggggttcgctgcttgcagggcgagaggagggcgg

SEQ ID NO: 32575 - DNA, 269 bp, Oryza sativa
ttcccttcctagattcgtgatgatttgtgggaaatctcgacctggatgcgttttaatcatctggtgtattgcgggcggtttcgtttgtacccgcaacctgttcgttttattgctttggtggtatcataatggctaatttcgttgttaatgagtactgttttattcgttaatcccaccatcatcatacacgaaatgtatctgttcttatataccctttgtgtttctgaatttgttggttatatatatgcagagatatgtggcgctgaagg

SEQ ID NO: 32576 - DNA, 1501 bp, Oryza sativa
taaatagagggggagcgtgaggcttcccggtatcgctatagagagcaattgagttgagttttgagttagggtttcgagtttagttgaaatttttgtaaggagtgctgttggtgcactttgtaaacacagagagaagaaataaagtcgtcatccactttaagagttctttgatttgtgtttcaccaggtttcggcggtctaaccggcggcgcaccggcggtcagaccggcggcatcgcggcggtcagaccggtgggcacacggcggtcagaccggcggctacaggagttggcaacaggcgttttcggcggttcgactgatcgatctacatcggtcagaccgacgttcatcaggtggtcagaccggcacaactactacggtcagactgcgatccatcgatttcgagggtaacttttatttccgctaaaagtttttggtttttgggtataccaaccattcaccccccctctgattggcttagttcttgtgattcgatcctaaaagtggtaaggccctttacgatcctacaattggtatcagagccaggctaggttaacatctctggcccgatggacacgtgtgaaggcctgatggacagtgggtgcctgcggggcccgtatacctgatggaccgtgggtcggtgggggcccggatcatattaatggtcgctgttcaagttttctcttatcattataaagaaactcgatcctgatcaaatccatggaaagcatggatgtagatatttaataccaaatgatccatctaattttgggcctatctgggcgttgtattcgaccattaatattttcattgatattgcatctctcttaagacatcaatcagtgagagaataactaagtgcttattattgttcagacaaatccttgttattgaatctatgcatatcgttatctattaaactactaaatgatcttccctgttgtgatttccaaacctgtgtgcagtctactggtttcgatcattatttgccgtgattattctatttctctcttgggacgttggtttaaattaaggaactcaaccctgagccgttccgtggaaaagtttgcatatgcaaggtattaaattactaagtgatctttctaattttgaatcaatgtgcaacctactgttttcgattattacttgtcaatgatattgattttattcacaaacctgcctttgttttctatcattatttgtcattcagtcattgacattcagtttttattttaagacgtcaatgagagaggaacttaatcctgatctatcccatgagtagtttaggtgattgggactcaaaacattatgggagggtccacacccacatgcctagcctatttgaacgcaggacaacttttagatctacacgacacagaaagtcttgacatacagaggctcttctctagctttgatgtcttacactagaaatggttccatgccaactgcaattagcaaccactgtacatacttcttctgattgaaggaatgccataaactcca

SEQ ID NO: 32577 - DNA, 1010 bp, Oryza sativa
tgttatcaccttaagatgttgcagtcttgtagtcaaacataaaaaagtatccacgtattgttgtgtaagaggtaattatcatatcaaaagtaaaatcacttcatacctggtagcgccgagcccgacattatgggggaagattgtagccttgtagacgttattgtgcccatgcacggcatcaataccgtagatcatcggaatacctagtcgggtcgaaagggcacccttttgcatttcattcaccattgaagcccaagcctgagctgatgcctgaggagcaggcacactgcctccaccactcagtacactacctgcatcacagcacaccaatgtcaaaacacaaaacatatagtatccagcatttcatcgttcacattacttgagcatgagtagtaaaccatgacacacctatgaagtacttggcaatctgctccgccgtggcattctccctctcgatttgggtcatctggccaatcttctcagcgagagtcatccggccgagcagatccttgacacgaacagagacgggctgcttcggatccttatacttgacatactgagcgctccccaacgtagcaaaacataacatgaggagaataacactgaacttgtgcaaactccccatcttggctcagtgtgagtgtctatctccaaccagagctgccaatatatagacctgtgagagaagcatatctatgagtgtaagcttttcaggctagtatgagggtaactacataggagcatagtagtgcacgtctcttgcttgaacaacaacatcttcaaacattagaatagtcaagactcaagagtctcttaggttgcaatcaaaacagaaacaagggaacagcatactcaaaacatggtcggtttttcaaacttgtttatccaatcgcatcaagttgctgaaaaccaacatgacttacaggggaaacaatcatgtacctaacctgattaattgaatcagccagccagcacataacaagagtttgaataagagcagataacgcagc

SEQ ID NO: 32578 - DNA, 1501 bp, Oryza sativa
tacatatatatctctccaagtccccaagtgcttctttctttaccatctctgatcaatccaaataattcactatactaacgtaaaataactttgcaagatttctttggtgtgttattcgatttctttttctttttaaccaacaacctgcaattgcctccatatatatatcagacaaaaatgtttcatgaacttccaactacgcttctctgcactttttgcttcctggattcattccatagagttggtatagtttcatgcaagcatttattacaaaatcacacatggaatatgctaaggtttgtgctcactttatttttccacctgcatatataggattagatgtaagtaaccaagctatatgtttttatttgtgaagttgcctagaattggcttttatttttgcaattgtctggaattgctgaaattaatatttatggctcatcagttcacctatgtaatgtacatgctactacctccatattttaatgtatgacgcggttgactttttatccaacgtttgaccattcgtcttattcaaaaaatttatacaattaacatttattttattgtgactcgattcatcatcaaatgttctttaagcatgacactggtggagaaaccatctttcgtcggtcggccgatttccacagtagtcccggatgcaataaaaaccggggctaaagatgttctttagtcccggttcaaaagggtaacgggcatatttgatctttagtcccgggttgtgttaccaaccgggactaaagatgatctttagtcccggttcgaatgctgtcagggtctgtcaggccctcccggtatctttagtcccggttgataacaccaaccgggactaaagatgttaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaataaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 32579 - DNA, 1501 bp, Oryza sativa
gcggagatcgggttcggaaacagagcaggaatcggctggagtctagatcggctacgattaggatcggctaggtctgagtcgggctaggtaagccgatgcagccgattccggcaatgcgacttcatgtatgatatcgggttgagttgaggcacttcaaggtgattactgcacaaggatagagtcctgagaaggcaattttatctattaattaggatgttttatataatttctttagagatacgcttgggcaaaagtctgccgtaaagacttattgtatcttagagtttgttaaagatattagtcgtgtccgttatagacatatcttgtaattctcgggtataaatagacccgagccctatgtaactttgaacacacacgttcaatacaatttcggctcatcaccaccctttttgctttagttttatttcgacgagttcttactttcgggttgagctgcatcggtttcgatcttcaacaagaggtaaaacttgttatgacaacttgtgttctcgggattagtgcttccatctttatgatactctgatctcgtttatgtaattcgtcgagctatcatatatcttacataatctccggcaatgcagctatctaatctacaatcggctaacatctgtcggtagagagcagccgattaggttagatttcaacgttgatttagattatataagatatctaccactctataaaacttccagcagcttgattgtctagatattgttcttcttttcatacttaatgccgtatcagttaagtttgatatattaagtcgtgcttagaaaatcaatctctagcctgccttctggttgccgattagggtagcatcggagtttcagctgatcttatctaatttaactatatttaccctatatactttattgacatgttaaatctgccctttattttaagatcttattgcatttaagtatattaggcctttgtttgatatattctacctactttaacatcttagtatagagtggtatcggagtattagccgatacatcctagatctatatgatcggctatgctatgaacatatatagtcccattattaatatatatttcgatttaagtgatttatactgtctcggcatggcgaccgatctatcccaatcacttgatttaagtatatatcgatataaggagtatatattgttaatatctacagccgatcgaatagatttagttccttcttatttattcatgtctgccgatcgatacatatatgacatcggctcaaagataaatgatatgtcatcggcctctagccgatcgactatcatttatagatttaaccgcgggttctttgcttctatttcttgttgattacaggatcaaatcaactggcacgcttatacattcgaaggcgagctttggacctgcactggagttaagcagatctcccaggcctcgtgttttctgtcaacacgcttttggcacgcccgatgggacctttaagtagtcagctaacaattcttcctca

SEQ ID NO: 32580 - DNA, 1501 bp, Oryza sativa
cccacgtcgaacaaaaccatttcagcccaaatctgaccggaagcagaggagcgcccaccgccgccgccgccgccgcctcctcgcctctccccctctcccgacgccggcgtccactctccctcccctcccctccccacctcctaacacatgcccgcgccgcagcagcagcagcagtggtagagcccagcctgcctaccctaccaaccgacgggcagtagcatgcgcggcggcttgcgccgcgggctgggcatcctcctcctcccgctctccagctcgcccagccgggcgccgcggccgccggtcccgctcgctgctctgctcgtctaccaccgccgcctcgatgtcttcgcccgccggtccttctgcagctccggcgggggctacgccgtggagcagttctccgacgacgagtacgaccacgagtacgaggatcaccgggtaccacctccgcgcaggcgccgagctagctttttcttccctttttgttcttctccagtttcgccatgctgagctatcgagtggtgaactggtgacccgcagccgtcgtcgtcggtggcgaacatcgacgagtggaggtggaagctgagcatgctgcagcgcaacgcggaggagcaggagatcatctccagagaccggagggatcgccgggactacgaccagatcgccaacctcgccaagaggatgggcctctacaggtcttccaccgtaattttgctatctccggttcataattcccaaatgtagatgtcgaaacattgaaatttgtggtttggtgttttctctgtggaacggcagtgagatgtatgggaaggtcattgttgcgagcaaggtcccgctgccgaattacaggccggacctggacgacaagcggccacaaagagaggtgagcccatgcattccactggcaagatcaaacatctttcccttatgcaaattgacggtgtttaaatactgcgaatgcctttgttatgcatggaaatacgcaggtggtgattccattaagcttacagaggagggttgaaggacttgtgcaggagcaccttgatcgtgcactcttgccggataaatgtggaactggaaatggttctgagatggctgagaaagctgagaatgtgaacctggatgagcagcaggattcccttctcgatcgatcggtcatggagaagatccttcagaggaagagcatacggatgcgcaattttcagagaagttggcaggtatgtcactcttgatatgactacgtaactttgaattcaatctggatacaggtttggattatttgaaaatgtttagatggtttatagatctgtacctcaacaatgggtacagaatttagggagctctctatctggataatttacaaatgcctggatacacatagattagagattccttctacagcatttagtgtaaaatttgccttatatctcatttcaacaattccattgtggttgatcatccatctatctgtaacaataggaatcacctgaaggagttaaga

SEQ ID NO: 32581 - DNA, 1501 bp, Oryza sativa
ctggcccgtggttttgcatttggaatctctatataactctggagattctttggggaaacaatattttttagatgaagggaaaaacaaaatactccaatttggcagactgacattgcacagaaacaaagagaaggcctgcagctgaccgccgtacgaggctcaaaacagcaaactttatccttatcaagaaggccaaaatcactcaaaaataaacgatacaatttgtgctgcattttcatcagcaaatcagtagtaaattctacagaggttgaggttcagatgcaggctggaacatgtcggggagcgtctcgagcaggtaggtgaacagcccgcccagcaagaagatgaacacgaacgcgagcacgatcttggtgatgtacgctgccatcgtctcctggtcgcgaggattcttcgccgactgcttcgtgtcatctcgtctctgcatggcaaccgaaaattttattcagagaggaaatcgttgctcattttgttcttgatttccgagaagaaaagaggaggaaaaaaattttctgaacttcttgcataccgtgtcggacgccggcgtctggtagtaacccggcgcgtcctgctcggtgatggtctgcagcttccatccgtcgccgtaatcggcgagcggcgcggcggggccgaagctgacgggctcctcgccgtccttcacggcctcgacgtgcagcgccgccggtgcgccgggggcgagcttgcggttcacggcgtgcagcgcgtaccgcgccgtcgtcccgaacgcgaaccgccgcacctcgccggagctcctgcacttcacctccaagaactgcgagcacacacacacaccacccacattgagccaatttccttctcctcgttctcaagattgaggacactctaccgtagaaaaaaagtaagcaggtttaccggcggtggaggagggtcgccggcgccggcgccggaggctgccttctccggctcgtcgggcttccgctccatcgcgccgccgccttccgatttcgcgatggtcgcggcaaggcggaggaggagttgtggccgactgactttggcccgtgcgcgtggagcagcagcgaggaaaaaagcacgaaagaatccgctaccgggttgactttttcctatccgtttctggtccgggccgaatcgctcagagatttcggctcaataccacgcgggatccaccgtgatttcggcccaagattacgcggaatccaccgtgatttcggcccaagatcacgcggaatccaccatttcgcgagcacacgcgatgcgcacgcgcgaggcggagaccaaaccaaacaccaccgtcgcggcgcgtgcgtctcaccagtcgcgcgagcgagccgcgtgacgcggtggtggtgggcaccagcgatgggcaagggcggcggctgcatcccgagcaagaggcaccgcgccgccgcggcggcggcagcgccagcgtcgcactcgcaccagcgcgagaggacctcgatcccggcgccggcggcggcgccgc

SEQ ID NO: 32582 - DNA, 189 bp, Oryza sativa
ttttaaatctataatagttaattaattatgtgcattgagttttctcgtttcacgtgcactacaaaactttctccaaactaagagaacaaacatagtctacattagggtggacaggttagctcgctcggctcgtgacagactcggctcggcttatttgattttcttaacgagctgagctggcattttagc

SEQ ID NO: 32583 - DNA, 1501 bp, Oryza sativa
ggatttattacttactagtagttgcatcactaggaatgatctttcccaatcaagtaaacacccaggggcatcaaagtaatttcacctgaacattaaactcttctaaacaacctagattctttatatttgtgggtggagggtgtataagattggagaggcaatatttgatattttgtttcttcatgttttgacaaaaaaaagaaccttccttgaaaccaaacacaagagctaaattgtcaatgacaaaccaaatcaaccaagtatgtcaaccacatcaataatagcaaaaacctataaggcacttaagttaagtgtgtcaacttcattgacgaaaagcttccgcatttggctttgaacacataaaccttactgcatacgagggacttgtaagctaaaatgcagcgatagccacactgccctcgcacaacctttaatagtttccttacacaaccaaattctggttacagcattgtacatccaaaacaaagaacataaattgcacagcacatgagcacagtaatcatgagaggtaaccagctaaccgcataataattatcggattacactatccgacaagttaagacatgcactacaaatacagtcatacagtcttccccattacaacaattttacccagattctagaaccaaaagctcaaattctttaagctcaggggaagccataaattatcaacatatcttattacgcggcaacaacaacaacaagaacagcaacagcaacaacaaacaacaacacatccttcgcttagaaaaggcttgaaaggggttaatcagatacattactgctggggcacatagtagtaggcgagcggatcggtggccggcacaccggcggcggggcgggggatgccggccgccgccgcggccgcggcggcgtcggcgtccttggcgtcgtcgcggggcacgatgtcgacgaggaagtcgaacacctcggtgcgcgcgatggcggcggcaatgtcggacttctgcagcgtacggcgcttgttctcctcggcgtgcgcccagccgcggtgggtgagctcgaggatgaacatctcgcaggcgcgggcgaacacgacgggggcctcggcggcgatcatgcggacgtcctcgtcggccttcatgatcttcttgatgcgggccagggggaggttgtggttcttgaagtcggtggtggcctcgatctcgcggtactgctccgcccagaacatctgcagctgctgctgcgccgccgccgcctgctgcgccgccgcggcggcggggggcgcgtagagctgctgcgcgtaggcggcggcggcggcgccggcggggggaggcggagggtacgcgccaggcgggaagccgacgggcgcgcccatcaccggcggcggcgtgctggatttggtgggatccatggctgctgcaagcggagcttagctagggtttgaggaggaggaggggatttggggatggaaaagctctctctttgctgcttctcttcacttgggtttgggtgatggatt

SEQ ID NO: 32584 - DNA, 437 bp, Oryza sativa
caagcccaggcgccgccgctcgatgacggccaccgccccgccgtctcccaccactgccatcgtgcttttgttgtgcttgtgcttgtgctggaatattgaactgaaaaaacacaacagcgctcctttttgtaccttgctcggatcataaaaatcacgaagttttagcatcatttgattacacaaataagcgacatccgaattctgaatcaacacgctcctgtggccgctcgcacaaccccctgcaaagagcggaaactcccaggacttcttgcctgaaaacgagaggaaaagaactgtaattgaactagtgaaagttcatccatgaagacaaatccaaagagctcaatcatacagtataaaaatggcattgtaaattggcaagctgttcaagaggaaggcatggccatgtataccagagttgtgccctgtgcggcagc

SEQ ID NO: 32585 - DNA, 160 bp, Oryza sativa
taataataataataataataataataataataataataataataataataataataaacacaaaaacaaatccatcacccaaacccaagtgaagagaagcagcaaagagagagcttttccatccccaaatcccctcctcctcctcaaaccctagctaagc

SEQ ID NO: 32586 - DNA, 1501 bp, Oryza sativa
attcccctataactcctggagatattttagagccaactaatggcactctgagtatcacaatcaagatatttaaggtttgtagttgaatgtattgatgcttttttgtcttaatctttttttgaaacatcataaatctaaaagcgaattagtggatactgaattgggtgtcaaattaataaggtgtatgaaatgtaaatacatggtttagtgacactaggttttcattttgttcacagtgtttattagtttacattttttttatatcaactgacatcattggtggatatttcaattaactttatttgcttttattgacatgcagaaaaaagatgatggtgactggtggttgtactttggacatgataataacaatcttagccctgtaggattttggttgagcagtgttttaaccaatttggctgaccatgcaaacgtcatagcatggggtggctacacctacacacaatctactactccctccttccctaaatgtttgacaccgttgacttttttaaacatgttcgaccattcgttttattcaaaaacttttatgaaatattgttgacagaaaacacgaggcctgaaagatctgcttaactccagtgcaggtccaaagctcgccttagaatgtatgagcgtgtcagttgatttgatcctataatcaacaagaaatagaagcaaagaaaccgcggttaaatctataaatgatagtcgatcggctagaggccgatgacatatcatttatctttgagccgatgtcatatatgtatcgatcggcagtcatgaataaataagaaggaactaaatctactcgatcggctatagatattaacaatatatactccttatatcgatatatacttaaatcaagtgattgggatagatcaaaatatatattaataatgggactatatatgttcatagcatagccgatcatatagatctagcatgtatcggctaatacttcgataccactctatactaagatgttaaagcaggtagaatatattaaacaaaggcctaatatacttaaatgcaataagatcttaaaataaagggtagatttaacatgtcaataaagtatatagggtaaatatagttaaatcagataagatcggctgaaactctgatgctaccctaatcggcaaccagaaggcaggctagagattgattttctaagcacgacttaatagatcaaactcaactgatacaacattaagtatgaaaagaacaacaatatctagacaatcaagctgctggaagcttcatagagtggtagatatcttatataatctaaatcaacatcgaaatctaacctaattggctgccctctaccgacagatgttagccgattgtagattagatagcggcattgccggagattatgtaagatatatgatagctcgacgaattacataaacgagatcagagtatcataaagatggaagcactaatcccgagaacacaagttgtcataacaagttttacctcttgttgaaga

SEQ ID NO: 32587 - DNA, 1501 bp, Oryza sativa
tggcacgtgttgcggctgtgaaggctgttctgttctgttgtgtcgtggcacacggtgaagccacgtctcgtttttctcggggtaaaagcgggtagggagtgggttcaatctttagtattcggcgttggcatcggaggatgccgatttaccgaaattttcgaataaaatttggtcaaatctaaacacaatattaccgaattcacagaaaataaaaaaaagaataaaaattttgaacgaaatgatatcatatgattcatatcgggggtgcgatagtaccgaaatttagaaaattttgttcgatattttgaactctacgagggacgtcacctaagaacatatttgtctcgtttttatcgggataaaaaccacgaacataagttaaaaatgaaccacgtggagttcgtgtttgtgagttagcggggacgtttttggggtgggccggcccgtcctccgttgggtcgcggaggcccaataaccgagctgggtcaaaaagtggaccccacttgtcagtgggaattgcgagtcgcatctacattctacagcgtcttccatttactgacgaaaacctgcagcagagatgagccgtttcgtttcctttcgtaacgcatcgttggctggctgtcaggccgaggccaggaatgggtctccttcccttgattctctcgctaatattttcttcctccgatcccttccctcgcatctctccgtgtcaacagcgtccatccattccgagcctcaccccccaattcgaacgcattttaatctatcgatttagatctcaagagagaggagagattgtgttcatgggaggaaatatctccatcttagcgtaggtttgggtcgttggatcaagaaggggctaattccatccggcattagcctccttcttggttgattagttaatttttttaactgtttattaaggcagttcttgattcctccctccgaattgatattttgttttgagagatcttgtttacttcctttttgacactttcggcgcggggttgatttctgactgagattttgtttttcttttctgtttctttccatttgattttgcgctttacgttccaagagggagggtgttaggggggggggggggggcgcttcgctcaaattttcggatggatgcattgcgtgtgttcgccatcgatatctggttgtaggcacgttgcatgcgtggttggtttccttggaagatttgggggctttaattgaagcagaaaagagggcagaaacgatttcatatccatcttctcctgcattagaaacaaaatttaatttggcgcatccaggaagaagaggccatataaggagaagaaacccagtcctttccatttcacacacacacaaccacaggcagatcgtccgttgtgttctttgccgaggagcgagatcgacaaagaacgaagtccatgacgagcagcggtggcgccgggtgcagccgcagccacagcttcagcggcatcagcagcgccgcggccaccggcggcgccgg

SEQ ID NO: 32588 - DNA, 1501 bp, Oryza sativa
aagaccaaggctcagaccccagttgagttttgcctgtggaatggagctgaagccccgctaggatcgcctttttccgctgctgctgcttttgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacagttttgccatggaatcaaggactgcagttcgacttcgtcaacatgctcaggcaccaaccgttcggcagcaagctccaactccaggcttcggaacaaaccaagcaccaatccaagctgccacgacgtggtcgcagccaatttttgacccatccatggcgactcagcaagtacctccaattggagccagacagtcgaatgccatggcgcaacctcacgcacaagctgcgattttgcccttcgccacaccgtacccgcagcaaagtgcagtaaacagggcgggaggcgaaaaggggctaccgctgagtgggggaatcaggactcgtccaatcccaccgcagttcaagttcccacccgtcccgcgctattcaggcgaaactgacccgaaggagtttctctctatctacgagtcagcgatcgaagcggctcatggtgacgaaaataccaaagcgaaggtaatacatctcgctctagacggcatcgcccgtttttggtatttcaatttaccagccaatagcatttactcatgggagcaattgcgcgatgtttttgtccttaactttcgaggcacctatgaggagccgaagacgcagcaacacctcctcggcattcgccaaaggccgggggagtcgataagggagtacatgcgttgcttctcgcaagcccggtgccaagttcaagacataaccgaggcatcggttataaacgccgcttcggccggtctgctcgagggcgaactcacaagaaaaatcgccaacaaggagccacagacgctcgagcacctacttcgcatcattgacgggttcgcaaggggcgaggaggattccaagcgacgacaagctatacaagctgagtacgacaaagcctccgtcgccaccgctcaagctcaagcacaagttcaagttgccgaaccacctcccctctctgttcgccagtctcagtcggcgatccaaggacagccgccaaggcaaggccaggcccccataacttggagaaagttcagaacagaccgtgcgggcaaagctgtgatggcggtcgaagaagtgcaagccctccgcaaggagttcgatgcccagcaagcgagcaaccatcagcagccagcccacaagaaggtccgaaaagacctctgctgcgcctttcacggacgctcttcgcacaccacggagcaatgccgaaaaattaggcaacatggcaacgtgcaagacccaaggccgcagcagggaacaactgtcgaagcatcctgcgaagcaat

SEQ ID NO: 32589 - DNA, 1501 bp, Oryza sativa
aagcggttgttattttgacaagcatttgatctttttttcgagttcctattttgcataaagccttgtcggtgtttagggggaaaagtctgcgcgaataggttagtgtttcgctatttgaatcattcgcgagtttagtgttgtatttatttgaaacggagaagcatttagttttttttttaaaaaaaattcgccttagatcgtgatgttcttttagattgaatcggtgtctacgcatgcgaacataaggattaggatctctcttttgctacaaatttggtggagttttcttcgctacgtgcaccctgttctgcttgcaattagtaccgccaagtctctgtttctgtagaaactctactagtgcttgaggtttaacaagcgtgtgatgttttaccaacaacgcagcaatgtgagttcgattagtgccttcgttgtgtttatgggaaggcctgcgtgaatgggttcctgtgttcgcgatttgaatcgtcgtttgtggtggggttcagtgctgttctatttgagtagtagaggagcagaggcattcggttttttccctgtggatttgtgatgcttttgttgttgttgttgttgtcgagtcatttggtggtggctattaacctgtgcgtacatctagatctgtttgttgctagcagtcacgttgaattagtggcaaattatagattagcttgtgaggagatctcctgagtatttgacatagacaattagttaactgcagtagtgtatacaagcatttgcaattcaagttagcaacacactctaattgcaatctgggtccgccagttgcaacggatggcagtactcctgttctctgttcttgctatacttagtgttctctgttctttcagattgaagttaattcaatcttctctttatggtgtaatttgatagctaattataacatgctgtttcctctgatggatcttgagggataatctgcaggtttcctgtgatgtgtttcaggtgtttggcaaaaagaaggtcgagcccatggtcaaggatgcagcagctccagggaagggcgggaggtgactccggtggcagtcgaatctcagtgaagggggctcgcatctgatcataaccaacttgagacaagtgtaaatcctcttaggtattcgatggtggaatttttggagctgtgagatcttatcgatcagtgagtagttctttgctgcgtcatcttgtttgtaattctaggccgtcgtagtttggacacggttggctgagtagtagctactgatgtttctacctgaaaaataaatgtgaacctttaaatctgtttggtagtagcatctatgatttgataactgaagtgcagtcagttaattttgtgccgctgctactctgcatttctgctatatacttactactatatgcgttcttgtgtttgcacctattctaacaatgttgatgtcttcttcagactcatactaatcaacttccctttgacttttctttttcaggcttaagatggaatctagcaatg

SEQ ID NO: 32590 - DNA, 1501 bp, Oryza sativa
tgctgaatctggatatggcgagcttttaggtaatgaatccttctaccagcttatttgatggtaatttatgttctttggagtcctcctcccatggcagaaagataggatttttttttcttagtaaaatttttgtttgaaaaaagggagcaagcaatctgctgctcacattgctgaaatcgaatccaactaattcttctcctacttcttccagcaggaaacaaacgccaggaatgatcaagggccttttgctgatcacgttgggcatcagaaccacatggaaaacctcacagatcatccagaaaaaactctcagaatgcaaaggatctaggattttctccattgagtttgttgccctgattgcattttgcccctttagttcagagttgttcattctctcgtgagtatgcttgagaaaccagtctgttgttcattctctcgtgagtatgcttgagaatcccgtctatttttttatgtgttctgctagaacctgagttgtgtggctgccttctcatctcaacccatagaagctatttctgattttttttggcctgcttgttttgggggctgacatgcatagcattagtaacaccttcttaacataagctccacctactattttactatcctcttttatgtttaagatggttgctagttcaataacacatctgcatccatagcgattccatcatgttgcttcgtttgtccatgcagggaaaggagaccgcacaaagcatccgttaatttatccattcagtatgagataccaaggaaacccactaaaatgatagttggcaacaacctagcaagaagaacctaaggtggttctttttatttaaacatattatgtctgcttttgatttgggtttaatagtttttgttggtgaccatagtattgcgttttcttaaaataagctctcacgttagtaggtggctatgagctaccatgaggtggtcactgttctttgctccttattaaatgcaagtgttgcttgtgcaggtgatggaaaaaagcaacaagtacttagggtttgtcattctctccagcaggtgatatgctattcaatttattatttcctgtgattttacggtgccactaccttcgttctgttctcggaagcaatatagctaattgcctataatagattacataataaaagtttagcgcatctgccaggtagcattttcatacaatgttagatacttacatgctatgcatctattcaagattccttttcttctgtcatgacctattactggcagtacttatttttgggcactcatatggatcttttctaatggttctctgttaaagctacgcattgttcacacatgaagattaagtgaaaaagatgacacacccatcttacctttatttgctggatatgctatattaaaacccaattgtatgtccttagcgtcttaggtcattgtattgcacaacaccgtttgtagatgagctcaatatatatatatatatatatatatatatatatatatagga

SEQ ID NO: 32591 - DNA, 1501 bp, Oryza sativa
cctgtgccacatcactattctgattaagatttcctccctgcagcccctgagcaccatcaccttgaactccatgcaccccgtcaccttgtactccatggactccttgagaattgtcgccttgatttcctagagagccgtcggtagcacctttgatactcggctgagccgagccgtctggagcttgtttcccatctccatccttagaagaactggtcccaggatcatcagcaaccacttttattttgtacttctgaacaagtgtccccttgcgggtctgcatgaatgagttcaagaactgatcccgtgcttgctgcaacattgcttcaaactctttcttctgttcaggtgtgaatttttctggatcgatcggcacgacgtttccttcattgacatcagtcaatcccaatttcagcatcttttccttaacagagcctgggctagatggtggtggtggttgtttctcggccatgaggaagaattgttagctgactacttaaaggtcccatcgggcgtgccaaaagcgtgttgacagaaaacacgaggcctgggagatctgcttaactccagtgcaggtccaaagctcgccttcgaatgtataagcgtgccagttgatttgatcctgtaatcaacaagaaatagaagcaaagaacccgcggttaaatctataaatgatagtcgatcggctagaggccgatgacatatcatttatctttgagccgatgtcatatatgtatcgatcggcagacatgaataaataagaaggaactaaatctattcgatcggctgtagatattaacaatatatactccttatatcgatatatacttaaatcaagtgattgggatagatcggtcgccatgccgagacagtataaatcacttaaatcgaaatatatattaataatgggactatatatgttcatagcatagccgatcatatagatctaggatgtatcggctaatactccgataccactctatactaagatgttaaagtaggtagaatatatcaaacaaaggcctaatatacttaaatgcaataagatcttaaaataaagggcagatttaacatgtcaataaagtatatagggtaaatatagttaaattagataagatcagctgaaactccgatgctaccctaatcggcaaccagaaggcaggctagagattgattttctaagcacgacttaatatatcaaacttaactgatacggcattaagtatgaaaagaagaacaatatctagacaatcaagctgctggaagttttatagagtggtagatatcttatataatctaaatcaacgttgaaatctaacctaatcggctgctctctaccgacagatgttagccgattgtagattagatagctgcattgccggagattatgtaagatatatgatagctcgacgaattacataaacgagatcagagtatcataaagatggaagcactaatcccgagaacacaagttgtcataacaagttttacctcttgttgaaga

SEQ ID NO: 32592 - DNA, 1501 bp, Oryza sativa
gcgtgaagttgaaggagagtatgcagatgcaaatcagagtgttatttccttacttgtttgttatatcaatatcgccgatgtggagcagccgctggttgctgctattggcccaggtgaacacctccttgctggttaaggtgatgcctagcgtttggcagtgaggtccgaagtagtgccttcgcctcaaccgctgccagccaccgctcgctggccaccaccatcaattgccacggtgtcgtcgtcctcctgcatggtgtgtcgccgatctgtgggctgggctgggatcgattcagatcccaaaaaaaggaaaaaaacatagtggggcgagagtggttggttgggtacgggataaatagaatatataccggaagcagagaagttgttttttatcaaagtaaatcatttactccgataatggtgggagcacgatgcgggacgtggggtgggatcggaagcaggggagttttttttattatcaaagtaaatcgtttactcgaataaaggtgggtggttgaggcgcgcgataggagtaaatcgtttactccgacaacggtagaagtgggatgacgaaacgtggggtggggtgggcctgggctgatgcatgtttggcgctgcgctcctaacagtagttctaataaattgatttcaataaatttaattggtttttatgtaaacttaagcatattttttcatattattttcaatccaccttattttaaataatattttataggatcgtagggatcgtagaatcaggatacaaactaagatttcatatgatcgtgtgtaaatgaatactaagattagaataccataaaaattaggatactaggtaggatcaatatcatttcagcttggtacgattatagtatcgtaaaataatataatacggatcgggatactgacaaccttggttgatagtaacattaggggctagattgatctcatttcatccaactacatctaattaatcccatatatcgctattaaatgccatgactaacctataaagtcacgcaataaaattgtgtactggagggcttaattcagggtggttggagcaagggtgagtgaaggtaggtagtgtgaaaattaaatcagaggtgattagtaagaatacagtactagtatatttcggatacagggcctgtttagttaaaaaaaaacttttccaaaaatatcacatcgaatctttgaacatataacatatatggagcattaaatatagataaaaagaaaaactaattgtacaatttgcatgtaaatcgcaagacgaatcttttgagcctaattaggccattattagccataggtgctacatagtaacccacatgtgctaatgacggattaattaggctcaaaagatttgtctcgcggtttccatgcgagttataaaattagttttttcattcgtgtcaaaaaccccttccgacatctgatcaaacgtccaatgtgacaccaaaaaatttttatttcaccaactaaacaggcccacaattta

SEQ ID NO: 32593 - DNA, 862 bp, Oryza sativa
tatagggcgaattcgagctcggtaccctcatgagctgcagttagacgtctaatcgtctcaagttactatacgagtttttttaaacagaattcttatatgattccttctgtattaccaaaagtgaacgatcttaaaaaccaaatcaaatacatatatgtatctccaaaagcaaacgaacttaaaaaccgattcatacacggatgacgtaccaaaataccggcaaaaacatattcaatttttataatagtagagaagtagagatagagaagtaactctcctagttgagatcgattaagtttggttctctacctcatcaattgtttggtaatgttatctggttattgtttgaattggtactgaacttctagaatatgaccaaattaaacgtaggcactaccaattacgcctgtttaaccttcatccaagcctaccacatttaacacccattgatttgtaaaaaaaaaaagaatttgagatactttcaatttattataggggaaaatttataggaaaccctatccttatctttgaaattattatggaatagataaaaatcgtgtgtttcctttttctatccgtacttttttttcagtgaggtgtttcaaaggaactcttactgtttaacttactaaaaaaaattggtaatgtaatttttggtaccaattcgaaattaccttttcttttgttttgttccagaacttctgctctccttataggaagtctaaaacaggtccttcttaacctcaagaagaatttcaaacagtggcacggacgcagtacgcacggtgcaagtaaaagcttgaggtgaagttaagaatttattaagatggcgtcatgggcattagtggcggagctggaacca

SEQ ID NO: 32594 - DNA, 349 bp, Oryza sativa
cccccccccccccccccgggcttgacaagttcagcaaaaccgtagagaaagtgggctacacctagcttagcctatccaatatccgattcaaaaagagcttggattgctaccttttctatctctgtataaagtcaattagtcccagtgttgggaagagcccactgtcaaaagatcgttttgctaggatgcttgcttgaatctagttacttccaaaaaaaggcatttggaactctatacggtatggctacaaaccgaatgaagaagtcgtaatcaggatttgatctatctggatcagcacattttattacaacttctttaggagtatgacatagcccccctccctcccaga

SEQ ID NO: 32595 - DNA, 1501 bp, Oryza sativa
aataatgggtccaccggttatagtgtaaatgtaaattagttaatatagattttaaattgttaatttaatgggtacacaatataataagtgtagagtttattttaaaaccgtgcattatttgataataatagtccaaagtaataaaaaatagatccgatgatttaaataatgggtccatatgtttaagtgcacgtataaatttgataggtacacaatataattgtgtaaactgtattttaaaatagtgcattatttgaaaataatagtacaataatgagtacactggtttaattgaaaattatcttacattattgatttaatgggtaaacgtataatggtgtaaattttattttcaaagattgtagagctaatttagttacctgtgtttataaagagttatatagagttatatgattgtatattctttctttgtaaaattttaaaaatatatatcaattgtataaatggaaaatataagaaaaaagaggaaaaaaaaacatgaaaggagccgtacgtactacatacccatgtgaaagaggagaggtgggacccatagtattttgtttgttttatgatcaatttcatctaataatgtataataatggactcaccaatttaagtgaaaattaaggggtagatgttttgtttttttcttagaatttctagggatttctctaatttattagagcaccacatggcaacttgagagtgtttgtaggaagtttaatagacttttagtatataatagaagatttgatacctctaggtacagtccttaaaaaagtacctaaggtacctaaattttatactaaaatttttgataccttgaaatacttagtacctagagatatcaaattttacagtagaaaaatatagtacctctagtacgtaccttcccaaggatggtaaaaattactcttataggatatattataggatatatgatcacctatatagggcttgaatttggtgtggtttctactctaatattggacaatattgaacttatctacaagctttattgaataaatacaaaattcagcatattcttgtaatccttaaacagaatagttactgctgaacagtttggtatactcagaaattgattgtttggattcatttatctaaatagttctcagtcacttgctaacattgattctctctcagattaagtatatggatcttgaaactttaagaaccaggttgaatgctatcgtcaattctgcatcatttcggggcagtatgtttcattggatttcttcagcagcttcatccaaactaaactcacaacagctgcctgtgatggagatgcccatctaccatgatagagttactcctggacctaataatctgccctcctgtgcatataatgtagtatcctccactcagggtgagttgagatgatgagttacctattttaacctcacaatgcaccttatttttttaaaattctttattggcttgattttggcaggatataaacaatatgagcactgtaata

SEQ ID NO: 32596 - DNA, 441 bp, Oryza sativa
caccacaacgacactccggacgctcacgccacgtggggagtcctaggggatttacgtgccattctaaagcctcagcagcaattcgacgttcatgctcatccttccgccttaggtagtccgatcttgtttcattacgtgggtaagcacgggttccgttgttttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgctttaccagttgaga

SEQ ID NO: 32597 - DNA, 1501 bp, Oryza sativa
tattagcttgtctcttaatcttgtgcacttgcacccgttcgatacaatttagttggatttctatcattagaaagaagtgcatatctcacacgttgcatcttgtatttagacattagattcaaggctatacctcactcgatgtgtgttaccatatttttaggattcaaagttgttggcaacttttttgaacaagtcacaaaatacgatcgaaacacctaaacgtcatatggtgacacggagtcgccaaccacctcgatctaaacaaagctaaggctgcgttcttttcagtggattgggaactcctttcctttgcacggaaaacggagcggtccattagcgcgtaattaattaagtattagttaatttttttaaaaaaatggatcaatatgatttttttaagcaactttcgtatagaaactttttgcaaaaatgcactgtttagcagtttgaaaagcatgcgcgcggaacacgaggaagaggggtggaacattgagcaaagaacacagcctaaatcaagatgagttttgtaaaattaaatcggccagtggagccgatttagatgaaacagggataaacacccgtctcatgggcaaatgaaaagtttacaaaagggtatttgcactcttacagcgaggatagatgacagttagttcaaaccgacaaaaatggacaaaactaggctagaattaggcagaaagtatatgcgacattgaaaaagtgattcaattggctaattgtgctagaaacagattgtgtggtcaatcgaactggtcttgacccttataaagaggtttatcttgctttctataagacctcctccacgtctaacttagggtagagatcaattaggactcgaaaaaatagattaccaaacaatgaaactcgagactcagactcggacttagccggtctgactagtcacaagtcgtcggtcagactggtcatgtgaaagaaacgtacttttcaaactctgacaatgatttcctatttcgtgtcaaggtgttaaatttttggtgttaacaaaaaccatcgtatctttttcatttacagtagaactcaactacgagtaccaacttatgacgaaaataaaagattcatttaaacgggaataaattcgtgtgcagtggtgggtaagtgtaaaaaaaaaaagccaacaatcccaaaaattcacctgagcattaacctgccaagtcgtgccaggccataccggccaacattacacggacgcatacgtgcacagggcttccacgagaccagccacgcaagcacctcccctgcatcacccaccgtccagaactcgatcgacggcccagataatcccacgtcgtatgactgcaaaaggaagaggagataaaaactcgagaaattaagccctgaaccggaaggaccccgagaggtcgtcgaatggcaactccgcctccctcgaacccgacgacgacgctccgagtcggctctcactgatcgcttctagaagcttccggaaggctccgaccccccgcca

SEQ ID NO: 32598 - DNA, 910 bp, Oryza sativa
gggagtggaagggtgtggggtggaggagaagcggcgctggcagaggtggaggagaagcggcgccggtagagtgcgccagagattggggaaacgcggcgcggcgatgacgcgatctcgatccaggagaggaagcgagggcgtcagcggcgggcccgcgcctggcacgcgcgcgatggaggaagcaagggcgttcggcggcgggcccgcgctggcgcgcgcgcgatggggagagggggagaggaagcgagcacgcgcgatggggagaggaagcagcacgcgcgcgcgatggggagacccggcggcggcggggacaacaaatcggtggcggagggatgtgcgtgatggattgcgatccaacggctgatgaggattcgatcgaacggctgaaaaaaaaagagtgacgtggcttaaccacagctcaggaaaatccctaataactacactaagtggggatcaattgtatagtattataggataggataagttgtgtaactacttggaaaagaggattttaaaggtattgggtgtttatccattcgcatactgtaaaaataaatatggtgacacgtggcaggccacacccagaaatatgggttataaatgcctaatgggcctcagcccaaagagagctattcaacgaaacccgtaaaataatcaccaaaaccgcttcatcatcttcctcgccgctttagcttccaaattttccctttcacgctcctgttcaccgtcgtcgccgccagaacttgggcaaagcttcccctcacatccagccatcaaagcgctccagattctgcgaaaatccaagtgctctagattccgcgaaaatccaacgcgggcttcctcctttcatctcccatccccaagttcagagccaaaaaattctattccaagttctcctccatttcattca

SEQ ID NO: 32599 - DNA, 1501 bp, Oryza sativa
tggccgaggtggtggaggaggcccttgaggaggatggaggcgactacaatgaggacacagacggctgccatgacagggataaaaaactgtagatctttagattaaaatttgaggaaaatttgattttatagttgctatcatttagatagcacaccagcttgattaatatgtaggaaaattttaaaatctgacaaagacaaagacaaagacaaaatacaaacacaaatatgacaaaattttaaaattgtgagatgctgacaaaatatatataaaaaaatgacaaaatgcttaaaaatccgttcgccgccatcgatagcatcatggccacgtcgacgctagttactattatgaagatagagcattaatttgattaatatgtaggaaaattataaaagttgacaaagacaaatatgatagacaaaaacaaaataacaaaggaaaaacctacaaaattgacaaaactacatctacatatatatgaatgtgggtaatgatagaaagtcttataatatgtaacggatgaagtagctaacaaaattgacagaattaggtactgttagtagcataattagttttattgctggtaaaactaaataatgtaagtatatgacaaaaaaaaacttagaaaatttactactgatagaaattttaattcaaaactattttagtagaaattgtacttaattgaaccagagtaaataatctttcgtaaaatgtcaattaattgcaaatctaagacttaattgaactactcatcacaaaaactaaatgattgaaatttactttaaaaaactactcatttatagtgagaacaaaacaatttctctaatagtttcccccacatctggcaaagagtaattactagaagaaggaggccaaaaatacacacactagtatacaaactcgcacgctcaatagttgagagtcagaatttctccaaggataatgaaaaaagaagacaattttcctcatgtcaataaggagaagctggagcacatgattgtaccagctaaacactacactgctcagtgagccatctcctccctggcatatggtgggcaccccctaacactacttttgcgtgaagaaaagcaaagctttgcaaatcaaagagtacttcctagctagagagtctcctctcctctcctcctcgaccataaaaaagtaggtactcaggatcacatatctatgtaataacaaaacaaaatgcggttaaatagtagtatcagactagttgctcttacagtagcatgctaagaaaacttgctactcagatatggagtcactaagctctccttgtgaaaaaacataatgtattacaaaacttcaaaagttctgaagatttatgtaggtttgcgaagttctcttaacagaaagcatatatagatcaatacgtgtctatcaaaatttataagaaaaatccacaattattccttaaatctaatccaaaataaaacaaacaagccaccatcaattccagctgcataatcatgcactgcct

SEQ ID NO: 32600 - DNA, 1372 bp, Oryza sativa
gtgagtaaatgctagtaggaatgaataaactagaatttgattaatcggattaaaatccttttttaatagagcaacatgtgagtaaatgctagtaggaatgaataaactagaatttgattaattggataaaatccttttttaatagagcaacatctatttcccataacattatttcataaaaagcatattggtcatagtaaggataaacaagtgcgatgaagttacactcaaaactaaagatccattcggcgcatttcattatatgattatcccacactaatatgatgtatctcttagtttttgtctatctctaaatctacccataagtcatagcaagaagtatcaatggctccgtcgaaattggaattcagcaatgatgaaagagggtagcacacgagacctaaaagtaaatagatgcggagacaaggatttagatggatttagacaggttcagaccatctcaataagaggtacgtaagaccctactcttgtttggagattgtatctactgggtgtagtattgatctgacgatctaattgtggttatatgtgttcttgctcttgaaggactctcccagctcgtcttatataggttgggggaaggattacagaggagcctgccttttatataggctgggggaagaattacaaaggagaaacctagccggatacaacattagtttcctaatctattatatgatagtactcggtcggagctctatacctgccttaacatacaaggcaacataacaactgagcaactgagttctactctattatataatatatgaatccggtccacctactatctctagtcgaatatagaaaccgtgtggatgtccaatacacatattctctacagcctcatcgatgtttttagttttagtatatacgacattacggtgagtaataataagacttgcaaccttcaagttaaaagatgtaagataggagtgaattagcccagggcatggccttcaaatcgcaaccttatgaaacccctttcctaacccaaaataactctcggccttagctcctaccgtcactcccacgtgtgccgagcttgcgcagccaacgcatccaggacctgacacgtgcgtagttccacgtgtccttcttctccatgtcacgccggctgccaccaccacggtataaaatcttgcggcattgcacggcgcgcgctgcggcgagagccatggcgcaagttcaagcccgacgaccaagaggaggagaatgccaaggtcatcaggtagtacagcctgatggcggcgacggcgacgccgagcggcggctcatcgccccggcggacgcctcggggcaggccgcgcactgcggcggccccgtcgtggaggtcgacgacgcgtacgacagc

SEQ ID NO: 32601 - DNA, 1501 bp, Oryza sativa
taattattgtgtgcatggtgccacacgctgcacatattcaggcgttcttgaatggcgccacacgtttaggcgtagttgaatgatatgaagatttagcaaaactatcgatatcctacgatatttggatagtgataacttgctagttcttgtgggaatcaagcaatccatggtatgaaaattttgcttgaaccatcaagcaattaggaaaaactggggcaagatttcacaggttgtgaaatatattttgtcaaatcaggttttagagcaggaaatatatgagataaatctgtaggggcttgaaattgaaatgttgattgttcgccgtgattttacagcataagaaatataatgctgctagaaatttgatgaaaagtcagggattataactaccaagcaatcagaacaaggtcttgcaaattacatgcttgcttctcataaagtgtccatgattctcagatgggttatcacaaagagatttgctccggtccggcaaaaagtatctcaagatactggtacctcattgtactaaatcattttcggtcgttggatctagctgggtagaatgagaattgttaaatctaacagtcggaaacgaggtaccataaggtaccggtatttcgagatattttttttgttggaccggatcggagcaaacctctatcacgaaacatatactgttcaggtgaaccattgatgcactgcttttcttgaaaggaaactcccattttttttaactgaacttctcatcgatgcacaattatacttactcccgtttattacccgaacttgtcaatataccaactgagccataatccataaatataccggcgcccaattgatgcatatttttctccgttgcaatgcaccaacatccaagtagtaattcagtattccttgcagaaaaaatagtactccctctgtttcaggttataaaacgttttgactttagtccaagtcaaactactctaagtttgactaattttataaaaaaaaatataatatttttaacccaagataaatatattatgaacatttatttttattcaattatagatttaatgaaactatactggtgttgtaaatattactatttttttctataaaattagtcaaacttagagtagccatcttataacctgaaacggatggagtaattcagtattaaatatgaaggggatttttggagtacattaaagtggacactagctatttattgggttagatccaacggagatgctgtcctactgcacccggtagtagtgcagtagaattggtggaggggtaaatttgtactccatgtggtatgggtatgtttgtgttagattgatctctggccatcgagtcagagaattgctctaatgggcttggcccaccccaagcccacgcgcacctaacgttaaggaccgattccctcggtcccgaatacacgtcgctctttctagcgctatgatcggaagcgtttttttcctcaagaagaaatcgcccccgatccccttaatac

SEQ ID NO: 32602 - DNA, 1501 bp, Oryza sativa
aatctactccagctcgaacaatgatgtgcattactgatgtttaatttggtcaattcacactcatgtgagtggatcagcgtatgtgtgttccaatgcaaagttgaagtagctaattgcactggtggatatatcttcgtttggttacctgacgaatactgtattccaaaacaactaacgccaatataaacacgaaaataactgacgaaacaatgaaacatcttggagacaatgagctgcattctgaaactgtgaggtgagcctgagccaggagcatcgatctccagttggtccatgtccaccgccggagagaatcctgagcacgaggcgcgtgtaccacagaaaagcagcgagcttcccgtgctttacacgaagaacgcagctatcacgtatgcataatttgcatatgcgtccaacgagccgcgtcggcgtcgctggcttggcccggtgctcgatcggtcgatgcttcatggctaagatcgaacatgagaacgttcagaaagagcaaaaacgcgttagtatcgactcgtagcacatggcagccacaacccttttgtatgaaagaacactttggcgttcccacacaaaaattttacaccatgtcacatcgaacgtttgaacacatgcatgaaatattaaatatagacttaaaaaataactaattgcacagattgtgactaatttgcgagacaaatcttttaagtctaattgctctatgatttgacaatgtggtgctgcagtaaatatttactaataatggattaattaagcttaataaattcatctcgttgtttactgacggatcatgtaattagttttttattagtgcctaaacatcacatgcgacaccttatataatacccgatatgacacgctaaaactttacaccctggatctaaaaacacccctttgtgttagctgatgcgcacacaataggatgcctgcctgctgcggcagagattctcgaagaatatgtcctgattagttctggtctactggtatgctgtttgcaaaagctaggatggatctgtgtataatgccggtcatttccttgtcccaaactggacggagctgcagtgccagcaaccgacgcccggcctcacgtgaaaaagcagatgttttgtgagttgtgagtttcattcctgtccaaactcttgaccttgcctgacccatctagcagcgagacgcaccaaactgtggttaccaactttactccacagtacctaccatagacaccacagaagcagaggccatcacgcatcactttcttctatcacatctaaagatcagagtctcccggagatctctctatgtccctgaccctcctgagacactctttttacaggccaaaagttccggtactatttgaattttatcaaatttgaaaagccattcaaaatacaaatgtgttattcaaaaaggtgtcggcccccctcagaattttccccgaacctgattatgactgtcagtgcatgagttcaaaaagagtgtcatgtgaaaccga

SEQ ID NO: 32603 - DNA, 1501 bp, Oryza sativa
cttagtcaatacactgtcgaacatgatgaaaacgatagccgatggctcgatagctgagcatcaggctacaggcccggcatacttgcaagaaggcatttttccgaattatcgaactttgatcactgatgctcagccagttgtgcaggcgactccatctgtcgaacccacgactcaaccaacagcgccagcatcaacgcccttacctgctacatcggccacggcgtcagcttagccgatcaaccctcgattgctaatgagggaacatccacagcttgctggaaaagcctcgaatcagccgactcaagatcaggttgctgctatgttttttccaccaccaccagttgttgattcagtgcagcagcagccgatccagcagacgtcatcaattcagccggttgtacagccgatccaacaacaggtcgcgcagccagctcagcaaacaccaccaattcagccggtggtacggccgatccaacaacaggtcttgcagccagttcagcaagcaccatcaacgcagcagcatctccaaccaatccagcaaacaccgccaaggcaacgccttcagccgatccaacggactccggtacgacagcaggtcgttcagccgattcagcacctggggccagccaatgcatcggctggatttgcagcacatggggggcaacctgcgcagcagtttgtgaatcaagttatcccggagcatttggttcatcatgcacaaccggatggcaccttagtaactcatatggttcctgagcacttggtgcacaacattcagccgaatctgcataactaccaagggggtaacttgaactatcagtatcagctttcatctccgcaagcccaatatcaaccagggggatcggcacagcaacagttcgctcctcagtttggtcagtacgagcccatgcaacagcaaccacaaggagcagctctgtcacaccccgaagttctttcccaagcctaaattgaagttataaatggtctcaagaaaataccagtgtaaagcaagagtaaaccttaataaattaatgcaagtaataatcggaattggcatgtggaatttttcttgagttctacatgtcgaaattcgctaacaagatttttagtggaattttcagagctctcgaaataattttaatcaattaaaattgagcacaggcaatatttaaatccctgggaattcctttcttcctttttcttttttctttttccttagtgggccgccggcccattccccctcctctctccccgcgccttgctgggccggccggaggccacggcccaactcagcccgcgccccctcctctctctcggggtcaccgacaggtggggcccacctgtcgggtcctcccccaacctccagccgctcgccgccgcacccgcaaccgccgtcgcgcctcgcgcccgcgcctcccgggccacgtcgtccacgtcgccttcgcgcccgcgcctcccgcgcccacttccccctctctcccgctcgcccgcgctcccgaga

SEQ ID NO: 32604 - DNA, 1501 bp, Oryza sativa
aactagctccattaattaacctattcatttttccctctcgtttcgtgtcgagtcgccgtcttgttcccatcacgctatacgcgcccaaaccgtccgttctcccggccatctcgacagcgaccccgcgagtccgcgacaccctcgcggcctcgcctcgtcggacccctgggcgtacgaatcgcgcgcgtgatctcaccccgaatccaccggtccaaggctccccgtccaatctccggcctccgggtcaccgggtggcggccggcgggtggtagctgcgggtcggctcagctcgctgctcgcctcaaggccctcgcctacagcacgggccacggcacgacacgacaggacggctactcgtacttgcttcagcccgggtggaccacatgtcgcgcccggcgcccgcgccgtccgtcgctctccgcccgttcgcgtctctgtctgtccctggcctcccacacgcttcgtcgacgcttcgtctcggcgattcgcggcttcgtgcgctacgggagaaaacggcaaagccgttgccgccgaaacaggacacatgcagctacagagctactgttgctgctgctgctgtgctggtggtggcacagcgcggcgtatcgtgctggtgtattctattgctatcatcacaacggctgtgagtacaaatttcgcggcgatcgagaaggttccacggttgatggtgtgacatgtgcgcgtatgcatgtgtgggttagtgccacatggggagggagggtgacgagagcgagacaggaatactcttgtggtgttttttttttctctgttcttttctcaaaagaagagtttggatgaagattaagatttttatgccatgctttttaaactgctaaacggtacgtttcgtgtgaaaaatttctatataaaagttgctctaaaatatcatattaatctattttttaagtttatatcaatcatacgttaacaccacctcgttttgcgtaaaaaaacttaatcttcatttttatccccatcccaaagataaagatgaagattaaatttttcacagaaaataagatggtattaacgtatgattgattgagttttaattattacaaacttgaaaaatagattaatatgatattttagagcaactttcatataaaaagttttaacacgaaacgcaccgtttagcagtttaaaaaatgtgccataaaaattttaatcttcatcaaacaaactcttgttggagaaaagaacgggccctctatatagcgaaattgttgctgttttcctggagtgtggtttggtttggtgaagtatgcatttgcttcgctgcatgattcgatcgatcgtccatctgcacagcgagatcatcgtggtcggtcttggtggcccacctgaaagcggcactcacggtcacggagaggtaacaccaaacaagctatataacagaatcccgttttaaaacgggatgattctgaataggtatcaggtgtgatacctatcaggtatcagacgattcgacacaacagga

SEQ ID NO: 32605 - DNA, 515 bp, Oryza sativa
atatagaatatcaagcaaaaacctaatatattcaaatacaacaatatcttggcataaagggtagatttaacatatcagtgaagcaaatagagataattatagttaaatcagatacgatcggctgaaactccgatgctattctaatcgacaactgggtggcaggctagagatcaatattctaagcacgactcaatagatcaaactcaattgatacagcattaagtatgaaaagaagaattatatctagacaatcaagccgctagaagattcatagaatggtagatatcttatataatctagatcaatgtcgacatctaacccaatcggttgccgtctgttaatagatgttagccgattgtgggttagatggcgatgttgctagagattatataagatatatgataactcggcgaattatataaacgagattagagtgtcatgaagatggaagcactaatccctaagaacataattcgtcacgacaagttttacctcttgttgaagatcggaaccga

SEQ ID NO: 32606 - DNA, 1501 bp, Oryza sativa
agtattctccaaagtttgcttataaatgaattctgatgaggatttatagatagccataattcaattaaactacagttattgggaagaaatatcaagttcatctacctttctatatcagggtattaataagaaactaaaggggcattcacagcgaacaattcgattctggcatcaatggaggtgaaaaatgttcagcctccccaaaacgcctaaagtgtgaactttaaaacaagatcaccaaaacataagagacaggactctacacccgatcaagaaaatagagaagaaccttgcttaaattttctacaggacaaggtaaaatcatctggaacaccttgccactggccaaaactaaccacccaaactaaaagtagtgacttttataagcagatcagtggaaagccaccaaacacactatcacgtagttgaacctatgaccctgtcacgcagcaaaatctacagaccagcatgccaatccatcgaaacatcatcgaaaagttcgtaagtttgcaccacgctccaacgaattgactaagaacagccaccgcgccaagttaatttagttcataaactaaaatcaaatcgaaacctattcatgaaatatcttcatatcaccaaatttccccaaacttttgcaccgcgaaatcgcagatcgcaaaaagaggaccacgattccacctgatccccaatccagcgtgccccagatcacgaaaaaacaaacccataaacccatctagttatagatccttgcatcgaaaatcaaaagcacaacgaagacgaggaggatcgggggcgggcaccgtgaggtcgatgccggggtggtcggagctccagaagatgtcgtggtcgacgacgacgaagttccccgacacggtgtccccctcgtagggcacgaactcgtggatgcactccgtgtcggtcaccgtcaccgacagcgcctccccgcgccacgccgccaccgccaccaccaccaccagcatcgccggccgccaccccaccgccatggcccaccgcaccgcgtccgctctcaccaccggcgcgtccaccccctcggcacgagcccggagttcgcacggggaggaggaggaggaggaggcggcgaggtcgaggtcgatggcgatggagaagtagccccggcgaggaggtcacgggctagattggggagaagagggaggctgcgtgtttttgcagaaaagggctcagcgaatcgcgtaattctgcgggttttgcgtgacgtggccatgtgcgcgcgagtggctgcttgtgtcgtacgtggcgaggagaaggtggctgatctagcggagtaaatagcgtctctcattatttacgtaatcatgagtagaagacgtactctagatatttgggctgggccgagaaacacgtcccgtatgaaatttctcctttggaaataagtccacttgacgtctctcgtctttacgttgagtttaattcacacccctaaaaccgcaagggaccacctatacatttgtcagacaaattt

SEQ ID NO: 32607 - DNA, 355 bp, Oryza sativa
aatggatgtagtaggtatttgcttgacgtacgttatttatgagggatgtagtaggtatttgcttgacgtacgttatttatgagggattgtatagcttttagtcacatgataatacccataaatttagtagcttttagacgatccagaccacattaagatttgtgcaactgtggtaccctacccacattatcttatctctcttcctcttcctatctttcacatgcgcaccactcgaacatatgtctcctatgcctgagctagcgtgttaccctcccagccacactactgctggtgagacctaccactagtctcctccacctccttctcccctctcctcctcctcctctttctcagt

SEQ ID NO: 32608 - DNA, 1501 bp, Oryza sativa
tcgggaacctggtgacggcgagggcggcggcgaggatggggtggcacgagggcgccgtcgccatgttcgccgtgggcgccgcgcactacctcgtgctgttcgtcacgctgtaccagcggttcctcggctccgactcgctgccggcgatgctccgcccggtgttcttcctcttcttcgccgcgcccagcatggcgtcgctcgcctgggacgccatctcggcctccttcgacacctgctgcaagatgctcttcttcctctccctcttcctcttcgcctccctggtaattaagctagctctccacagcaaaagcctcgcgtttacgccattatattgcatttgcacgcaaacgccgaggatgaacgtgatgagtcagcatggcatccgatccaaaccgtcccattttttatccaacgctcaagataaattccatttctaaagggtaactctaccattttaaaaaatatcgagaggtatcttattttaaataatgtaaaattttagtatcatatctctatctctactattataaaaaattgaaaatatttttatcggtgttttggtacgtcatctttgtttgagtcggtttttaattttgtttgcttttaaaaatacaaaaggagtcggataagaaatttctttaaaaaaacttgcaatctaatttgagacaaaagtcagactcctaattacagcttatgattttctaaaaaaaaatataagtaaattcttacagtgaatttcaccatatctaaatcgtataataataataataagattaaaataacatttacccgttgcaaagcacgggcatttgtttctagtattcttaaagatcataaaaattctcatttctaaaagaaccacagcaccatgtgctctccattgatccaaaactttcaacaaagattcctcctttaacccctagaaattaggatgcatttgacaatgaaaatagaagtcctatatagatgcatgatataggtagagtttatagatattgcgagagaaaactaaaggatgggggaagagaagtgggggatgcgcattttctcgaaatgatcaaattctgctccatccatttcgctgagaggttcttttttccctcagctttttagctctgcatctatctatctcctttttgcttttcgttttcattaattttagtggctgggaaagaactgatccaactaggatcgtgtaggactgtaggataccactagggtgccacgtatgctgatcatcctctttctctaaaatatatatttatgcatgtgtgtgtatcgtgccagtgcctccagactcacggccaactaatcatgcttagttagcaattaagccataaacaattctctttagctgaaaaaaaagacgaatctttagaaagcaataatgcatgtcatgaagcatggttaattatttttattttaacttaaaaacaaaataaatgaactaatagcttggatatgatgcaggtgtcgcggccgacactgtttaagagggcga

SEQ ID NO: 32609 - DNA, 1501 bp, Oryza sativa
ttttctatatgactttgtttgaaccgtttgaatttaaatttcaaaatatgacaacttcaaacaacattttgaaatactaaatgatttcaactgaaaaagttatcaacaacaaagtttcataactcatcaagatctataaattttatttgggtcattttttcatccgacaaagtgatagtaactttgttcacaaaatttacatctatctcatctggttctatagactataagagagatatgtaaactttgtgaacaatgttactatcactttctcggatgaagaaatgaccaaaataaaagttctatgtcttgatgagatctacaattcaaaatataaatgtagttttatgttcatgacttttttagctgaaattaattacagcttcaaaatataatttgaagtttttgaaattcaaatttttaattgataaaacaaagtcacacgaaaaaaaagtccaaaataatagcggtaagaatacaataacatgatagagcatgattttggaaacatttaggaaaaagaatcatccaatttggagttcatatgagtgagataaactagttttaaagtttatttttgcatacggcttcttaagacacccttatggaaaaattgatttttccatgcgggtccttaagtggtccacatacaaacaaatgaaaaaaattcaattattaaaaataaccactcaaatttttaaaaactttcatgttcaacccaaaatttaaaatattcaaccaattttcaaaaatttcaatgtgcatgcgaaaatttcagtgatgcacattaatttatttgttttatgataacataaatttgtatggaaagtaaacacaacattttctatctcccccttgcccttataaatagagataaaatttgaaaatggtgatgttttgtttttgaaaactaatggctacagctcttccttgatttaagaagcttattttgaggggtcttaatattttgataattattcgttagcgtattcgtttcaattcgtattcgctccatacctgtattcgataatattcgattccgttttcgtatccaggttttcgattccgagaaaaaaatatgaaaacaaatatgatagagcttgtttccgaccgtattcgattcgttttcattcctacatatgtgtgtactgcgattttttttcttcctcaccagaacaaatcttgtaatagatctaatgattcaaaattgcgtgaaacttacatacaagttacactgtagtacatgcaagttacagtgtaattacatgcaagttatagtgtaattacactatgattgtattataattatatctgtcaaatttttaggagaaaatttgtctgacaaatgtataggtggtcccttgcggttttaggggtgtgaattaaactcaacgtaaagacgagagacgtcaagtggacttatttccaaaggagaaatttcatacgggacgtgtttctcggcccagcccaaatatctagagtacgtcttctactcatgatt

SEQ ID NO: 32610 - DNA, 233 bp, Oryza sativa
ataccatgcatgaaccctacaaacatatgcaagatagtgaagcctagcaccaaacaataaccactatacgtgaccgttcgtcgctaagcggagactcccaaaagaaaggcttggttcagtctgtcgaatatatggattacaataagcataacttgaaatgttgatgatatgctagctgcagcgcatacccatggtggcaatggtgcaagaagtactaataatgaactagccct

SEQ ID NO: 32611 - DNA, 1501 bp, Oryza sativa
gctgaatggaattttttattttctatgtactggttttcatgtacattgtggatgctctaacgctggagagggaacacggaagacagcgacccggctcggacagatccggaccctatactatacatatcccggcaaaacaacgtgatctcgccggcgtcctatataaccatggaccatcgatggtatgatggctggtactcctatatgatgcctttcttcgccggatatcttccgtgaggtaggacgtctgcatgtgtgccgcccgggtccactgccgcctcgcttccgtactgtacagtgaggcggcagatatatgtatactccagtagtaataacatgtcacagtacatgtacgctagctgtacatatgtaccaagggttgtgctccaattctccaaagctacaagactgtagtactagtagagaacggcctaacccctgaagggatatgcatggagtgggtaccgtccaaattcaggacgcacacgatctagataaccaacggtctcgtgggatgctgacgttttttggcactaattttcagcaggtgagcacctaccgttgcgttttcttgtagtcactttcgtgtaaaaaggcggataatgagccaaggataaacttattatactgggacatatcaaatcacgattgcatcacataaagctgagtcaccagatctacccaacgtaatccttttgtggtattgcaagctacgaaccggaagtcagaaacggaaacctgggtgacttgtataggttgctgggaaaagcagcggcaccacacgcacacgttcactcgttcagccgatgcggtaaacgtccccggccggcacgtcgcgatcgcgcgtgcgccccgcctcaaacgccaagcccaatagccgaacaatcgcgttccggcccatgaacaacagcacaagtagcaaaacggggcccaaacgtagcgacactcgcgttccggtcggcacgcacgtacgctggaataagtccactttaagtcccttaaccagtgaccgaatttgattcatatccttaaaccgcaataccagtgttgacgtaaaacacgaggcctatatctgcttaactccagtgcaggtccaaagctcgccttcgagtgtgttagcgtgccagttgatttgatcctgcaatcaacaagaaatagagacaaagagatcgtggttaaatctataaatcataaccgatcggctaggtgccgatgacatatcatttatctttgagccgatgtcatataagaatcgatcggcggttataaataaacaataaggaactaaatctattcgatcggctgtacatattaacgatatatagttcttatatcgatatataattaaatcaagtgattgggatagatcggtcgccatgccgagacagtataaatcacttagatcgaaatatatattaataacaggattatatgtgtttatagcatagccgataagatagatctagcatgtatcggctaatactccgatactactctatgt

SEQ ID NO: 32612 - DNA, 1501 bp, Oryza sativa
aagtgtcaatcccatatcgttttgaacccaataacataagaatgctagctgttgcttgagtgtttaagaacgcgctcattctgaatatgcacaaagatgtgctgcataactgcttttgttgttttggggggggggggggggggtattagtgttaaggtcaacagtatcaaagctttcttggccctttttattaagcattgctttctaaataagcttcacatgtttgctaaaaaatgaattcatgctttcagatttgaaactcttatatatgtagcatcaggatttatgatgaatcattatatttcttgtcctttctgttcagagttctctctctgtcttgaactcaaaatggactttattgtttcaaatgagttgtccctatctacaaaattattaattagcactgatttttctgcgttattgatcaatgaatatttgtctgtgaagtatcaagtatcatctgatgttgatgaggaagattgtctatgtttgagaactaaaatgaagatcatggacttacggtgaaaggcctaaggatctgctattctgctccatctgactacgcctcttctcactaaggtgattgatccacttatatgaccagacgaccttttcattcaacttcaaacggcatgtgatcttaattgagaagatttcataagtacataactaactttccttaatttgatctaggtcttccattaaaaaaatgatacaggtcagagaccagtcactgctatgattcggatctactccctccgtctcaaaaaaaaaaaggcaaaccctgagtttccgtgtccaactttgattgtccgtcttatatgaaatttttttataattcgtattttcattgttgttagatgataatacatgattaatattttatgcgtgacttgtctttttaatttttttttatatttttttcaaataagacggacggtcaaacattgggcacggaaaccaggtttgtcttttttttttgggacggagagagtatatgcttctgttggccagtgcatgcaagacaagacattttttacggactgaaattttatggtgcttggaataaatcttgtaacatttgtgacttgtgggctgtgaattgtgatagagatgacctggtaatctttgaaacgagttgttaaaatacatgtttttagtggaccaattggtcgctggatgacttacttgttcgtcctatgtccccagattggttgtcattctgaactccgtattttacactgtacatgtatatagcagtactgataataaatgcgctcttcgtccaaaaccattagtagtgaaggattttacagtaaataactttaaatttcggtatgaaacaggtaaatatcctgtgccaaaaaaccatttaagcaggcctaccgctataggtgcaggattttacagtaaataattttaaatttcggtatggatcaggaaaatatcctgtgcctcactgcctcctgggcgaaaattcatttatacagggcctggcact

SEQ ID NO: 32613 - DNA, 1501 bp, Oryza sativa
taccaaaacaatcttgaaatatccaatagatgatgacacgatgtgcgacactagcacaccctatcgccaattattcttcatcaggggtaatctatacaaaagaaatgtcaaattaatgaataatgacaattaacaaacaatagcttcaaataatttaaagtagggaatggaggcatggagtagtaacatccgacttgctttcatatcttcaaacctttggataattttttcattactaatacttttaaaaatttgcttctcactatctcagtatagcatatcatcgagtcatttagccatcttcacaatctagcaatataacaaagtagcaaactaggaatcacaatctatgattttttgaagacttgaactatcaataacaactagacatgacaattgaaattgattttaaatgacaaatcagaaattttatatacctcacttgctcaaatcctcaattgttgagttgttgccttgcctcttggcgctgttgcttgccttgctgccttggtggttgcctggttggtgctgtccggcttgcccgcttgccttgttgctgcccggcgctgctgcctgcttgccttgttgcctctttggctgctgctgtgtcggcgcgccgccgggtccccccgccagaccgcccgcgcgccgcgccctgcctggctgccttgctgccgcccggcgcccccatgccccagcggccagtggccggtgagccgcgtgccctggctgctgcagtgccggcgcgccccctccgcgcgtcgggtcccatcgccggcccccgtccgcctcaccggcgcttggagctggaagccatcgcgcgccgagtgcactcgtgtgccgccgccgccactagtctccgcctctcttcggctggggaaaaaagattagggttggccggttgggtagggttgtgggatattttgggccttcccagcctgttgggccttctaaaatctcagaacaaagtttattttagaccccctttgggattaaaattgtagggggtattatgtgggctctaatggttcgttagggggtagtgggggcttgagaccccctgcccccacgctgtctccgccactggcggtgatctaacgagtttgggtttagacatcggcatgaagataggctgagggcagggagtgggaggatgttcactatgcttaaatgcccttgggagatgacggaacggctactactttgtcgaggctatgagatcggatgcgaatgatgggccggtgtagcaaacagggtgtgggattctaacccgttaggagtctgtgttagtgttggtgtcccgccaaagacaagctagatggtggaatggaacaccttatcactacccagcttgggaaggagaaggaccgaagggagtatggtaaggggaggatcagtttggtctaatgagtctcactagcacctttagggcccctttaaatcatagggtagaaaaaacagaggaataggaaaaatataggattctgacaggaattgaagt

SEQ ID NO: 32614 - DNA, 1501 bp, Oryza sativa
tgtacagaacaattaggagactattagttactatctcagttacaattacagaacgtctgaaccacggttttgagcagccgcagaataattctagcaaacttttggcccaccgtttcatattataaaccgtttaactttttttcctaatcaaactttgttaagtttgataagcttatagaaaaaattatcagcatctaaaatataaattagttttattaattctaacgttgaatcaattttgataatatgtttgttttgtgttgaaaatacacaagtgtgaggattattccaacaataagctggtaattagtaatccgtacagattgaaaggctacagcgctgcatgcatgcttgctcctttcatatgatcttgaatattcatactctgattcataaaactgcatgctagacagttatcgctgtctaataagtaataatgcaagtgcaaaagtattcaaagatccatctaaaaaaaaggacgaagtgcgagggacttttagtactatgattgtgtactgatgctagcaccaaggctggtttatttcatcatggaaacatcaactgcatgtagagcatatcctcatttagttggtgttagtggctaccatagttatgaagtctgaaaattagcgaatgtaatatgtactggtgcaaccgtataatagaattaatgtactgttgcaacttgcaactgctgggggtttgaagcttgatttcacgtgacaaatatagcatttacctgatttgggtttttgttaacatttttacagatgactagttcctcgcaaactatcaaatactataaattagcaccctttttttatcaactagcattgcttgtgttagcttgcaggatcaaataagatcgactgtttgaactttctgtatgacaaattgatgaaatattgtcataaaccacgtgtttatgacaaacagttcatcgattaatgtcttgttcacggcattcctcaactgtgtgtgctggctgatgcgtgctaaatctcatataagatggggatttgttcgaggttagagaacctgattagtgataaaccgataacttggggcagccgtccaagcctattgttacagagtactactgctgatggtgagcctgaaaaacacggtagtacagtaccaacgtctctatttggagcggaggcaaatgtagcagccgcacaagacgcttggcctcttccacggcttgcgcgctgccgcggcgcgatgtagcggccggaacgcgcgcacggccacttccgatgattcgttcgcgtgggagtagtactggtactagtgtgccgtgtgcccgtgcggctgtgaatcgcgatcggtgggaagtgcacgcgcggtggcttagcttcactccattttttgccatacacggaccgcaccacatcgtccgtcacaaacggcatctgccaactggcggcctggcgcaccgtgcaatctccggccgcgacaagtcgagcataggaaacaaggcaacaagcgtaacattctt

SEQ ID NO: 32615 - DNA, 410 bp, Oryza sativa
ttctttctctttttttttgaccaatttcattgaaatagaagaaccggattagtgcatgtttcacattttcatgcttatacctgttgtggcaaaggcaaaccacacaaaaaattggaaacgcatcaaggccagccaaactgttattgttgctcgaagaattaattaactaagtagttataatttaatctcagttgagcgcgcgaacgccccagcaatcaattatttctcttcttttttaaatttgtttgtttacatgcaacggatcggagactgaaatggagagtccacgggttcaaaaggcctagaagaacgaagcggagcttagctcgcgcatgtgccaacctgaacctccgctgcgaaacgccgcgacatctcgccgcgcgagctaagcttagctgcaggtgagccat

SEQ ID NO: 32616 - DNA, 1501 bp, Oryza sativa
atatggagtatactcattcacgagccttgtcttaccccgtacatcacggattcacatcaagaccagaattctgcccaccactggcattattgtcctccaagatgaaggacagtggtaggcgcaagtgcacgactctacaagttctgcacagtaagagagcaacgacgacgatgacgggtcagtcagtcaagtcagagtaacatggtcactgaactgttctacatatcgtgcacgggagacccctctcctcgtcagtttcaaccaacggagtggtctctcttttgagatcctcgaacgaattctcaggtcttcgcgagagcgcgagcgtgatcagacgcgcctaagaacaaaaacctgccattcctgccgaacaaattgaaacgccgcacgtcgcatgctggccgtgatggtcactcactcatcacgcccagatggcgatcatggacatgagccctgcgccgagcagcaacgcgacgttcatggcgagctgcaggcgtccccttctctgcaccttggtcttcatgaagtcctcggcgaggatgtcgacgagcgccatgtagacgagtatccccgctgccgacgcctcgaggagcccctgcaccaccagcgccgttgggctgttcgcgtcgtagacggaggagatcccgatcccgacgacgatgccggccggcgtcgtcagggagaagaagagcgccatcgtcaccactgacctgacacggaactttgcctgcagaaacaagaaagaacaggttatattataagttattttaacttttttcttaatcaaacttatttaagtttacctaaatttatagaaagattaaggagtattaagaaaaccgcagtaagttttttgagtgaaaaattttcagatataactataatataattgaagtgaaattacatcgtaaccacactgcaactgcgctgtaactgtaatataacttatataaaacttatattctactatgttttggttagcatcaagttcttacgcgtgagatgggtgaaaatttctttctaccaattattttccttcatgcacaaatctcaatgcgatctgatggccacaaatctgaaagttttttgggggcaaaaaaaaacttgcggaagttttctagcaattccgaaaaattattaacatctacaatacgaaattaatttcattaaaattaacataaaatatattttgataatatatttgttttgggttaaaatgttgttatatttttctataaacttagtcaaattttaaaaagaaagttaaaacgattaataataatataaaatagaaggattacttttgattgagattaattagtggaggcccagccgcccagggaagtaggatgggatgcgatttgagtcgtgatttaacaactgggcccctcaaagtactaaggcccatctgtaaatctgcaaaatcggaacgtctttttctaactttttggtagtacaagacatcagttgtcctcttgtttgaaatcggtatcttcggacg

SEQ ID NO: 32617 - DNA, 213 bp, Oryza sativa
aataaattgatgcatagaatgcaaggtttgcacttaagatacatgccacttgaaagtttggacttagaaatatgccactccaaagtggaattattttgaaacatgccactacgaagctaaattggttgattaaattgcccctatgaccttcttcctctctttccatcatcccactccagaagttctctcgtccctctctccagcagggctgga

SEQ ID NO: 32618 - DNA, 223 bp, Oryza sativa
tccatttgtgctattcatgtttgagttattttgatgctgggcatggtctgcacatctcatttggccggttcatgattaatcctgccatcctgcacaccagagggtgcatctaatctagcagatacagatttgcactgtatagttcttttgacattgtaaattaatgggaatcgatcaaggactatatgtgaatttgcatgtttagtaccttctacattttagt

SEQ ID NO: 32619 - DNA, 1501 bp, Oryza sativa
cggcgaccagagcaaatgtgaaactgtgaaaaccgtgccatgccgtcaatcaagcaagcacacaaatgacgcaaaaaaactcactctctgctgcagcttcttgatctccatgggaggaggaggacgatgcagagacagagacagagcgtgagggaacggacgaacacgaggccggcaatggcggcagagaggagacctagctacatctaccaccaaagaaagagagggagaagagtataaaaaccacccgtcgagcgcggtggtgacggtgccttgccgatgaggcgattacttaccggagtttagaagcgacggcgcggttgcgtggcgaggactgacggcgacgggcgcggccgcgagactccacacgtacgaacctcgccggaaagcgacgcctcactcacccaccaccacgaaagcacaaacccacccactgttcctctgcaaatcttatatccacaataccaggataattcttgcccaatccccaatctcctcctccgatccactgcccagaaaatggcagccaagaactcgcaatatgccaagaaatggcaggaggaagaagaagaggaggatgaaacgggccaaacggctaggtatggggtgatgatgagatgggtgaaccgcccaatcgacgcagtgatttttatagcgcggcagaagcacgaacacgaactgatcatgagacgaagaaacggacacggatgatgagtggcagccgggcaggaaaagcgcgcaggcgcagaccaccctggcattagattagcaataaatcccaacgttcgagtcgatccgacggccgagaacgctctggaggtggcgccggggttgggggggttaggtacttggaacgtgagattgcctggtttttttcctttttcttttctgtttcaacgacgctttttcccacgagaaagccaacggctagctcaactcaatcccatcgagacgtttattactcctggtgatgcagatctctatgcttgttggtcattgcatctggatttctttttgctcgcttcacgagatgcagttgattccatacttttgttctgttctggagtaggaagagtagttttcaatctcttccgtgacaaaacctgttttcaggctgcgaaaccgggacgcaatcaatgtattcccaaacttcatttagacctggtttagttgccaacttttttatcacatcgaaacttttctacacacataaacttttaattttttcgtcacatcattctaatttaaatcaaacttctaattttggcattaactaaacacaccctcacttcaaaagcttggaacaaagagatgctaaaatctaagaaaataagctttatctaaaaaaaataaaatctaagaacaaagagatgctacaaatcaaaagcaatgaagctagagagtaaattggcatgcatcctttttaacgtaaacgagtgcttttcacgcaaatgcatgcccagaggaaactagcaacaggatgcaggtgcaaactgtgagt

SEQ ID NO: 32620 - DNA, 949 bp, Oryza sativa
atatacatatagatatagtagtttacagtaaattagttgtgtgttgtatggcactagatatcgatgatgagctgccaaaattgtctaactacctaccctcttactagatatataatattatatagtacctattttctactacatacttagagagaggatcccaatatacaagcgttgggtgtaagaagagaagggtacactaattggatatgagatctctaatggctatacttcgtccttcgtcctgaaatattacaacctacaaatctggacatagcaatctaagttgaaacattctagaatggatgtagtaggtatttgcttgacgtacgttatttatgagggatgtagtaggtatttgcttgacgtacgttatttatgagggattgtatagcttttagtcacatgataatacccataaatttagtagcttttagacgatccagaccacattaagatttgtgcaactgtggtaccctacccacattatcttatctctcttcctcttcctatctttcacatgcgcaccactcgaacatatgtctcctatgcctgagctagcgtgttaccctcccagccacactactgctggtgagacctaccactagtctcctccacctccttctcccctctcctcctcctcctctttctcagttgggcagcgagagctagctttcatcctgcctgtcttctccatctccggtggcttgcgccatcgagatgcccttgcctcctaaccactctagatataatgccctgccgctaaccccatcaaccatccccctctagcttcatctggcctcgccgcctgtccttgtccgtcacgcagtgctagtctgccgcctccctggaaatccctcaaagcgtaaggaatctgccctctttcccctatcctaaaatcctaaccctcatctgtaaattcttcattggagtctggtgtcacgaacaa

SEQ ID NO: 32621 - DNA, 1501 bp, Oryza sativa
ctcgggaaaggggcgtcctcacgtgggtgggcacacggcaagggacaaaccggagttggaaaagaggatgggtatgtaattaagaagccaacggtaattaatttgctcatgtatggtattgtagcaagtagctattggtcaatagtgacattttatcgagtccacttttgtgaactggtatttcaaaacctacttaggaaaatggcacaatgtcaaatttgttgatgcctatgagacaatcctaattccttcatccaaaaaatacaaatagaggaggtttgtttatttcaaattttttgttgtcttcttcaatttttatctttttttcttttgtaaaaaaagtaagggcccctttgatatggaggaaaaatatagaaattttggaggatttcaatcatataggaaaattttctatgaagcctttgaaacaaaggattgaatcctatacaatgctttgaaattcctatggaatggacaatcctgtaaagattttggaggaaatttagcaagagcttcaacctctcagtaatttttctttgagtttatctttctcatccaatttatgtgtttttcctgcggttcaatcaaacggccattcctgtgtttttcctgcattttacaatcctatgttttacacttacactcctatcaaaatcctacgttttctcaatcttgcgattctaaggggcccttagatctttcgtcgcaatcctggtctctctctccaatcaacttcgagttccgacttccaagtaaaaaccctaattcttccccaattcctccgaattgagccgccgtcatagcgatggccgagcttaataacagcgcaattaacaacaatgacgggcatgcttggaggtgagctaggcggcgacgacgacggacatgctcgggaaagggcgcgtcctcacggtgggcacacggcaagggataaaccggagttggaaaagaggatgggaatgtaagaagccaacggtaatttgctcatggatggtattgcagcatgtagctatgggtcaagagtgatattttatcgagtccacttttgtaaagtggtatttcaagacctacttataaaaatggcacaatgtcagatttgttgatgcctatgagataatcctacttccttcatccaaaaaaatacaaatacgggaggtttgtttatttcaagttttttttgtcttcttcaatttttatcttttttcttttgtaaaaaaaaagtaagggaccctttgatatggaggaaaacataggaattttggaggatttcaatcctataggtaatttttctttgagtctatctctctaatccaatttttacgtttttcctacaattcaattaaacagtcgtggttcaatcaaacggttattcatatgtttttcatacgttttacaatcatctaatttacacttatacttctatcaaaatcctaagttttctgaatcttactattctaagggcctttagatctttcctcgcaatcctggtctctctctccaa

SEQ ID NO: 32622 - DNA, 304 bp, Oryza sativa
agcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaaggacgagcatgtagattgctaagctgacgcgtggtggacaagaa

SEQ ID NO: 32623 - DNA, 1501 bp, Oryza sativa
ctagccctgtaccgtgatgttaaaaatctgcaactggcagtatggttatgaacatttacttcagttttttttttgccccttcttgttttataaggaccacttggcattaacaaactgaaagcttgcgacatatggagaggaaaaagagtagtagcataggagtttatatatttgggcacttggccaagttgttcaactggcatttttcccgccatctctctttgctcgttcccgcggtcaagcttgctacacaggaaagatcgatcagctagctatctagagcaactcgaccgtcgtgttcgcgaaaagaaaagaaaaggaggaacaaaaattaaagaacaactcggccgttcgccggatttgatttatttggcctccatgctttgttattatcctctccttctcctcttgtttttttgctaagttagatgagcttgcggcatcgcacatgcaagttgccatgcaagttgggcgcgccgtgctttgcttgctttgcacagggggagagaagcttcgccggcgtgctaatccttttctggggttctttctttttttccctctccaactgcttcattctatctatctcttcctcgtaaaaggagatgcagtttagggcccctttgaatcgtaggaatgaaaaaacgtaggaataaaaaaaacgtagaattttgataggaatgagcgtttgattggaccgcaggaaaaacacatgaattagagagagataaagactcaaaggaaagtttccatgaggttttacctcatgttagaattcctccaaaacttgcatggcattaggcattccataggaatttcataggattccataagatccattcctttgattcaaagggctatataggaaaaattactatagaaataaaatcctctaaaattcctataaatttcttttgaatcaaagggggccttagtggttgtagtgatctgagtagtagcgcaaaatctcgagttcaaattgggttgtttgatgggctaagttcctaatttaaaatggctgcatatacccagttggatgtagaagccaaaaaaaaataatatttttttttaaaaaaatcgacctcttcgtcgccgcttgcaggtatacgcttgggctctaaacggcgacgaccacatcgactttccggaggatttgacgatggcaaagcgattggtcggtcgattgcaagagagcatcggtggtttcaaaaggaattgaaaaacggctgctttcgagatgcgccggcagccggccggcttctttctttcagttgaagtttcgaattttaattgcttcgtttcgtttgtctttgggaaaggtgaaatgttgcattcatcaatttgataggtaaagacgggcgagatatctctatattttcctcacgcttaattaaggcacctaacgtttcgtctatgcataatcagtagttgtcaaaatttaaattttaaaacttaattttaaagtttttctattgaagtttatttttaagtattgacatttaaa

SEQ ID NO: 32624 - DNA, 1501 bp, Oryza sativa
acggcatggcacggttttcacagtttcacatttgctctggtcgccgtcgtcgtcttcctcgagtaaactgtagtaaactcttgtagagggagggttcacgtgagttcggtaactcacgcgcagctttttttgctctttctctcgctttctgtctcatgccgttgttttcgccgtggcggaagccaacaattccgccgcactgtcgagaggaggaagaagatgatatttttcggcgggaggattggaccgcattgtggcggccttcatgaggccatgcctctccatagcccttgctgctccaaccactcctcgatccttatctcatttcctggctttattatataaagaagccatcgccgggagacggagtacaagagagcaggaagcacgcctcttcttcttcttctccatcttctcacccaccatagccaccttcttccttcctgcaactcggctttctggtaagaccaagagaccatccttccacccatggaggtttctttctccctaatagtagtaattagtaaataaactacagtagtaacgcacacgcacacgcggtgaacactgcactgcttggcgtttactgcgtgtcagggctcgccgtctatctagccgttgctcatgcatacagtgagctttaggaaggcaaaaatggtggctttgggtttggggtttgggtgtggggcgagagattccagtcggttgcaacaaacgcattgaatttgcttgccttttctctcatgggaattgtgcagtgcaagaacagagaaatgcagctgtgctgaactgctgctgatataagcttggctccttcctcttcttgcaaaggctccacaatttgcagcagtgcaaattcgcaactgcaagaggagcactctgcttctgcttctggtgatttgtttgccttcatggatggcatagcttatttctgttttgcttggttattcataccaaacttcagtttttgtgttagtttgcaaagtaaaattttagttcttgttactgtttgagaatttagacaccttgccaaatgtttttggtactatttttttcaagtacaaaagcacagcaactctacagtagagtggccagttaatctctttgttaggagtaaatcattctgttaaaatgtccattagagaatgctaataaactattgttaacatctgctagagatctgcaatgacagtggaaaaacagtgtctttttctttcacagttgcgaataaattaaaaatagctctgatgattttgacccagtagtttgttaggacgtcatggtttcctcttgccgcgtttcctctctgcattcttggctcctctcgccgttgaccgaccgcccgcaatggccggcaacggcggcggcggcggcggccggagacactgctccggcgttctcgagtcgctggagggttgcttcacggggtttctcatcgtgctcctggaatggcacgcgcaggtccggaggcggctgctcccgctccttcgccggcagagga

SEQ ID NO: 32625 - DNA, 183 bp, Oryza sativa
ctcgtattattagcaagctattgcaatagatgcatttatttatttatgctttggtgatattttctgccgtctatatatggaattttatgagtttggttggaggtcatgtggtcactggctatgatccatgctttttaaagaaaaatggtaaatatcctccttaaaaaggacacggttagatct

SEQ ID NO: 32626 - DNA, 1501 bp, Oryza sativa
tggggaccgccggaggatgcgggcgcacgccgcaagggagaggatcaccggccgcggcgcccacgcggggagggttcacctgccacggcgtcgatctgctcggccggcaacacatcctcctgctgtctatccgcgccgccaacctccagcaaaatacataagctcatcaggctacctttcgaagagcatgtcatgtgctgactgtggagtgcaaaagattaagctttcacctaaacacttggagggggataaactggcgaccatccatggagcagcaggagtaacaactgaagatgatcatgatccatcccaacaagtcgccggagcaagtggtagcctctttcgagcttcgacacctcacgaggaacaaatcagacataaaaaacctcatgaagaacaacccaacagtaacaaaagcatcccccctccattagctgcatgtccttcctggaattctatttttcttctccaaagagacaacgtgagatgcatggatgaacaattggctatgcgcctactactgcccggactcctcatcggactcgccgtcgtagcgctcatcctccccgtcctcctgctgctgctgatggtgttggtgatggtggtgcgggtgcggcagttgaccggcggcatcggcgctgccgacctggtggtagaactggctgagcgactgtgcggcgagcacgctgatgtggccgtcctgtgagagtcctagctctagccccggcatggtgcgacggatgtcagcgccgacaccggtatggtccccgtccccgtggcggcgacgattgccggctccgcctgctggagcagccactggacggtctcaccgtcggacttgtggccgagctcccacgtcagctggaagatccaggcgacgcacagcaccggcatccggatccgccgtccccgggcgtccaccttggtgtgccgggtccttgttcgagctccgcttcggtcctagctcctgcatcctcctctcccccgctgcaaccgctaccacctgcatctactgctgctgacagcggatcctctccctcgcggcgtgcgcccgccgcatcctccggcagtccccacacctcacgcgcctccggcgcctcccctggccgtgctctgttcggggagagagaagggggaggagagaggagagtggtggaggagaggaagaatagaaatgccacttacatgtgggtcctcaagtattttttaatttttttatgactaggaagccacgtcagtaaaaccactgtcaaaaaccaccaagggagttgtttttgtactggttttaacacttgggggaggtaatatacccggttttgcggttgagggatgtaattcgataaagggcaagaattgagggaggcaaatggacttattccaaccgacaacgaaacgaaacggtccttaattactcctatatatataaggcaacctattattgcctcttcttttgatcttttcacgtagacgtagtaacgatttgatcgaggaggagccataa

SEQ ID NO: 32627 - DNA, 1501 bp, Oryza sativa
gcggagcccattcacccgaaagcgattttgctaacgatcactcgcgtgatttttttctgacatttcacgtttttttcaggctcgtcagccggcgcgtcggacaccagcacatcggccaccgtgtcggagaagcacgatgacacagtggcctctgaccggcgagccagccgccggtagcacggccaatactgatcgacgagagacaccgtctctcttgtcgttgtcgtgaaatataaaattacaatcctatataactaaatttacatttgtaaattcagttgatttgacatgtaagtgcactgtaattttgataaaaaataatgtttaagtaaatatgtacatattattttctttaaaatataaaattacagtcatatataactaaaattacatttgtaaatttagttgatttgatatgtaagtgcactgtaattttgataaaaataatgtgtaagtaaatatgtacttattattttctttaaaatataaaattacagtcttatataactaaaattacatatgtaaatttagttgatataacatgtaagtgcactataattttgataaaaatattgtgtaagtaaatttgcattagttattttatttcaaatataaaattacagtcttatataactaaaattacatatgtaaatttagttgatatgacatgtaagtgcactgtaattttgataaaaatattgtgtaagtaaatttgcattagttattttatttcaaatataaaattacagtcctatataactaaaattacatatgtaaatttagttgatataacatgtaagtgcactgtaattttgataaaaatgttgtgtaagtaaatttgtattaattattttattttgtagtccgttggatgcaaatccaaggaaagaaaaaatctcaaaaatcacccgagtgatgcataggcggccccctcgaaagaggggaaaagaaaaacatcgaaccgacaaggaataagtccattttgcctccctcaattcttcccctttgtcgaattatatccctcaaccacaaaaccgggtatattacctcctccaagtgttaaaaccagtacaaaacaactcccttggtggtttttgacagtggttttgctggcgtggcatcctagtcatcgaaaaaaacttaaaaatatgtgagggcccacatgtaagtggcatttctattcttcctctcctccaccactctcctctctcctcccccttctctctccccaaacagagcacggccaggagaggggccggaggcgcgggaggtgtggggaccgccggaggatgcgggcgcacgccgcaagggagaggatcaccggccgcggcgcccacgcggggagggttcacctgccacggcgtcgatctgctcggccggcaacacatcctcctgctgtctatccgcgccgccaacctccagcaaaatacataagctcatcaggctacctttcgaagagcatgtcatgtgctgactgtggagtgcaaaagattaagctttc

SEQ ID NO: 32628 - DNA, 1501 bp, Oryza sativa
atgtgtggcaatgatcttgaagcacctcaattcaacccgatggcatacaccaagttatactgtcggaatcggctgcatcggcttacctagtccgactcagacccagccaatcctaattgtagccgatctggactccagccgattcttgctctgttcttgaatcgatctctgcctccgactccacttcgatctaatctccttttctgatgctgatattaccaaatttggtcgataacaaccagatatctcaaactatcaactattaaaaccggtacaattttactcccttgacgattttgctgacatggcagtgttgttctgatttgtggcggtgatatgacgcttaggtgacttttcttttaacgaatcgtcgagccgccaatttcattgaatagagaaaggagtaaactacacaagatggcagaaagaaagaaatgtacaagctcagggcctttggaccgtgctaactatatagaagacagttgccaaaaaaattttgtgtccgctagaacccatgtctttgcttcctccttaatcttggctagcaagctggttgctaggagcttcttttgttagaaggtcctacgatttctttcattctatatctcccagacttaggcgacattagaatttaaaacatatatatgggacctattcgtcattcaaaaaaaaaattgtggggccactgacataagggactcaaagtggccacagtcgatttccggcccgtgtatgacaggtcgcacgtagaccgcaatgccgtttcggcccaaatataattgggccgcactcacgccgcaattccattcccctccccgtcctcccggccactgaggcggcgggagcctgatcgtgtgcggcgctcaacggagaacggcgaggatgtcgccgggagaagagggctccgccacgcatcgattcaatgcaggaaaaatctgggactacacttgtcccaactcccaaggaaccatcgcctccgcgacgatctgagtgcattgcagaatctctcgatgagcagcgggggcgcgatttgcttgtcgcgatggcaccgggttggctcggatgacagcgctgatagtgatagccaagaaggattcttcaggtgatagcttttgtgccatttcgctttcttctcaaagtggggagctactcggtagtagattttatttatttaaccttattttcgactaatagtactaagttttcatgaactacctttcatcataaaagaatgacgcaacacaagctgagtgccgagagaaagaaggcaaaagcgcatctgattttttattattccacaacccaacactatgacactaacaacagccacagcctcaagaattgagcacatcactcactctcatcgttattgcattcccccaccacaaacaaatccaccccaacaacatgtgtatgtagtactacatgatcgccatctctctcgtcacgacggcgtcacgtcccaaccaacgtcactctccaccgacatcgccgccgcatc

SEQ ID NO: 32629 - DNA, 1501 bp, Oryza sativa
gaatctaactacattatataatttcattagaactatactataataataataacttgtatatatgtattaaaacaatatatgcaactttatatcttatatagagataacaatttagttatagtgtagttacactatacttacaatataagtatataacaatagtataactacaatgtagttagcatgtaactagaatgtaacttagatgtaacttgaacaaatctgccataaacatgtgatgatgagactagcttgtgaaaaagagggtttagatctgatagcaaaatatctcagcacaaatcttagcgcggaatcaacgaccaaaaaattgacagttttcaggattgaaaactatcgacagttagctagcaaaaccgtaaatcatatatacatgcattaatccacatatcccgcaacaaaacgcggggtatcaactaataattataataattctaagctgaaacaaatagagcatcagtctttgtcaactattgtttcggtgatcctaaaacaaaagttgtatgtgttccttaaacgacggtgttcagggtttttttttggcttgatgcgacctatcatggcacaaattaaaatatgaggtggtttattttatatccggagatcataaaatgtttgtcacgctaggtcatttaaggggtgtttgggagagaggggctaaatttgagatcagggacttttggttttgagcaagtttaatagtatagccaactactagctttaattcatttatagtcaatctaatagcttttttttcggggaatctaatagcttattcatacaatagttacatactacactaataatacctggccccacctgtcatacacacactgcgtcttggagtccgtgctatagctggctataaatctgtagcccgctgctcttctctctgctcatttatctgtttaaaatatatttgcagctggcttatagcatgctattgtacctgctcttacggtcgcttggctggcatgttttgagggggaaaaccgttacgaggttgggccgcgcgcggccggcgtaccggcgtctggaagccgctgtgtgcttttaccgtacaacaatcgccgcgcagccacacaagcacgctttttagctagtacaccggcccgtgcgaacgaatcgctctgtaaactcgcatacacgaaaacatggacacattttccaggtgcagacaagttaggctgagccttttgggctagaaaaaaaaaaaaggacatcccggcacaaaccgtgccttctcagccgctcacgacgcggccacgcccaagcgttttcacccgagccggaccaacctggctctggctggtataatacgcggtttcagatcctgatgaggcagcgacgacggcgacgcaggaggtgcacacaggctcctcgactcgtgaggcgaactctccctcggcatcgctacgtgaaggtaattaacacgcgcgctggggctccctcccacgcgcatcgccctcaccgtgcgcgccga

SEQ ID NO: 32630 - DNA, 1501 bp, Oryza sativa
cgggggtaccaggccatgtgtgcgattgtgtctgcctcaaacctctagtcatgatactcctgatcccatgtcaccgacaatatcaaaacaagtataatatatcaaataaaagcctaatatacttaaatgcaataagatcttaacataaagggcggatttaacatgtcactgaagcatatagagcgaatatggttaaatcagataagatcggctgaaactccgatactaccctaatcggcaaccagaaggcaggctagagattgatattctaagcacgatttaatggatcaaactcaactgatgcagcattaagtatgaaaagaagaacaatatctagacaatcaagccgctggaagtttcatagagtggtagatatcttacataatctaaatcaacatcggaatctaacctaatcggctgccctccactgacagatgttagccgatcgtaagttagatggcgatattgctagagattatgtaagatatatgataactcgacgaattatataaacaggattagagtatcataaagatggaagcactaatcccgagaacacaagccgtcataacaagttttacctcttgttaaagatcgaaaccgatgcagctcaacccgaaagtaagaactcgtcgaaataaaactaaagcaaaaggtgatgatgcgccgaaattgtattgaacgtgtgtgttaaaaataacatagggctcgaggtctatttatacccgagaattacaagatatgtccataccggacacgaccattatctctaacaaattctaagataccataagtctttgcggcagacttttgcccaaacatatctctaagaaaattacataaaacatcctaattaatagatacaattgcattctcaggactctatccatgtgtggcaatgatcttgaagcacctcaattcaacccgatggcatacaccaagttatactgtcggaatcggctgcatcggcttacctagtccgactcagacccagccaatcctaattgtagccgatctggactccagccgattcttgctctgttcttgaatcgatctctgcctccgactccacttcgatctaatctccttttctgatgctgatattaccaaatttggtcgataacaaccagatatctcaaactatcaactattaaaaccggtacaattttactcccttgacgattttgctgacatggcagtgttgttctgatttgtggcggtgatatgacgcttaggtgacttttcttttaacgaatcgtcgagccgccaatttcattgaatagagaaaggagtaaactacacaagatggcagaaagaaagaaatgtacaagctcagggcctttggaccgtgctaactatatagaagacagttgccaaaaaaattttgtgtccgctagaacccatgtctttgcttcctccttaatcttggctagcaagctggttgctaggagcttcttttgttagaaggtcctacgatttctttcattctatatctcccaga

SEQ ID NO: 32631 - DNA, 1501 bp, Oryza sativa
gcggtcggggcagaaatcccgaggcgcgggggagacaaagacagagtcgctctggcgcaaggtaaggagggaaacgcccggcgggtcgcgccagtcgaaggcgaggtggtcgccggcctcgaagtcgccgtcggaagaggacacgctcgggacgcaggccaggatcacccacgtggcctcccgcggcggcgccgccatcctctcgtcccgccggaacttgggcgccgcgccgtcgaacaggtgcgggctatgctccatgcgtctcttgctgctccgaacttccgaagcggcggcggcggcggcggcgttggagtggtcggtggcggcgatgggaggggtgggatgaactggaaatgggctgctcccgtcgattagtttgccgctttaacggagacagagcccagaggggcgagaaagttctaatcgcatcccggtgtttggcacattggcttgctgaacaagccggttagttacggttatcaccatctaacctccctacagtgcggtgatttttttttcactaagggatgtacagtggtgtttaataacaggctcttttcgttgtcatgtaagtaaatttggtgacgtggaagaaagagaaggaaggaatgagaaacatcgttgctacgcatgacaacggctcagagtcgactctttgcatttattaacagaaagtttgttgcatgagggtatagaaaaggaaagaagtataataaaaaaatatttagtgtattaatggtttagaaatcttattatctctattattatagaaggatagtctctagtgatattaattaatatagagaactcatattagtctctacctttgtacatgttctaagccatgtggttataagatctgacggtaattattcgttaatctcatgttttttggggaaaaaatggtttaaaactagagcattactcggcaccgatgtatattgcaaagctgttgatcgaggaggattcaccaaaccgcaccgatgtatcaatttttgcagtaatctaaatgtcatacattagtatactcacttaattactctaatcagtagcagtaactcgaactctcgaaggtggataaaaggtaaaaattattactagcgaatccaaatctacccgtcggggcccacatctggtggctgccgacgaactggataccatatcccatccgcagtcgccggcggactgtaagaattgccgaatcggtggcgattgtgagggggaataagttcactggaggtccctcaacttaacagcgagattttttgagttcccttaaccataaaatcagaaatcttgactcctaaactatacaaaacgaccgttcagtcaaagtccgtaggcagtatatataggacgtggcactagttagcaatttttttaaaaaaagtacatgggacccacatgccagctgcacgtttttttcttctccttctcttcctttttctctcttccctcttcccttattcagtgaggaggccggcggcgggcggagcggcga

SEQ ID NO: 32632 - DNA, 718 bp, Oryza sativa
accccctcggggggactaagaggagggcgaacacatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaactgggcagaaacccaacggtcacaaaccacgcacatcggcaatggtaactcggctgtcaacaatgagcggtctcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgataaacgagggggcgaaatagtgggcgcgagaagcgaggagccgggcacagcactggcaagagtataaaggcactgaggaagggatctgtttccttcctttcgccattattcctcttgtcttcgccgcttgcgccctaactccttctttcctgtgccctaccttcgccacacgcgctcgctcttaatcttctcttcctccggcgcca

SEQ ID NO: 32633 - DNA, 1501 bp, Oryza sativa; identical to SEQ ID NO: 32564

SEQ ID NO: 32634 - DNA, 1501 bp, Oryza sativa
  unsure (1)..(1501): unsure at all n locations
ttagattccgatgttgatttagattatgtaagatatctaccactctatgaaacttccagcggcttgattgtctagatattgttcttcttttcatacttaatgctgcatcagttgagtttgatccattaaatcgtgcttagaatatcaatctctagcctgccttctggttgccgattagggtagtatcggagtttcagccgatcttatctgatttaaccatattcgctctatatgcttcagtgacatgttaaatccgccctttatgttaagatcttattgcatttaagtatattaggcttttatttgatatattatacttgttttgatattgtcggtgacatgggatcaggagtatcatgactagaggtttgaggcagacacaatcgcacacatggcctggtacccccgagggacgtcgggcccgagggtgatgtgttcgccctcctcttagtccccccgagggggtcgggcagcacccccttcggccagaagggcaaaggcgccccgacccctagtgggtttntgctnngggtgtatgggttaggtgagnacagtggggctcacctaaccacatttattgcggttgggctgagcgtgtcacgccacatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacgcgtggtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaaagagagaaatggtgcatgtggtatccccttaagatataaaaggaggaccttgcccactgagaaggggactggacttttcgagattagaaacccagaacaagggagaggctggctcatactttgtagctccttcatacacagatctcccacaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaa

SEQ ID NO: 32635 - DNA, 1501 bp, Oryza sativa; identical to SEQ ID NO: 25318

SEQ ID NO: 32636 - DNA, 1501 bp, Oryza sativa
catactgacatgcagcgaatccatcagataagcccgtaaaaacatcgtctcgccatcagatgtcgctgcagtgccgcgagcaccctgacagccatactacacatgaactgacataagattcatcagcttgggccacattctgaatttcctgatctctgaacatgtttctgacagcacattcctctgacgaacgtgcagctgctagaattgtcatcgccggctgtcactccgtcagaacttgtcaccggatgatgcagatgcctggagatcgtttagccggttgattgattggataatgctcgagtcgcttcgttcattttagccaccattagtactgtattagcaccggtggctagtcatggtgtatagtgataagactgatggttacagcttcagcaatcagcatacgtatgcagacatggcatgtttatggcactgtacgattataccgtgttgacgtgaaccgtagtagagactttgtaagccgcgagtacgtggtagggtccatggatcatcacgacagccatgccatggagagggagtattctgttcggttttcagctgagcattatcatcagattcattttttttttgtttttgatagaggattatagtcagaaattggttggttaatttgtttttataatttaattgtacatggatgtctattaattaaatgtacacgacttggtggattttctagattccattaccccacttgctctctttgacaaaaatagcaaagaaatagtacaatggtgctcagcctagtacagatatgtacatagaacttgctctttccctgtaaaatagggcagagattcagtaaattctccgcggaagttttgacttggaaatcaaattagcgcgaaatctttgacatggtgtcagccatgtgcctaaaacaatcatatacatggaactaaagagagattcagaatcaatcaatcagagtatgaaatcgtgaagcagtaaacaaacctgcacaactgaagactctgcactctaaactatgtcaaaaatgctctttctccccgctgttcttttcccttgtcatcagggcaaaaaaaaaaaaaaacaataaccaagcagtgtactactactagtccatgaccatgttgagcagtagatggcctagatagcagtagcatgcatctgatcatctgatgggtactatccatgtgccaaaaagcaaaatctctcctttttttttcttctccataaaaaaacaatctgtacatttcattgccggtcgccgcgacagcgaaaggtgccatatcaaaacaatataaaggaaaccaacgcattgcacacgaccaacaaacaccaagaaaatcaatcagctaagcaacacaaggaaagaagaagaaatagctcaaagctagagagcacctactgctgctgctgctgccgctacgacctagtaatataattcagaaattcagaggcaagaacacttgtcatctctgatcaaagaagggagataaacttgttcagatac

SEQ ID NO: 32637 - DNA, 901 bp, Oryza sativa
aaatgctgcttttgcaaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttattttttccgctgcttagatctttattgattgagaggaactatctacctctataatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagctccttgaccctaggttatgccaaatggttacccatagaagccctctaaaaatattggaaaagtagaactgttctcctccccttctcttttaattaaaccaaactaatggcacatgcatttcctaatattttttttagtggttctcgttcaaaatttattctagcgttattagtactgtacatctattactgtactaatggctcattttaccaacaaaagttttacaatattgtttagtttaatcttgctgcaatgaaataaatttagcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttaga

SEQ ID NO: 32638 - DNA, 1501 bp, Oryza sativa
caactcaacttgaaacttgatgaagattttgcgattatacattctcattgcttggtactcaatgtagtaatgggaccaaagtttgcttggtttctttgtccttgaaatgtgatcatcaaactgttccaagttttgaattgtatccattactctttcatactctatcatgaagtttgtaatgctgtactgtggaccaacattattcttaaaccttgagttagtcccttcactgagagctgtgctttttataaatggacagaaatcacccttgaaatacactggaataaatctttttctaattgaccacatgtgctttagaaaattgatatgctgaacttcaaagctgtcaatcatttcttgccataaatactcaaattcttcttctgtaactgagttatttatgatgtcttcatactcatcatacaacccttcttttgctttgaacaaatttccaaatagattgaaagctttctttacaatatgaaagaagcaatttatgtgctttgcattttgaaatacttgagcaattgctgatctcattgctccatcctgatcagtaatgattgtttttggttctttttgtgacatagctttcaaaaaagttctgaacagccatttaaatgtttctgaagtctcatcatgcaaaaatgcacaaccaaaaacaattgtgtttccatgtccagaaattccaacaaagggagcaaacgggaggttgtatctgttggtgaaatatgttgtgtcaaaactcacaacatcaccatatttctcataccactccctcgatctcccgtctgtccaaaacagatttttcactttcttgctctcatccaaatcaaactcataaaagaaatgtggatctttttcttttttccttctgaaaaattctaaagttttcatcatatcattgctgcttgtctccttgttaattgtggttctcacattgcttatatctttcttcgtataaggcaaagaagtcaatcctcctcttagaacagataaaatcacaatcatgtgccttgttggtatattacattccttcaaggtccttatgagcattttttcttctgtagtcatgtgtttgtgtgatttgagaaatctcacttcatctcttggacttagttgatgattgtggtctaattgtacccttgaaatattccaaatctcattcctctctgaaataaccagagcacacttgcaatctgttgcatcattttcatttgtatttctttccgaaaccactgtttcctctgcgcttactggtttggattgagaagttggtttgccttgtctattacatctgaacgttactgtcacgcccggaatttctatccaaaattccaaacgcttacatgtgtgtgaactctcgtccaggaatcagccgaggcacacaataacaaattgataatagagtacaattattactctaattaataagcgaataaaatgtcattacagaggtagatagttcctctcaatcaataaagatctaagcagcggaaaa

SEQ ID NO: 32639 - DNA, 1501 bp, Oryza sativa
agcgagaggagtggtacaccgtcggcagctgcggcatcgtgtactacttcttgcacgcgagcacgcttctggtggccacgcgtcgacggcgaacatccacgagttccgcgaggtgatctggaagaacaccaaccacgccggattccttggggtgaccgagcgcgagcaccagaacgcgccgcggcatcatggattcatggtcttccggtatatatgtgtcatgtggtcccagatctggttgatgcgcaccccgtgggcgtggcggatcgaccaaatcaacttctcccccgcgtcagaactgcagcgtccacatgctgatcatgatcatcgatggcgcgccggcggcgtcgtcgtggatctgcacgaacgtcagctcaccgtcgctcacgttcacgcaccggtacttggcttggggggttcgcatcgctggagtacgcggtagcttgcatccctcagggagcggcacgaagcgcatgtcaggctggagctcggccaccaaacggatccggtgtttgccatccgctgcagtcctggggatcatgccgacgttcccggcgcagaggagccggtagtcgtcggagcagggcgggtagaggaaggccgtgcggagccaagcgtcgcagaggatgtagccgccatcgttggcgcagctcggtgcagggtcgaagccgagcgcgacgccgccggggccgaaatcgtgggcgctgcggagcaggagtcggccggcggagacgcggagtcgacggagacgacaaggggtgatcgtcgcggtcgaggcagaagtcctgaggcgcgggggagacagagatctaaaggagggaggcgcccgccgcccggcggatcgcgccactcgaaggcgggcgaggtggtcgccggcctagaagttgaagtcgtcgtcggaagaggacacgctcgggacgcatgccaggatcacccacgtggtcgccggcggcggcggcggcaaggacgaggagagaaacgtacccacagggtcctcgcggtcaccgatcgtacatagaggatcaaacgagttggcatcgccttgcttgaaattgatctccggaacagcgagggtggccatgctcgttcaccgccggcaacgcgtgtgcatattagtccatggcggcggcggcggcggcggcggtggagcgggtggcgaactggcgacgtgcagtgcgggcgaggcgaattggaaatggtgcgctgcgctcccatctcaatttgccggcttatgtagagggagaaaaggaggagctactagtcgtgtactcgtgtcttgtgcttgtcttgcaggacaagctggttaattagttagttaggcttatccaattctaatctctcagtttgtgcagtgcctcctcgtgtcattcgatctctaacttgggctcttcatcgcgttgatggcctcatgggctccttataaggccgatgctaatcgcccataagatggaataagttcattgtgagctctcttaacttgacaacgaattcgagttccatc

SEQ ID NO: 32640 - DNA, 1501 bp, Oryza sativa
cacataaggtgcacataagaggcaagcttcttcccccggccgaactcacgaaaggggggtcccgcgacctcccgctatcggggaacttccctcgacaatatttttgtcaaccgtttgatatgtcacccgtatctaattcaatgtgaataactattatacatcccctcctagcccagtctaacccagctgacccacaccatctcgccggcccgtcctacaccccttccccgatcggtatcttttttttctccactttttttgctttctttttcttccaatcatactgatccactccctcctcttccgatctccttttctcctttttttttcctcctatttttctctaatttctctcctcatatatattttctttttaaaattatcgttgtttaagatatgcatgatgttactgttgatgcgaaaaacacactggaccaaattttggtgttaacagttactttgcaaacaccccatctacagtaaataaaacttccactaattgcaaaattttaatctttggccgatgataatatctctttagcaatctatagcaaatacctatgcatcaatttatggaatagccacccgatcgatttgttaggctatggaaaggtgcacataagggattttttgtgtgataatgcatgaagcgagcacaatcggattcaatgccatatgatatctgacttgttttaccattgttttgtttgtcttgttttagtttagcatttaaatgggaagattttttatcaatcataaaaattatcttcacctattgcaacggacatgcatttttactagctagtaagaaaaaaagacaagcttctagattctttcactagtcatttagtttaatcgaaaattaaaaaagctagggggatcctatcgtgatccctctggtcaggttgtgcgttaggcaaattgattttatcaagtactaggtgaaaaaagatgtgatgacaaagctatcctacgaagtacgctccggtcgccactacacaagtaaaaatctcccatggtatcacccggtgaagatagcattccaattatacaagaaagatataccaggttggttgcgactctatctccagtagagtatgcgtacctatcccctatttaagacatcagtcatattttactataaagttgatatccactaactcataaaactcaatatacaaatttgtcacatcatcatcatctcccactagcaattattatctagagtattttaaatatcatttacaattttgttatatttttaaaactcaatatgcaaacaatgtcaaatcattatcttcacattttttaaatatatacatcgaccatttttataatatataacatacattcatccatacattttccatagcaaagcatagggtatatatcaactagttatatttatgtgtccagctaactagaccgatctgattcaagtagaacagcaaatagattaactcctcatcaccatccatatgtctttcttagattgattaat

SEQ ID NO: 32641 - DNA, 1501 bp, Oryza sativa
tgcatcaggcgaattgatagtatcaagtactaagtgataaaagttaatatgatgacaaaatgatcctacgacagtccacacgccactacacaagtaagaagcccccctgatcttactcggtgaagatagcatcccccgacgacgcaagaaagatatgacagctcggcggtgactctctctcccgagagcgccgtccgttcccaaactcgaggcatcaaatcaattatataagtccagacaattagactaatctgattcaaatcgaacacaaaattagaattaatcatgctccatcagcatggtaaaaacaatagtaataatctgggcatgctggagtcttaaacaacacgcatcagacaaattcgtgtaccaaaactaccatttgcaagtttatgtacaaaattacagcggtttgataagtttgtgtaccaacaatgccatttactttctacaattttcaagttgtatgtgctctgatcgttgaagtaaatgattatgaagtgtaaggccatttgcaccaatacatggtaaaagaataatttagcagtgtgcttcaatatttgatatagctaaaaggtcctcttggtaagaacacacatgacatccatagaacattgcacagatgcattttttccacattgatgttggatgtttgcattactattctcatagaatagatttcatatatacagacgctaccatagtaagtaagcgaacaacaacaaaaaaaaaggaaataaacaatgctaagcgtttacaataatacttcatttgtttcagattataagatgttttgactttggtcaaagtcaaactactctaagtttaactaactctatagaaaaaagtagtaacatttacaacaccagcatagtttcattaaatctataattgaataatttttcataatatattagttttgggttaaaaatattactacttttttctacaaaattagtcaaacttaaagtagtttgactttgactaaagtcaaaatgtcttataacccgaaacggagagagaagaataataacgagatgaaagccatgaacaacaaaaaaaaaatatagagaaacaataatagatgtttaccatccaatctttatctttatataaaaatataaaaaagggggacgacggtcagaaaacctaaactctaggagaagacgagagtgctctccggagtaaaggaacccttataaaactcatacataatcccaaacacaggagtagggtgttgcgctcgatagcggcccgaacctgtataatccgattgtgcgcaagctagccagacgccttaggggcaggtacgcgatttctaaaaggcgagcttcttcccccggccgaactcacgaaagggagggtcctgcgacctcccgctatcggggaacttccctcgacagctggtgcaccaggtagggggaagttgcgcgctttgaagagaagccgtttccttccgccccaagtttccttaggccctcgacgatcatggtcgaggtcc

SEQ ID NO: 32642 - DNA, 401 bp, Oryza sativa
gcctcccccatccctcctccgccagatctgggaggggagcgcgctgccagccggacgccgcgccgcgccgcccaatagccgccgttgctccccctccagtggccagggagaggaggagaggtgaggggaggggagggaggctgccgccagccgtacgccgcgccgtcgcgccaccccgcgccgtagccgccgtcgctccccctccgacggccggggagaggagaggtgaggggaggggagaggccgtgaggtatggggaggggagaggccggccgtgggtgaggaagggagggtgaggtgtggagacttagaaaaaatcaacccctacccaagtctatttatatttaagtctattttcgcaggcggactgacaatttcaccccgatttatatttttgtagg

SEQ ID NO: 32643 - DNA, 1501 bp, Oryza sativa; identical to SEQ ID NO: 25310

SEQ ID NO: 32644 - DNA, 1501 bp, Oryza sativa
tcatctccccgcaagcatctccgtccttgccagtgcgccctagcttcccctagttcacatttcagtttgtttagagtggttcaggtttgccttttctttgcttcgcttttcctttcacctttgtctagtggtattctctgatcaggcagcctttctttatagtggccattgccttacttgttgcactatggaggtcctgagagccttgtgcagtggtaaggctgctacatttttatccctaatgaggatgggattgatttcaatcaatgattaactcaaaactgtgtgtagctgtgtaaggctgcaattatcattttttagagaatggaaaagtgtaaggccgcagttagtctctgactgcttgaatttcgagcttaagcatgctgtcctatgaagaaacttacgctgacggctgacctaaacgtgcagtgtctgacactacttaagaaaccatagcagtgctaaagttgtgtgtggtaatcgtgggcaccaaactgaacaccccttagcaactagtgttgatgtgctagactgaatttagttctcggtaagcatactgccatactttagtgttccattcaagaaagtagtgcagcgtgcacgatgtgatatgctcatctatgtggctagtattgaaatatttatgttttttttttctatttttccttcttgcctcatctttctctgctttattgatgccttttgtcttttacacgtcgaccctatcatttcagattaaccctcctttagttgctttgtttcggtgacttttaatcgcatattttagttgaaattaaactagcgccattctttggaagtagaattcttgtcccttgtggtgattagatattggtagttttattcccatgatttacacactgctttgtgctgatagagaatctcagaatcacctctttggtgagttacaaggctcagtaaagagattggctgccaggccctcctagaggaaaaacatgcagggttccctacatgttttgtaatgattcgcactgacctatttggcaggataacacctttactagcattctttagcttcttttatgaaagaaagcagactgcactaatttggacaagagttttcttaaatcattaggctttgatgggtcattttttcttttgaaagtgctttggtctttttcttggcatgagcctctagtggggcaaactgccagctttatgcttccactacacaggcatgcttgtctgcataagtgcatagctgcatttgaagatcatggaatgtgcttccttctggactcagcacacacacatctgtcgtgattgctcgtatgctatattctcttgagggtttatgagttaaaagacacaattagagttatgtttacagttctactgttacttttcatgattttagcactgacgttttccattttcattgcagcaggactggtagttactgatataaacagatgctgatattgttcatttagtccagttgattcagagacacctcttatgg

SEQ ID NO: 32645 - DNA, 1501 bp, Oryza sativa
atgatagatttcggtaagacgccggatcacacggacaggacagaggctgcatccctggtatgatgtgtccagtattaaaattctgattaatcggaatccattttagagagaagataacgatactccctcggctcctatttactttgtcaactgtcacctctgaccagggttgtttcaacttcaaccattaacaatttttagatttatcatatttggttgaacaaaaaaaaagtctagttaggttatcatagttcgataatatggtgtatttttcaaagaattacaaaacattgttaaaacgaaaatggtcaaagttttcatttccatcgatccctgaagatatatattctttttcacgcggttaatgagattcgagcaaatcgctgttgggttgaagagattttcttttggttggcgacgattcaaggacaacgttgtcgggacagctgcattgtcttgtgtgatcagagcaagagaggatcgatcaatcgtcttccctgcagaaatgtgtggttgcgcggccaattttagttcaggcttcagggctcctgtcgcctgtcggcagggaatgaatctttggtgccgaatggtgcaaaaatctggtgaatggctgattgctggatgatcatagatagctgcaggagatgcaaatcccaaagaacataagagagagtttcgatcactggtggtcctggtgtttttgcagaaaataaaagaatgagaaaaatattgaaattttctgttgctatcttctctagacaatatagtaatatactgtttttttccttttcttgaaaaaagggtgtcacattggttgggttcagctgataagctgtgacaaaaaaaaaacgagcaacgataaatgatttgagagtagaaccattacatttgtagcctttaaaatccaaggctgaaaaggaaaactcaataatagtataaaatgatttaaaattaggcttaaaaatttaagtttcggttgtgaattataaatcaacaagcaaacgatgaaaaaaggaactctctctaaaaaaaaaagaacaactaattacaaatttgccactgggttaaatctatatattgtaggattgccaccagataattaaaaaatgcaattagaactgttgttcgattggcatccttacaaaattaaaaaaaccagtggcaaaattgtaaatacaaaaaaaaaacaacatatggcatctagatacagcagaggttttggatgttgaaacaatttattaattgagttttgagtggatctaagaaaacttctcgagtttaactaaaggcccaagtattcatgggccgggctgcaatctcaaagccgcctccaaatctccaaccgagacactgaccggtgggcccaacgagagagccactcataaaccctaatcctcgcgaactccccctcctccccgcctccctcccatctcgcgttctcgcgctcgattcgaatcccaccgcaaagcaaaagcccacgcgcgaagcaaaagctcgccgc

SEQ ID NO: 32646 - DNA, 1501 bp, Oryza sativa
tttctttaaaaagcatggatcatagccagtgaccacatgacctccaaccaaactcataaaattccatatatagacggcagaaaatatcaccaaagcataaataaataaatgcatctattgcaatagcttgctaataatacgagcacgggcactcaatgctatctaaattctacattttaagctaattgcactggactataacactgtattaatacagagcaacgctgttagcacagatttaaacacagtttacaatatccaatctgtatggcttgcatcagatgctcaaattaatattgttccaatttctccaatagaaaaccgagaaaatgagacttcatcgtgataagcaagatgtatatcttctggaacaagttggaaccgcgcagtatatccgcatgaacgaaaaacaggatcgccacgagctacatttaatcgccacctaaacgaaccaactcctacagctaccacccggatagcacactcgccagagcgtcaaaatcctaatccatggaagctcacagcctcacgccccccaccagacagaacccaacatgaagcccgttcacttgtccgtgcgcccgtgcgtgcgtaccttcgggttcttcctctcgccaccgtcatcgtcgccgccgccgcccttccccttccccttcttcttcctcgccttcgcgccggacttgtgctgccggtgcgccttgtgcggctgctctcccccgccgtccgcgggggccatggagcgctagggttagcggcggagggcgtttgcgcgcggcgccgctgcggcgaagagagcggcggtggagaaagctagtggggaggaggaagcctggagggggaagaggccgagggttttggggagagggagagagaggcgccgcgtgtgatgggccgagcggggtaagcgctactatgggctgggccaagaaggcccaggcccattttcacgtcacgagattcggacatgccacgtgtagcgcgcaggggtcgcaccggccaccgcgccgggaaggggaaggcgtgccgcgtgcgcggcgcgtggccgcctgcgacaaagccaccggcagttacgcctccgcgctcctccttcccaagagacgcagatctccaccccgcgctcgcctcgctttcccccaaaaagtcttctcgtgagagctttcccccccctcctccacccaacaaatccccagcctcccagattcgtggcggaggctgcggcctgcggctgttctagggttagctctcgctccgccggcatttctcggtattttttctaactagtcttgtttagggcagcgcccctccgtaaatttttatagcggttgagttttctgggtagatgctttgttgatatagaatggacatggttccggttgtctgtagcgcgtggattcccagctagaatttctggccttatgttggcgtcagttcaataaaatggaatgtttactttaatgtgcttatcgtagagatatcagatatgttttagttgcaaatgatt

SEQ ID NO: 32647 - DNA, 1501 bp, Oryza sativa
acgtcaagatgagcgaatgtctgactagtgcattttgcacttcggatgtcccataaccgaaggtgtccatccctatgacccgagcaaagggtgacaccatcaatgaaagctagtgagttggcgttgctccctgacattatggtgcttttgcagaagcctgactgaagatcccaaatcttgatggtatgatcattggatgaactagcaagaacacagctcttcacccagcttgcatcaacggatgaaacattttttgtgtgaccagtcagagtgtgacgtgggcgccccccattaacttcccatacaaacaatttgttagagctacaggcagcaatcacaaacttgttgtcattagtcacagcaagatcattgacagaccccaaacagccttgtagagtggaggttaaagcaccggtatgtgcagaccaaatcttgacagtttgatcctggccaccactgattagcttgtctgtgttatgctggaaaattatagatccacagccaccatcatgagcacggatagtgattctgcatgtagatgggattggtgtttccatgatgtccatgtacccagcttcagaacgacgaatgatgccatcagcttcttgtagtgcattgtgttgtataccaccaacaccagctgacttcagctttagaaccatctcctcatacattgcatttgcctgaacaaaaaatttccccccatttaaactgataaatgcttggtacctactagtactgtgggaccagttatcaatgtaaagcatagtaaaatagatcttcggctactaaaacaatcatcgatatttagttagttcttctactcccacttatgctatagaagcaaaagagtttgaacatgatgtacatatagaattgattcgactgtcgtgactaactgttcggttaaatatcaagggggaagtatttgaaaactgtctaaaaagagccatttccgcagacagcgcacagtagtcaagcaaaattaaagagcaaaaatattctaacatagtaatttgccatccaaatatgatgggaagatggtaaattatagtgcacaaaatctcctgtgttatgtcatggaaagcatgatggtactttaagtatctcaattgtacatccactacaacaatggtagggatccatgcataacatgcaaatttttttcttggccattttagcctaccaggcccttaaaagggaaaatataatcttgatttgcaacaccataaaatagaaagctgcggttttagtaacaagaaaataaggtacctcattaagcctctctgcatccttcatcttctcaagcatccatcgatcaatcagattcctgttttcatcttctgccactttctgttttgttaatgcctgttcaagttcagctttaactgcctggtgctcctgaattataagatctaaagcgcttgttttttcttcaagcgactgcttgagctgcgtattttcttccctacaaaagtgtttgcacaaaatgtcagctgcg

SEQ ID NO: 32648 - DNA, 1501 bp, Oryza sativa
cgtcgccggcggcgaggcggcggcggcggcggcggagtcaccggcggagatgcagatggagccgtcatcggaggactacacctgcgtcatctcccgcgggccgaacccgaggacggtgcacatctacggcgaccgcgtcgtggagggcggcggcggcgccaccaccgccgtagcgctcgccggcgagagctcgccgcggccgatcaatttgccggcgccggcgcgtgaagcgagaggcttcttgagcttgtgatgcagtgatagatggtagcttgattaatgatgcttaggtaaagtttggtgtgaggacaattaaattaaatctgagtcttaatgctgtcattattattattagtatttttattgtattggttgtttgttcgatcttgatgatcagatggtcaagtagtagtagatgctttcttgatcggatcctcaaattttaaatagatgctttcttggtcagatgatcaatcgattcaaacagatgggtttgttcagtatacttcaatttgagctgaatctgtaatacaaattcagaaattctttgcttccacatcctgctgctaccagagcagagtctttacctgcaaatcacttgctgaactattaacccaatgaatttaatctgatctccaaataacaagcttagctgttccacacacacacaaaacaatcttcatataaaccagtttaattccctctaacaaatcagagagaattcagaccaactctgaatttctgacagagagttttcagagcattttcgctcactgaatccaaagatgaggcaagtggtgttctaggcttctgccatactactcctaagctgcagggttcaatcattgacggtttcttgtagcatcacactcacaaccgatggaggagaagaaagaatccaatgattgatgttttcttgtggtgagcccctgctgctgtgcctacgcatccaaaaatcgatcgatcgaatcgaccagtgtgtgtgtgcgcgtgctgggcccacatgaacgggtgccttgtcagtgtcaggggcccaggggttttggcaaacggttgcagctaagctaaccctctgtggataagccaaaagcagtgtgggtctcatgccttttctgcttcagtgaccagcttggccgggttgggttggccgtctgatcggtctggtccaattttgtctctgtgcctctagtgttttaggctttcagtttcttcgctgaagctttcttcttttctgtgatgctgactgaatttgatgcccagtttatttttgaggtttttgtggtttttgagtgtttttgttttgggtgttatgctgtattgctgtcatatgatgtgatgtttgttgaacaggtactgctccagtgtagagttaaaacctctctctttcaggttcaggatggtgagcagcaaggaagggaataaattcttgaggattttagatcagtagtagtacaattcttttaaaatggttagctaccaattgattgctttgttgggggtg

SEQ ID NO: 32649 - DNA, 1501 bp, Oryza sativa
agcaccggtatgtgcagaccaaatcttgacagtttgatcctggccaccactgattagcttgtctgtgttatgctggaaaattatagatccacagccaccatcatgagcacggatagtgattctgcatgtagatgggattggtgtttccatgatgtccatgtacccagcttcagaacgacgaatgatgccatcagcttcttgtagtgcattgtgttgtataccaccaacaccagctgacttcagctttagaaccatctcctcatacattgcatttgcctgaacaaaaaatttccccccatttaaactgataaatgcttggtacctactagtactgtgggaccagttatcaatgtaaagcatagtaaaatagatcttcggctactaaaacaatcatcgatatttagttagttcttctactcccacttatgctatagaagcaaaagagtttgaacatgatgtacatatagaattgattcgactgtcgtgactaactgttcggttaaatatcaagggggaagtatttgaaaactgtctaaaaagagccatttccgcagacagcgcacagtagtcaagcaaaattaaagagcaaaaatattctaacatagtaatttgccatccaaatatgatgggaagatggtaaattatagtgcacaaaatctcctgtgttatgtcatggaaagcatgatggtactttaagtatctcaattgtacatccactacaacaatggtagggatccatgcataacatgcaaatttttttcttggccattttagcctaccaggcccttaaaagggaaaatataatcttgatttgcaacaccataaaatagaaagctgcggttttagtaacaagaaaataaggtacctcattaagcctctctgcatccttcatcttctcaagcatccatcgatcaatcagattcctgttttcatcttctgccactttctgttttgttaatgcctgttcaagttcagctttaactgcctggtgctcctgaattataagatctaaagcgcttgttttttcttcaagcgactgcttgagctgcgtattttcttccctacaaaagtgtttgcacaaaatgtcagctgcgtattttcttccctacgaccacaaccaaacattgtattcaatccaatacctggtttgctcgagttcagtctgcatggtagtaatcagtgtttctttctctttaagcagcgcttttgatgctttcccctcttctatctcggtaacgagctgctcggacaaacgtgactgagccttgtagcattgctgcagctccaattcatgcttctcagccttctctttccactccaccgcctacaaggaaacgaaataaataaataaacaagcccaccaaaaaaaaaaaatctatgcacacaataatatctaaatttttgggtttcttgatctccagatgaagcatctatggtacttagcaaaagcatcattatcgaggcacggttttttatacaaaattttccattccattatgca

SEQ ID NO: 32650 - DNA, 1501 bp, Oryza sativa
tagagctgaataaattgaccgaactgaccaaagtattattcagttaatcaggttctgtttctattttttattccgctaattcagttttccagattgttcaacagaaatatataattcattcggtgtaaaaaatattataactgaccaaatcagccaaacgatcacccctaagcagtgaggcatgtcctcattctggatggcagcaagtaagaacaaatggtaaaaggaaattacaagcataagataagatgatcaccgccaccctagcagtctagccacaacatcatggatccaatgctatattgcttgaaataataattaaaatcacaacaaaaatcacacttcagaatgttctaaagcttctctaaaactacctgataaaagtgaaagtagtaacttagaacataggaattaaactcctccaaaagaaaactatcattacttagcaccataaagacttacgttatcattgtcacaagcaatcatatcaccatatgaaatctgaaatatcaataagaagcagaggcacctttcagaaaacatcttagaaaaagtttgatgtagactaatttccaggaaaatcgctatacattccaagctgacctggtggcatatacagtatgttggttcatttggatcaattgtttgatccacatccataggtgcagttgttttcttgttgctacctggagggggcattaagtcgaagtccatacccctttccctgtcccattccctctctctgaacttctttgttgcttgaggtgtactgaaaccaggcctccgtttgtcatccctgctaaatgctgaaattgcaggaaggattgatggttcatctggaggtatctttccttctgcaaatgagatcagctcattaatataacaatattctgctcaataggatgacctttctaagatacaagtaaatgctagggataattgtgattcagaccctattctgaaggctaactaccaacttgcccccccccccccttcctttccaattttgctcatttgaccccacttttcaaaaacgaacctgccgtctgaccctcttctaaccacaccattaggagtgttattagaaaatgcatttagagaatgaacaagaccaaaatgcccttggaaaaataaacaagaccacagtatcggcctttcccgtttcagcctcaaatctaggtcaaatttgttaaactaagtcaaatatgtcaaacctgtgtcaattttgtctcatattttagtcaaaaattgccatcacatttttatagggataaggtaaaaaaaattggatcaaataaacgaagattttgagaaattagggtcaaatgagcaaggatataaatggtatttttccctgagttaaccccgttaggttgtcttcatgaaacaggttcatgcctgatcttcatttttgaaaaaagagggtcaaatgagcaaacttgaaaaaaacagggtcaaaaacacaattgctcctaaatgctactatctcttgattatacct

SEQ ID NO: 32651 - DNA, 1501 bp, Oryza sativa
cgaggtgtgtttggaatccgcaccttcctggcccgtggttttgcatttggaatctctatataactctggagattctttggggaaacaatattttttagatgaagggaaaaacaaaatactccaatttggcagactgacattgcacagaaacaaagagaaggcctgcagctgaccgccgtacgaggctcaaaacagcaaactttatccttatcaagaaggccaaaatcactcaaaaataaacgatacaatttgtgctgcattttcatcagcaaatcagtagtaaattctacagaggttgaggttcagatgcaggctggaacatgtcggggagcgtctcgagcaggtaggtgaacagcccgcccagcaagaagatgaacacgaacgcgagcacgatcttggtgatgtacgctgccatcgtctcctggtcgcgaggattcttcgccgactgcttcgtgtcatctcgtctctgcatggcaaccgaaaattttattcagagaggaaatcgttgctcattttgttcttgatttccgagaagaaaagaggaggaaaaaaattttctgaacttcttgcataccgtgtcggacgccggcgtctggtagtaacccggcgcgtcctgctcggtgatggtctgcagcttccatccgtcgccgtagtcggcgagcggcgcggcggggccgaagctgacgggctcctcgccgtccttcacggcctcgacgtgcagcgccgccggtgcgccgggggcgagcttgcggttcacggcgtgcagcgcgtaccgcgccgtcgtcccgaacgcgaaccgccgcacctcgccggagctcctgcacttcacctccaagaactgcgagcacacacacacaccacccacattgagccaatttccttctcctcgttctcaagattgaggacactctaccgtagaaaaaaagtaagcaggtttaccggcggtggaggagggtcgccggcgccggcgccggaggctgccttctccggctcgtcgggcttccgctccatcgcgccgccgccttccgatttcgcgatggtcgcggcaaggcggaggaggagttgtggccgactgactttggcccgtgcgcgtggagcagcagcgaggaaaaaagcacgaaagaatccgctaccgggttgactttttcctatccgtttctggtccgggccgaatcgctcagagatttcggctcaataccacgcgggatccaccgtgatttcggcccaagattacgcggaatccaccgtgatttcggcccaagatcacgcggaatccaccatttcgcgagcacacgcgatgcgcacgcgcgaggcggagaccaaaccaaacaccaccgtcgcggcgcgtgcgtctcaccagtcgcgcgagcgagccgcgtgacgcggtggtggtgggcaccagcgatgggcaagggcggcggctgcatcccgagcaagaggcaccgcgccgccgcggcggcggcagcgccagcgtcgcactcgcaccagcgcgagaggacct

SEQ ID NO: 32652 - DNA, 1501 bp, Oryza sativa
atctatattagtctagtctagtacggcaaggagaccggaaaagaaggcaagcggttatacctacactacacatgtgcgaaccaaactgaacacgcaacgtgggggagagggctcaccgcgtacaaaccgcgttcgtatggcggtggtttgccgttaaccaaccagacaccgcatctgcgcgtatgcatcaccaacgagagcgttatgtgtatctttggtgtaccgaagagcctattgtacttgaccaacttgcgttagttgacgcgggcacacgccgcacgcgacgcggcgcaacgcagcgcacggcggtgttgcctgcgaaacgcgagaaaacgcggcgttattcagttagcggtgagcggtgcgggcatcatgtacactcccgtctcccggtgtggacctcgcttgggggctctggcaggcatgtgaaaacacagcgtgacataaaaatctgaaagttggtggtgaccatgaaattcgagtcgctttcctctctcagatcggtcgggaaaattgttgggttgcggattattcagtgatgtgtgtgcccccacttcgcatggatcattgtacaccacagggagctcatcattgactgccttgggtgactgacattgttttcgagaaaacagcgtgtaggaaaacaaggaaatgatattggaatttgaagaaattcgagaaattacttttctcagtgttctcacagtaacgggggagagtcaggcagagaactctcaccgtttcttccagcgttcgagaaattattgctagtgtgcgacgtaaagaaaatgatgttggacattttatacaagtgctagtgcatttctttgggtagcatttcatttagattttgtggattaatttggtaactttctctggtttatgtgtgttacgtattaaacgggagagcgcagcgtgtgattacctagggtattgctgtcttttatgtcacggaaaaaaaaactcaactatcatccatgtggtcactttatgattaggctgaatggctgattatcttactactactgtcagccagtcagcgttgttggaattaggaagaactcgcgcacatgcatggtacgactcggaccaccaggcaccagccccctcccaagagaacggaagacgcagccaaccacgcgcgcgccttcaccgcggccgcatgcgccaacccgcggcctcggccggggaatgcgccgctgcgaagtcgtacacaatccctcccagtctctgcaggcatatgtggccgcacgcctcacgttgacacaccgcgcgtcctccgcgctccagtgttccaccacctctcctggttttgggccttttcatcacgtgatctgtgcattttccacgggtcttatactacgacttgccccgaccccgttgcgtcggctgttgcacaccggcaccgctgattcatcatcggtagcccggtccagttcgcgggcgcctttgctttgtttctaggcgatctagatcgaggacgaacgctttattcccttgc

SEQ ID NO: 32653 - DNA, 1501 bp, Oryza sativa
tatagatccttgtcaactaaaaataagtaaggtcgtgttctgcctattcctgtgtaaaacggcgaattcattcttgtgaaatttctttgaacgtctgatgaaattgtttattacgataagtgtgtcattatgtcactcgtataagtagtttatcacgatgaagtggaaattgaaaaacaagaagcaacgagtttagcatagtgcaataaatgccatggttagtaccatctcactatagacacaggatccgtattgtaagcactttactgcaacgcttcaatacgagccatatggcagcatactgccgggatatttattccattatgcagcatacgggtttagtaattgattgtactgtagaaattaatgttgttactacaacataggatcctacctatatgatgtttttttttcctatctacaagtttgttttttttcctatctacaggtttggttcttagtgtctgtttaattcgtgaaaagaaaatttttgggtgtcacatcggacgtttgatcggatgtcggaagaggttttcggacacgaatgaaaaaattagtttcatacctcgcctggaaaccgcgagacgaatcttttgaggttaattaatctgtcattagcacatgctggttactgtagcacttatagctaatcatggattaattaggcttaaaaaattcgtctcgcaatttcttccttaactgtgtattattttttaatttatctatatttaatacttcatgcatttatctaaagattcgatgtgatgtttttggaaaaagtttttgggaattaaacagggtcttatgccggagggagctacagttagacccagtttaaaacgtagggaaaagaaaaagacctagcactacatttaacatggacatatacttctatagttttagtttttggagtatctaaagttagacctgatttaaacgtagaaatttcacatgaatattccaatgctcacagaaaagaattataaacttatcaaggaaaggagcaataatataatccctatattccgttttgtggtgtaagtcatttttggtttgttataattcaaactttggaaaaataaaacaacattcctaacgcaatacaaatatcttatagcaggatttaatataattaatttagtgttatagatattgttacatttttcttataaaaacaccaagtttaacttataataaatccaaaacttattaccactccattagtggagcgatcagtactatacttgggtatcagcccatcaagcacctcaggtccagtctcacagtaagccgagccttggagaaccgaaggcaacggcccaacaagtctgccacgtggcccacgacggaagaagcccacgtcgaacaaaaccatttcagcccaaatctgaccggaagcagaggagcgcccaccgacgacggcgacgccggcttcttggcttttcccctttgccgacgccggcgtgcactctccctcccctcccctccccacctgctaaca

SEQ ID NO: 32654 - DNA, 1501 bp, Oryza sativa
ttagtagctacgaacctggactcgtagctagagtttatctttttctgggacaaggtagtaggtacccagagataccaaatttacaataaaaaaacgtggtacctcatgtacatccttaaagaccgtaaaattgctcctaaataaatggcacactgtcagggttttggttttttgttaccgtcggttagcggtataaccaaaccacttaccaagcaaaaccaataaaaactagacaaattttacacaaaaaatattatcttaaaaaataaaaattaaacttggtgaatatacattgtgatttccgttaccacacactaatagcaaatccctgttgccgaacgtaaaccgacgataatgcaaaccctggacacactatgccaattattgatccgatcgaatgggtgaaagcaaacaccccatgcatctttaccccttttgcacccatgcattgcttgtgaaaaactagtgactacaggcgaccaaagccccatcctgccatccgtatccaatgatcgatgtgactaatttttacacccgaaaaggcgaaaatataatgagcagctaggttgtcgcacgtctttgccgggataagatcggttagttgagagctgcacttcagctagctctcccctgatctgttcattcatcacagaggcgagatggatattcaccaacaaagctaaaacataagggatccgatcaacataatggatagacattgcactttggaggcattgtattattacaccccctagctaacataacatactacctctttttcaaattataagactttctagcattgcccgcattcatatagatattaatgaatctatgtatatgtatatgtctagattcattacatatatatgaatttaagcaatgctaaaaaatcttataatataaaacggaggaagtagcctacatacatgtacaacatgtgtgagtgcaacttccctccttttttttcagtatctttttttttttgcgccaaagtcaccatttggactctagctctcgcaaccccggcccctctccccccccggccggacaccgtctatacatacacgcacaacactgacgaccagctgaaacacgcgcgcgcgcgcccacacacacactcacattctctctgcacacacacaaacacaaacactaggaggagaagcttagttaattaacgtcgtagagagagtcgtagtgagtgagagagagatggaggtgggcatggtggtggtggtggcggcgaaggtgttggtgagcctgtggtgcgtgggggcgtgctgcctcgcggcgtacctgtaccgcgtcgtgtgggtggcgccgcggcgggtgctcgccgagttcaggaggcagggcatcggcgggccgcgcccttccttcccctacggcaacctcgccgacatgcgggaggccgtcgcggccgccaggcatcagctggcggaggcgcgacgccgacggcgagcacgcgacagcggcgatggcggcagcggcgccggca

SEQ ID NO: 32655 - DNA, 1501 bp, Oryza sativa
taatttcttctttcaatgaaaaaaaaaggtattacgacgttatatatctactgtgtcaccaagtgacatccctttcaggccccggaaatgattacttctaaaattaattaatcaatccaccatttgcatcttgatgttgatcttactttaattgtagccatcccaacgttaacagcttggctaaactactgttcacgtccaactcgttgctgctaattaagcaaccctccccgtcgctgttactgttggatagcaagattacattaggtgagctggccatcaccttcttctacaacttctttggaccctagctatttgatagaaaggtgaagatcatgacaagtatgtaaagatttgaaaggggttaaaatcataaagaaattaagctggaatgagtgtcgaggtgactaattatatatatataagctagtactccctttgtcccataatataatataagggattttaacattttgcttctactgtttgaccacttattttattaaaaataattgtgcaaatataaaaaagaaaaattgtgcttaaagtactttgaataataaagtaagtcaataataataataatttaaaaaattaaataagacgaatagtcaaacaacataagtaaaatattaaaatttcttatattatggaacggggtgaataatagctagccagatcctgtcatgtagttttggcccgaaacgatgcaaaaggacaagtactgctgggatcaagctgagtatacatgctgcaccatgtgcaactctgctcccataaaagtaacctagcctttttccctatttgaaagatcgcagtcgagcatgcatttaattaaatctgttgttcagatgatatgattgcactagaatgcaatcatattaatttgatgtacccggcgattagtcaaatagttttagttaccgcaggaaattgaaatttttgccagcctgttcagatgcactagacttccacttaaaaccaaggagaaacttcttcgttagctttccagatgcccttcggaattgattgattcccttatttgctctcgtgaaatttgctcctcattctcattcttttcatattttatttgtcctttccgttagctttccatcaacctaccgtcgttagtaggcgggtgaaaacacaactttttccccttaacttgtttcatgcatggtcagcaatttctatactagcttgttatgcacaaaaggttgaatttctctcctgaacctaaatggtattttcgtaatcaggagttatgcgaaattctttaaatttagtatattgtgtgaaattaattgtcattgactgctcgtcatcttatcagtcagtcgaatttaaattttaaaacttaattttatagctatttttgtttttattttgcagtctaggtctttttcggtagttggctttgttgcatcactaaaaccacatgctttcgatggttcaaattataaaagatggaaaccatgtacacttttgtggttgacaacga

SEQ ID NO: 32656 - DNA, 1501 bp, Oryza sativa
tgttggccgaagccggtgttgctctttattcatctagatcacacaagtacaatatttggggtagcctatcaaactgttgtcgacatggcgatctgaagttctgactcatagtcgacaacagggtagccttccttctcgaatccatatccggcgagatcagagacagcgctatatctctcctgacgatattcgtaggcaccgtaggggactagccatgtctatctctgaagtcgatatccggcgtcttgtcttggcgtatgttggcttatatgttgatcttgtgtcttaacctattgttccgtgtcccctctcctcctagggggccttgtatttatacccatagttgtccccttatccgagtagaactagggaaaccaatatggatataatccgagtagtccttgtcgtttttatgtagaaccctattcatcattccttatgcggaactcctcctatatccgaagtttgtttccgtataggacatgatatgtggtaggtcctgtcgagatttagtcaactactattaggtatatggtatccataaccctgacatcatttttaaccatacctttttttttgtaaagttgccaaaattttggctacgtttagtttattgccaattttaataagtacatataaaatcttgccaaaattttggcaactctaccaaaatttgacaatgccaaaacttggtatggtttaaaatggtaacaaagtgaaccatccctgaatatcgtcttaacctcttttaacatttgtttaaagaaataatagtatgacctgcgagtaccgtgacatatatacaaaaatattttctgagcgagaggagatacagggactagtgacaacaactgacaactgacaagtggagcagcactacataaaaagggcaggaggggatgatgcgggcgctacaaagtgcttcacatctttgcctcgttcgtcctccggttttctccgcagtttcttgatccatccgcctttcctctcgcagccgtcggcggggggagtggttagttggttactggttagtactccatcggtaaaaaaatccctccttttcatatctttttttcgcttccaatcttgcgcaattcgggacctttcctgccatttcgttctgtccaaattcagaacattgatacggttgtttggttgttttctcccccttttctgtgtctgtacactgctgttcgtcggttgattcttgtgtgagttgtgaattttggcaattgaagaataagaccttgatgtgtttgcacgcctatgctgttgttatccgtgtccatgcgagtgaaatgatccgctgaatttttgggtagatctgaacttggtaccttgaatccagtagcatttggtgatcggcgcggggattagggtttaccgttcagaggggacgcggatatttaccgttgtgctccaaaatttcactgattgttttgggctcaccaaccttttgctttcttgcaggcttgcagagttttcagagagatttaggcaa

SEQ ID NO: 32657 - DNA, 1501 bp, Oryza sativa
ctttctcaaagggactcaacgatggcggtgacgacaagctacacgaaggggtttggcaaaagcagctttgagaacagaggatccaacgatacatgtgcggtaccagatttgatatctgtacaataccaaacctgatatctgttggtctcagataatacctggtagatgccagatctggtacctgttagtgtttaggcatcctcacccaacttggtattagtatgagcacaagcaacaggaggtagtgcattacagagggcacagtgtttcttgcctgccatggagaataagatgaggtccatcaagaaaaaaaaatatttcctatctagtagaattgctatcttcctcatctgcagtgtaaagctattgtttttttatttgcttgctatgattgctactcgcgatagtagcactacaaccagtagttgttgttacctccttccacaatgcttatatcttattaataagaatgcattcattacttactacctgcttttgaaccatattgtagtcagtggcgtagctagctaggtggcactgtggtccatggactaaaaatttaaaactatagtatggtcttgtttagctccaatttttttttcaaacttccaacttttccatcacatcaaaactttctacacacataaatttttaacttttccatcacatcgttccaattttgacgtgaactaaacacaacctatatgtactagttaatataataaaaattatacagtgaaccacctttttaattgacacagtacatatagatggacaacctttactttacatcctagttacgctactgattgtgattgcccttagatactatgtactctctctttactataaaaaactaacctgtactggatgtgacacaccctaacactatgaatctgaaaatatatctatccagattcgttgtactaaaatgtgtagtatctagacagctagttatagatttgtttttgggatatgaggagtagatatcaaatttatatatgtaggtatcaggtaatataagtagataccaatatttaagaatccagtgatatgagctgccaggtgccggcttacatttttttattgagggagtagatatcaaatttatatatgtaggtatcaagtaatataagatgataccaatatttaaaaatctagtgatatactctctctgttctaaaatataataacttttaactataaatctagataaatgcatatataaattcgtagctaaaaatcgttatattttggaacggagatatgagctgccgggtgccggctaagcaatctttttcccttgtcagcctatcctaagcggctggccgttttctacgttaagcggctgcgttttcctgttttcccctttcttaaaccttccacacacaccaatcctcccgtttacacctgctcatcttcgtcgcgactcggtgttggctccagaaatctcgccaagagaccataagcccaatccaaatctctccgcgtaggaagcaga

SEQ ID NO: 32658 - DNA, 1501 bp, Oryza sativa
tccaccatgccctaagtatgtgaaaaaaacaaagaatcaggcaggcaagtaacactcattgttgtcttctgtctagctgtatgcttgttcttaaatctttgaattctaatttactgatgacaataggagaagaataaaaaacccttatgtaagtgtgataaatagctcatcagaatgatccaatgttactgaaagtggtcctaactagagtggggtatagcacgttatcttggtggatcagaatattgtagttttgctgtcgtgagtggtcctaatcagaaattttaatgctcgtaacacattatctagctggatcagactgtagtagtcactctgctccaggctctcttacgttgaactgtaattctaaattgcgtttgctaagcgggaacatgtagatccacatatttatttctccctgaaactatgaggatagctttgaatgcctacttgctggggcctaaggttttcctccgatgccttcaaatctttgttagcaacccaagtctatttgaacatatatctcactgtcagttcttttttggtggctatagtgggagtgacatttcagagtcattctgggcctcaacctcaagagtttcagtttgccataataatttttatttgcatgtatgatagttggatactaactggatattggaacagtgcgatatattgcacataccttgaccttgtccaggaagaactcacgggcaatgatctttctctggtgtgcccacgcctctccgttggatttgaggatgcccccaccgaacaggggctcgtgcgtcgccttgaggtaggagctcttgcccaggtccagcgacacgcagaggttgatgtcccgaaccacgtcaggccggctcacgtgaaggaacacgacgttccccatggagtaagtgaatattggacctgcaattgatcgtaaagttaaacggttaagatcatatatgaataaaaatcgtaagataaaaaattagattcaatcgtaagaacatatattgaagctgtttggttaaaggaaacgtatgtcttttctgccctttaagggcagaaacccactcttattccctttagttatactgtactaccctatgtattcatgttggttttcctctgaaagtacggcaagggttcattttaccattcgtcaatcgatctgagagctattgaaacacacgattgagaaaatagaggagtaggagaaaaatacatggttagcagggctgcacatataaaataaaagactgcaataatcatgataaaaaaataaccgtttggttaggctatggaaaccataggaatttgagagataataaaagacttgaaaggaaatttttcatgaggtctaaaactcatgttgattttttttccaaaacttgcacggattgaaatttcatagaattaaatagggtaaaatcatttgtttcaaaggagcatttatgaaaaaatctgtaggattgcaatcatgcaaaatttctattcatattctaaagtaccg

SEQ ID NO: 32659 - DNA, 1501 bp, Oryza sativa
caaagctgcttttgccaaaccccttcgtgtagcttgtcgtcaccgccatcgttgagtccctttgagaaaggtaattctaggacactgggagaatgaaaaagatttttcctaaaaaaccgtcaaataaatagaaaaagaaggtgattcatcttacaaattcgcttgattgggcctgacctctgctgccaagtcaacaaccttgtccaccaccatgaaatatcatgtgcgacacctgcttccccaacctccgtgagctctgctactgagcatcaccatggtcgctagcacgcaaggacatacaatcatcgctacctcaagtgtggccatggagaccgtgagcagagagatctaacacaagacaaggctactccgacgagaccgtcatagctgcccacgtccatgctttcgacctcatcctccatgctctggatctcatccaggagcttctcatccatcaccaccactaataacaaaacttactagtagcacataagataatttgctactatattccccttccagtcctctacaatcaactacctactcttgcatacccaaaatccaaaatctctcaatcctcaatccaaatcccaaactacgtaccaagctcgtctcgttagctagtggaagaaggctaattaatcaataagcttagcatattggaggaatcaggaggaaggcaagttggctatcgagtgaatggaagagaagaagaaaaaggcaagctaagccatgaaaaataaagaaatctaattcaatggagctagccaggaggtatttgaggatcagtcgggaagctatctctttgcccaaatcaccgttgccaccgcccacatcgactctgacaactccgcgcgacgtgtgctccaggtgcctcgtccatgcgtgcgctcatatgtctcattgtgcgaggatatcggtacataacatttccttttttaaaagtaattacactataattgggatgtaatttatattaaacttatatataattgatagcatagtgcgtgtggctggttggctagctagcggatgatcttcttttcgagctatttttgttatgtgaagcatattccaaacgaaaattgcgaaaaatatagagaagttattcatatttacaataacaatgacacacactgctattcttttttttcgagataatcacataaagagggtcatataaatattattaagattgagaaaaaaaattaaaaaaaggataaaatactatcgataatgttggttatgtaccgaagtgcacgtctagataccatgcatgaaccctacaaacatatgcaagatagtgaagcctagcaccaaaacaataaccactatacgtgaccgttcgtcgctaagcggagactcccaaaagaaaggcttggttcagtctgtcgaatatatggattacaataagcataacttgaaatgttgatgatatgctagctgcagcgcatacccatggtggcaatggtgcaagaagtactaataatgaactagccct

SEQ ID NO: 32660 - DNA, 1501 bp, Oryza sativa
tattaattttacaagctgcattgtgtaagactgttttcagattagatatgtttcatgggaaacgagtgtttctttagatatattaggaatagttcctcggggaaagaaaagtagggcagacatttgttgtatggggttggttgggcaatgttagatttgttggggctgcagaaatgtagacacccctgacctttttcctggacatattctttgtacaactagaatctgcgattttttaaaaactctttaggagtgcacaatgatgaaatgagagtgatgaacctgagttattttttccccttgttcttggtgtagttgcaagtttacatttatcacatccaaaactggaaatattactgctttagaaatgttagtcctctttgacttggagttggagatcatagttttgagttgctatacattagtatgtgatatattgtcacctctgcctaattctcactatcgttctcagttattgatgtctttattgatgacctctgtaattcttttagacaaacctagattatgcataccgtctgcatccttttctgttccataatcccaatatcacatttgggtctgatcatgctagaacaggcagggcaatgcaagatagtcaggtcacaattcgcacaatgccactgaatttctggaggatatcggcttgaaatctcagtctaattgcaaggattctcgatcgagagattccatatttggtagagcattcggatcacgaggcaccgtgcaccattttcttgacaagtgtggccatgtacttgccgtggtgctcggcgagggccagctcgagctcggacggcggcctggagccgtcgccggagaagacgcccgcgccgtacggcgacccgccgcggagctcgcccatctccaacatcccctccccgaaggtgtacccgatcggcacgaacagcatcccgtggtgcgccagctgcgtgatcgccgtccagcttcatccatgcatgcagccagagagattcacggagcagagtgagatgatctgatgcgagagggatgcgatctcgcggcggcggcggcggatacttacgcggtggtttcttggccgccggcctgggtgccggtgctgacgaagaggccggctggcttgccggcgaggcgctggtggcggcagagcggcacggtggagtcgaagaaggcctgcatctgcgcaggcatggcgccgaacctggcagggaagccgaagaggaacccgtcggcgtcggggagcccgtcggggtccacgacggggatgacgtcctcgccgtcgccgccgccgccgccgtcgtcggcctccatccgcgcgagcacggcggggggcagcgtctccgggacgcggaagaggatcgcccgcgcgcccgggacggagcccaccccgcgcgccaccgcccgcgccaggagccggacgtgcccgtacatggagtagaacacgacgtagatgcgcaccggccgcggggccgccgccggcgccgggatcgaggtcctctcg

SEQ ID NO: 32661 - DNA, 1501 bp, Oryza sativa; identical to SEQ ID NO: 32574

SEQ ID NO: 32662 - DNA, 870 bp, Oryza sativa
aaagttctggaaaagaagagaagtatgactttgatattactaaagctgacaagatctttgatctgctactccgagagaagcaaattcaacttcctactagtcatacaatcccatcggctgaggaattaggcaaaaagaggtattgcaaatggcataattctggatctcattctactaacgattgcaaggtttttagacagcagattcaggtggccattgagggaggcaagattaggtttgatgattccaaaaagccgatgaaggtcgatggtaacccttttcctgttaatatggtgcattcagctagccaaacagccgatagggtccgtgcaaggggttttcaagcgaattcggctaagattatcgacaaatatcagaggaagtatgacaagcagtaggagaggcatcatgaagaatacgaagatggttttgatcctcattggggttgtgagttctttagattctgctggaatgaaggtacgaggttgccatctattgaaaactgccctgggtgcagagatatcgtcgagagctcaagccgatcatataataggggtaatcggctaaggcagacaagagtttctgttcatcaatgattgggtccagtgaatcaagatcatggccaagaggacaatgtaatcaggaagaatcaatggtgtccttctggtattttcacgaagaatcagaagataagggttcaaagattgaggaacagggagcgccttcaggaggttgaacaagaaattaatcatcggctgaggaaagcaaagccaaggcaggagtggcgtgttaagaatcaggttcctgtagccgatgatgttgcagccgatgaggtgaagaggttggcaaaagggaagagtgttgtgacag

SEQ ID NO: 32663 - DNA, 173 bp, Oryza sativa
attacttgactaatcttttgctcctgttttgcagacaacagagtcctcccctctcatcaaagtaacaatggcaagaacatcgaatatgctttaggtctaattccgaatggatgtggattatctcccctgttatcggctaccatgcccccaagacttcaactctccttcacagc

SEQ ID NO: 32664 - DNA, 1501 bp, Oryza sativa
atcaggttgaattgaggcgcttcaaggtgattgccgcacatggatagagtcctgagaaggcaattgtatctattaattaggatgttttatgtgatctccttagagatacgcttgggcaaaagtctgccgcaaagacgtatggtatcttagagtttgttagagatagtagttgtatccgttatggacatatcttgtaattctcgggtataaatagacccgagccctatataacttcgaacacacatgttcaatacaatttcggcgcaccgccacccttttgctttagttctgtttcaacgagttcttgctttcgggttgagttgcatcggttttgatcttcaacaagaggcaaaacttgttatgacggcttgtattctcaggattagtgcttctatctttatgacactctaatcttgtttatgtaattcgtagagttatcatatatcttacataatctctggtaatatcgctatctaacctacaatcgactaacatctatcgaagagggcagctgattaggttagattttgacgttgatttagattatataagatatctaccactctatgaaacttccagcggcttgattgtctagatattgttcttcttttcatacttaatgctgcatcagttgagtttgatctattaagtcgtgcttagaatatcaatctctagcctgccttctggttgccgattagggtagcatcgaagtttcagccgatcttatccgatttaactatatttgctctatatgcttcattgacatgttaaatctgccctttatgccaagatattgctgtatctaagtatattaggcctttgtttgatatattatacctgttttaatatcctgatagagtagtatcggagtattagccgatacatgctagatctatctgatcggctatgctataaacatatatagtcctgttagtaatatatatttcgatctaagtgatttatactgtctcggcatggcgaccgatctatcccaatcacttgatttaagtatatatcgatataagaactatatattggaaatatctacagccgatcgaatagatttagttctttattgtctatttacaactgccgatcgattcacatatgacatcggctcaaagataaatgatatgtcatcggcgcctagccgatcggctatcatttatagatttaaccgaggtttctttgcttctatttcttattgattacaggatcaaatcaactggcacgctagcacaccccaaggcgagctttggacctgcactggagttaagcagatctcccaggcctcgtgttttctgtcaacagatgccctgactccgattttcctccctcaacctaaatcggatatgacgactcactcacctataaaaaattgatttattttatctatccaaatggttttgattgatttagcctctcttctcttttggcacactcttttggcacgcctggtgggacatttgagaagtcagccaacaattcttcctcatggcca

SEQ ID NO: 32665 - DNA, 1501 bp, Oryza sativa
gctcttcttcctgggagaaaagtcgatcataaagcatcgtgcaatcaccttcactcagagtgtatcgacagtgtggcttgtaactgtgtatttcactgttcccattttttcttcggggaggtttttccagtgagccatgtcagatttggtacatagaggatctcatgtttttggaactttagagtcgccattcttttctttgtagtgtcgatgttaaattgattataggtgatagtgatattctgggccatatgttgttgactcggtatggattattggttattgaatgtctatgcttgtgccatgtttgttcttagcaatttaactgtcggtaattggaatgctcatccattggtagtgagtgttgttcgttggtatgtgttggcattgcttgaattctttactcacaacagcgactggttacttctgtagtggatacttaggcgccccttgatttaaaggaaattcataggaattttagaggattttatttctataggaattttttctatatagccctttaaattaaaggaatgaattttatggaatcctataaaattcctatggaatgcctaatgccatgcaaattttggaggaattctaacatgaggtagaaactttcctttgagtctttatctctcctctaattcctgtgttttgtctgcggtccaatcaaacggtcattcctttgtttttcctgtgttttgcaatcctctgttttacacttacattcctatcaaaatcctacggtccaatttccaatcaaacggtaattcctctgttttacacttacattcctaacttacattcctatcaaaaatcctatgttttttcatttcaggggcccttaaatatttatgactacatttggcacgcatctaaatgttgcttacttaaatcttgcactgggacttgaaaaatgagccgtttgccactttgcctgtttgaaagtcccatcgtatgctcctattcccgtcttattagggaatttttttacgtgttcttgtcacttacaaaatcaatgctgaaaaaggaactacattgtaatatcttaaaattaatctcaatattaagtttgaaaaattaaattttagttttttctttgacttatttgggcatccgatctatcaatgcaaaaagaaaagaaaggaggaaattcatatgattcttttaggaactgaactaaatcctgcaaaaattatgtaaatttacttcgattcagaaatcaaacatgacgcatatgcgtatatcctgccgcaatttcgcaatccgtagaacagaatctggactggaggtggtccaaagcatctattctcagcctctcaggaatctgcccggcttccgggattcccccacctcagaccttctctctctctctctctctctatatatatatatatatatatatatatatatatatatatatatatatatatatatatatatactcgctctccgcctctacttcgcgccatttccaaatccatttccctcgcctcac

SEQ ID NO: 32666 - DNA, 1501 bp, Oryza sativa
tattctgcagaagttcactgtcatctaaaaggtaactgagaaaatgagaagaactagaacatggagttttttttttagtgagatcagaaattaaatttgtcgtaaatcaagcagtaaactggcaaatatattacaacaatctttgatattcatcggtttatcgaccaaatcttagtgagctgtttttagtttaggctttggatgcaaatccatggattggaatgttgcttctggcagagggaaagcggaaactcaccagcaattgaggcggagcatgttctccgatccggcagcgacgcgagatcatctttgttcccctggtgatagcgtagcagaggcgtcagataaggtatggtggggtggggatacggccatgggggtggtgaggaaggcgaacctcgctatggcgacatcaacaaccgtgggcagcggcggcggtggcggtggtggctctgcgcctgactgcgcggcaacggcggcaagcccctggggcgcggcgccgtggcagagaggttgctgtgtttgggctgcagagaaccccttgaccacccgtccaacgacgcggcgattccagcgcggtgccaggtgttcgtgcccccacgacggcgatggctgcttcgccggtgccggcaccgtcaccgatgtggcctccagagagttctggcggcaaggcgaagctctcaccatggtcggcggcgccgcttgcgaaccacccctctaccctcggtcgtggctgagcagcgtcgctgtggaggacgacgagagacggccggattcgaggagacgaggaatttggggattggagttggacgaagacagtttgggctcaacccaccgttccatcgaattaaatttgaaaatatacattgttttttaatattttacgtttatatacatgcatgtaaaatattcgcacaaatataccttctctgtatgatggaaacgcgggaccgagacagtgccgcgctttcattctgcggaaccggcagtcgcgcagcacagccgtgtggcaccgctcgctcccgcagcccgggagagcggcagcgtggtataggcagctgcacacggtcgaggtgaccgcctccacggcaccgatgcacggaaccgatccggtcacgcgacatcatggcgcgggaccgtgccggtcgcgcaacaccgtcccgtcccgtgtgtgcgcgtgtcgcggttgacgcgccatgcaagcatcacatgtcgagcacgcatgcaggcagttgatccagtcaaatcccaggcactagcttaggggtgtgttcggcacctccattttccaacccatctctctcatttttcactcgcacgcttttcaaacagctaaacggtgtgttttttaaaaagtttttatgcgaaagttgcttaaaaaatttaaattaatatatttttaaaaaatttagctaatgcttaattaatcacgcgctaatggaccactccattttccgcgcattcctggttgggaacctatactagcgaacacaccctaggc

SEQ ID NO: 32667 - DNA, 1501 bp, Oryza sativa
tgggaggggcgggtgccgccgcagccgccgccgcgtctgccgccgtcgacgccggcgccaatgcgcgcgcctcaacacttgcaccggccggccgcgccctctggccgccgccggcggcggcggcggctagccgggaagagttgcagaaggcgagctgcttccatgaggtggtgagaggaggtggagtggcatgaggaggagtggtggcagtaggagtgcagaacgccatggccaattcttgcaagaattggtcgagtggcagtgtagccttatctgaaagactgcaagttctctctatctgtacctgtgtgtgtcagcagtgtcttcgggttttgaggttgacatgtgacgaaaatatcccttttccgttctcacgctttttaagtgcaaaaaaaattatatgtgatagttgctttaaaatatcaaatataattaattttaaagtttatactaattaaaacttactccctccatcccaaaataagtgcagccataagtttctgtgtccaactttaatcgttcgtcttgtttatttttttttttttgaaaaaactaaaaaaaataatcacgcataaaatactattcatgttttataatctaataccaataaaaatactaatcataaaaaaattttaaataagacggatgatcaaagtttagcatagaaactcatggctgtgtttattttgggacggagatagtaattagttattccctaatagcccaaacgaacggaaccgaaatgagaaaagaacattgtgatctcggtaggatattggagggtattctttactactacatctcattttattttattttaagtgcagttatggattttaatgtccaatgtttgatcgtttgttttatttaaaaaattaattaaaaatagtcacatatagtacaatttatattttattatctaataacaataaaaataccaataatatttttttctcaaataagacgaacaatcaaacattgcacataaacaatgcaaaactgtactcttttgggacagaggcagtacttatacttcctatgatcaaaatttacgttgctaatcttaccggttcctttaaaacataggattttgaaacacggggataaaaatctcatgccttataaaattcctgcataaaatagtagtcgtttgcataacacgacaaaattataggaattaaagacacgttaaaagaaatccacgaggtgagaataaacttctcaaagataaaacatggaatatagaaaaccaggtctataagatttttaaagttgcattccttcattccaaaggacactacagaaattctaaggatttgaattctttgaaaatcctaaaatatcgtccaatcctaaagaaatgattcatttcatatgattttcaaaggaattttcatggttcatgttttttcaaatccttaaatccttctctcttgtttttcttttgttgcaaacaaggcctaagaatttagactaatggctcctttggtatgcaagattt

SEQ ID NO: 32668 - DNA, 1501 bp, Oryza sativa; identical to SEQ ID NO: 32667

SEQ ID NO: 32669 - DNA, 1501 bp, Oryza sativa
ttaattatagtttgttgcattgtgtataatattatgagcaaccacttaaaagcttcatgtaatatttttgctgggataaaaaaaattgatggaaggtaagcagtagatgtgattaagtgcaaactagaaacttttgcctataaaacataatagtattgtgtaagagctgaaaggattccctgcattgtaatcatgctgagtcactgtcattctttggtcctaaaatattatctcttatcaagcctaagagtctaagatgatgaagcttgctactacgatttgatagtaaaaatcataattaggtattctgctgaataaagacatgaatataaaataaaattgttgtgtaatatagtactgaatcaggacttgaataaaagataacatgctctcttttcaatttcttaagtagaaatggctagatggactatcatagttttccatttacttgtttatgttttcattttttttataccgctcattctattcaaacatatcctaatgtttcctgtttgattcagatttcttaaaaaccaactgaagaggtgttttaacgaatgaggaagctgatggatggtagttgtagaagtcccgtttcggaaacccaatggaagttccaagtgttttgacctcacagtttatctacatatttttggagaaacaggaacccttttttttttcctttttttgggtggaggctttgcttgtgagcatattgagaacattgcagtagagtgactcaattcagccagcatgtcatgaccatcacataagaatatacatgctgtgtttgttgctggacaatatggtcatctttgcacttgaaaaatagatcgatggatgttaatgtaactttccaggattcttgtttaggcatcttctgtgcttgcttattcatatcggatacctgtcatcacattgtttcagctggtaaaaaattcaatactaaatctcgggttgtatcttcatgcttggttatacgtgtgcatcagcacctaagtgccaatctattgttactggtaggcaagatatgtaaaatatctctctgttacttatttgaggcagaagagcagggaatcattcgaatatatcgcagtgatttcatgatttatacgcagaaaacagtgttttgctttcatttgatagaaccattgcactactatgaagtacaacgaatccagacatggttatgaagtgttttatctggtactaggttgctttataggacggagggagtagcagctagcatggcaaacatgatggtcaatctctgaactttcaatgccatttgcttcaccccgctttaagacaaaaaccaccttggtttcacattttcacttgtacgttacgccgcgtggttttatcaagctttggtgaagggacctaatgatttatgtattcagcatatttcagtgcatatataaaaaagtttctcactgttcttataataaattttcctccctaagataaataagaaggatgtaaagagaggaggctgctt

SEQ ID NO: 32670 - DNA, 1501 bp, Oryza sativa
gaggttattcacatttcacagcgccctctgcaacaatgtcgccgcaaaggaaaaaaaagaaaaagctaaggcagcaaaagaaatcaagaaagcttaagctaacaccaaaacgatcgagaagtgaactaatagctagctaggaaatgataatatgtagtagtagcagtagtagactagtagtagtaatgtaggtaggaaatcagatgcctggcctgcccttgtatgccgcggaatggatacgttttaggccggtttaatccctcgaccgccgccgcattgccgtgtcaggtgtcaccaccaccaccagcagctgctgctcatcatctccgttctgcgagatggatcggagtaggaaggcggccatggcgaaggcgaggagctcctcgatgaagcgtcggtttgcatggagaagaagaaaggaggagatgtgtggtggtgttagagagagagagagagagagagagatagagggagggagctgtgggcgatggtgtccaggcaccggcagcaaggcagctgcgtcgtcttaagaaagagcagaaatggcatggagccctccaaagcatctgatggctggccctgtatgcgtatttatttatgtaggggctaaaggcatcttttcgcaagacgtacactgcacactgctctcattttttgcaagacgtacgctgcacactgctcttatttgagagagagataagagatagagagagcagcaacagcagcagcaattttttctttaaaaaaaataatcgaaaacgcagcaaattctaccactccctcagttctcagatgcataaggttcacaaaaccgtttgctgaccgaaaatcgctcagtgttggttttgtcagttttggcgaaaattgtttgaaaagagatggaattcagataaattgtcaaaattttaagattcaaattgatactccaacagtcaacagagtggtttgtcaactcaagccagctcaaaaccacgaaatgtcgtgaaaaccaagtggttttcgtcggttctatgaacctcaaacgtggaactggtgctcttcgttgcatgatgaggcagcatcgccaatgtgaaaagagaactgaaatattcatggttgatcactttcagcattctccaacggaacaaaggcattgtttagttccaaattttttcttcaaacttcaaaacttttccatcacatcaaaacttttctacccacataaacttttaacttttccatcacatcttccaatttcaactaaacttccaattttggcgtcaactaaacacacccaaagactgattaaaacaggtgtcatacccgaactgtgtttagttcacgctaaaattgaaagttttgttcaaattggaacaatgtgacggaaaagttggaagtttatgtatgtaggaaagttttgatgtgatgaaaaagttggtagtttgaagaaaaactttggatctaaacacggcccaaatctgctagtagagcatagagatagattggtgaaaagagtactgta

SEQ ID NO: 32671 - DNA, 1501 bp, Oryza sativa
aagtaaacctactacagccaaaatactataatcccctagcaactatttgaacttaggtacagagagaacattgttctttttctttttcttctgaactgacatcgttagaaaatgatttccttatggcttcggcgggtatcaaaatctgaagaatgcacagaagaccatccatagtatgtatgtaaaagggggcttcaccttttaggttatcaaccaaccattagcctgttagccccagcagaacgccattaaatcccaaggatgaacaagtaatcccctcaccccgagcgtgggggcacttaccatgactccacgacgatgcgcttcccgttgctggccacagcgctgtaatccgcagccgccacctctgcatcttctttcctggccctcttcctccccttctactcgggtgctgccgcctcctttttggccgcctttgccggagcctcggcccactgcttcccgacggccatgctccgtgtcttcctcggtgacccggccgccggagacttgcgcttaggaggcatcagcggcagtaggcgagagttagcgttggttggttccttctccaagggagatggagttggggttggggaaatgggggggtttcgtcggaattgagggaagagaaaaggtgcgagaggttcccgcccaaccctcttcccattggcaggaaagaatccactcccaacttggtccttcttgggccttgggcctatgaatcgattgatgtatgagccttccctgtaatttatcgatgtgaacccatctgtcagctggaagtatctttcagttggaaaaagtacaccaaaggtcactcgacttgtcatcgacttaaaaaacgccctcaaaccacaaaaccagatatctggtatcccttaactaattaaaaccgatcacaataggtcctagatcagtattgcaacaggttttgttcgacgtggtgactgagtcagcgtgggacccacgtaggcactatatgtaagagtgatccacgtcatcacccttcctctttctcctcttctatcattctgggcgaggcgagaggcgggtgcagaggccggcagatgaggcgggagagaggaggagggtggtggctgcagcggggtacagcccagccggcccatcccgtccccgccgcaagcggtcgtcgtcttccacctccagacgctgcccgttcctctccccggccacaaaaccctagcgctgccaccgattcgatccgcctccccgcttgttttccattccgattgattacgaaaatcgattacccttcacctcctcataaattcccccatgttttccccatcaatcatgcctttaatcgccttgaatcatcgcctcttcatctccggcgaaccgacgccattaccttcggcaaccgagctccccggcactgtgttcgtgttcctttcttggcctctctcttggttcgtgttcctttctttcttgccaagtgccaagtgccaaccacggggcaggagttctcggcgccattttt

SEQ ID NO: 32672 - DNA, 1501 bp, Oryza sativa
attgaagcagaagcatcaagctaggcatagcactcacagcaaggtaaggaagggataaatctttcttaaaaaaaaaactaaaaactaaatggccgttagaagataaatacacgtacgcgcgtgaggctagctatctacacccacactgccgtgctgatcgatcaggcctcccagttcatcaactagctagctatggccatcgtcctggatgccttcgcgtcctacgtcggcgacctgctcaagcaggtggcccaggacgagctcaccctcctgctcggcgtctccagcgagatcgccagcctccacgaaaggctcaacagcctcaaggactacctcgccgacgccgagcgccgccgcatcaccgaccagagcgtccagggctgggtcaggaagctcaaggacgtcatgtacgacgtcaccgacatcctcgacctttgccacctcaaggccatgcagcgtggcggcgtcggctcatccgcacctcccgtcaacatcagctgcctggactcgctgctcttctgtctccgcaatccgctcttcgcccacgacattggtagccgcatcaaggcgctcaacgccaggctcgacgccatctgcaagagcgccgccgccttcagcttcctcaagctggaggcctacgaggacatggcggcgcctcgccgacctagtgccgccgaccgcaagacggacccggtgctggagcggtcggctgtggtcggagagaagatcgaggaggataccaggacactggtgaagatgctcaccaacggcaagaacaagaagcagaatgcagtggtggtggtcgccgtggtgggcaccggcgggatcggcaagacgacgctggcgaaaaaggtgttcaatgacgaggccatcaaggaagcgttcgacaaaaagatatggttgagcgtgacacaagacgtgaacgaggtggagctccttaggatggccattaggtccgtctctgtcggcggtgccagcgatggtcgagagagcaacaagtcactgctggtgcccacactcgtggacgccatcagggacaagaggttcttcctggtgctcgacgacgtgtggagcgacagagcatggagcggcctgctcaaggtgcccttcagccatggcgccgccggcagtcgtgtcctcgtcaccacccgccatgacgccgtcgcccggggtatgcaagccatgcaccccttccaccacgtcgacaaactgtgccctccagatgcatggtcactgctcaagaaacaggtcagatttacacaatatactaaatgttttacatccctccctcatctatctctgccataagaaacactgtgacacctatcttcttggccataataattaattctaacaacaaaaatccccgaaaaaaaataatctaacaacaaaaagacattgccaacatattaacttgtatgtatatagactagaatagagtaccatttgctaaactaattgttctaaatgcatgcatgtatatgaaataattttcaggtag

SEQ ID NO: 32673 - DNA, 975 bp, Oryza sativa
aacgttgcaagtaaaaattcaaaatcccttatattgtgggacggagggagtagtacctaagaccaaatacaaacatattactcataatacaaggttagtataaccgttcgcaactctctcgtcttgcagtatatatgctccctctagtcatatagtagtaatactttagactatgttcggttagtcccgagagaaagattaaaagggatttatttcacacctattatggtgtggaattactccccctcaaacccctccaatccgctttaaccccctccaaaccaaacaaggccttatgttttgaaaataaaataatcaaactttataacttttgtttctaaaatacgaagaccatacgtaaaattagttttgtataaattagttttaagaagtacttcaacatccataaaatcatatatctattgttatttttatttatactatagtagaaaataaaggctattgattttttatatttatactgtagtagaaaataaaaagttacagttgttcttttaaggccgtttcgttatcaaccggagggagtagcacacatccaagcccaccgaaaaacgccccacgcagaaaccgggccctataaggttattgcaggcttgcagttatgacaattgacaagaacgatcactaaatcctgggctacaagagccttcggtgtgcgctgaaaaggtcagattaacactgaagcttcgcccaggttaatcgtgctcgaagttgcacaatgacgaggtgaaaggggccaaaacttcttttcccggttcgctggttttttaagtgccggcgggcgatgggaggtggacgactgtgctgtgtgcagagtagtatagagaaaattgattagcgtacaaaattgacccattgcatagttgtacaaaatcataaaagagaacagggtcgatgttgcaggaaagatctgaaatgtaaatgaacagagatagaggaaattagtgacgaatg

SEQ ID NO: 32674 - DNA, 1501 bp, Oryza sativa
aggagattaggttagagagaataggctctccgctgtcacaccaaggaaatactataagaagatgtgctgctcctttgatcagaaattaacaaccagggcgcaagatatggatcgatccacatgactcgcacatatccatgctgcccacctcccttcttttcctctatcccagtgacatgtaggcccaagcctctctctatattcattgggaccacctatacatttgtcaacaaattttctactaaaaatttgacagatgtaattatagtacaatcgtagtgtaattacactgtaacttatatgtaattacactataacttgcatgtaactacaatgtaacttgtatataagtttcatgtaattttgaatctttagatctattacaagatttgttttggtgaggaagaaaaataaaatcacagcacatacatatgtaaggatttgtttccacaacctctattttatcgaaataacatattacggagagatttttgaaagttacatacaagttacactatagttacagtgtaattacactacgattgtactgtaattacatctgtcaaatttttaggagaaaatttatcgacaaatatatagcaaaatcgaataaatatatatgacgtaaaattttagtgatggttttaccagggttcttatggttatattgctggtagtgaaggctcgagatcctctagcccctatgatagatccgctgctgattcggctgggaataagccgcataacgcggtgctggccttcgccggccggctatggtgggtcaatacaagctggggcgtggtctctgtcgacccgttcagctaccgaccggcaaatcatcgaattgagggagataaattgatcttgttttaataattgagggaggacagaattgtaaaccgggagcccacagatgctaggaaaataaaaggggaaaagaaagcaaatgatgaaaatgatgacaaggaaaaagatccctcagtaatcctttccttcccacgcaatcccacataaaaaagtgaaaagaaaataaaggaaaagctattgaagcagaagcatcaagctaggcatagcactcacagcaaggtaaggaagggataaatctttcttaaaaaaaaaactaaaaactaaatggccgttagaagataaatacacgtacgcgcgtgaggctagctatctacacccacactgccgtgctgatcgatcaggcctcccagttcatcaactagctagctatggccatcgtcctggatgccttcgcgtcctacgtcggcgacctgctcaagcaggtggcccaggacgagctcaccctcctgctcggcgtctccagcgagatcgccagcctccacgaaaggctcaacagcctcaaggactacctcgccgacgccgagcgccgccgcatcaccgaccagagcgtccagggctgggtcaggaagctcaaggacgtcatgtacgacgtcaccgacatcctcgacctttgccacctcaaggccatgcagcg

SEQ ID NO: 32675 - DNA, 493 bp, Oryza sativa
  unsure (1)..(493): unsure at all n locations
aattcctgcagcccccgtcccatctttgttctcaacgttgtcaccaactccacggtaacgtgccaaatccgatgcgatgggtcgggtcccggccgcacgtgtgggccgtggactcgtctacggtcacaccgtcgccacgtccctgtccgccacctcgtgctccttgctgacctggtagttctgggtccaacccgacgaggacacgtagtacgacgacgacgagttcatcaccgtgctgctgcgcgacgtctcgtcgtcgtcgtcgccatcgagcgcgacgggcatcgcgggccacatgaacgccggcttcgacggcggaacgtgcggcgggggggcggcgcccgtcaggatctgcaggacggtttgcgtcctcggccgctccccggggttcgggtggctgcacgcgaggcccagcagcaggagccgctcggcctcggcctcgtcgaactcgccggcgagcctctggtcgacggcctcgaggatgcggccgcng

SEQ ID NO: 32676 - DNA, 1501 bp, Oryza sativa
tcctctcttcaattgttctttttcttttttccttcctaattcctttgttttttttgcttcctcccgttggctactgggggtgcggcggtgcgcatcatcggccgttctctgtttcaacagcaccgtgccattggccaatcccaaccattactttgcatggacgatcaggatttgcaaacccacaagctgaactgctgaatgataagtttttgacccaacaaacttgtgacagtttgtttttgacccaacaaacttgtgacagttttttagatactccccttcctctcttctcattggcacccggcacggtgagcagacgatgcgcacccaactcatggtatctcacgatctctctctttctttctctatcttcatttatctctctctacttcatctttaagagcaagtttaaggcttcaatacatcaatagtcaatttaataacttattcatgtaatagttacctataaacatatactacaatctaatagtttattcatataataatatactacaatctaatagcttattcatgtaatagttacctataactatatactacaccattaatatatgatcccacctctcatatacacacaatgtattggagtccgtgcggcagccggtctgctttccttctctttttctcttctctcctctacatgagtttacagcactcagcctgctattgtactcgctctaaatgggccaaagccctggtagctacccatggttgggtgcgcatccacatgatgacatgagcctcttgctctagcccagccgaaccgaaacgccgcacccacgaagagccttgctgatgttggtttctgcttttcttcagagcatgagagcatgactgttactgctttttcttaatgaacagacacaagacggtgccaatttccttgaatagagaatgagtaaaagtctttagagggtaaaacctaaaaagggctatacaagcttaagaaacaatctctgctggatgctttgctctagcacgcacccaagtcctccccctcctctttaatcttggtgagaagagctattgtcgggagttctttagcacaagttcaatagtatagccaaataccagccccaagtcatctagagccaatgtaatagccaatctatctaggcaaattttgctacatgatacttgttatgtgtggttttagccctaggacactgcccaaactcacttttgggggaaaacactccataaacgtggtaatttgccagtggacaccgcgccgattaaaataatactttccggttggggaggagagagaaatcgcgtgaaatgtcaaaaaagcccttgggcccacatgttagctctatctcctatctctctcctcatctctctcttttatctctcagagcgcgctcgcacggggtggcgaggacggcggccggcggagcggcagcgccggcctgagagtactaatcacaagagcaaatccacaaatactagtattactactaatcacaagagcaaagca

SEQ ID NO: 32677 - DNA, 1501 bp, Oryza sativa
ccaatttggtttggacggttgttttggtttcgtcccacatgacgttgacatggcatagaagcaagatttaaaagaaaaataaaagttcaaacaaaatatgtggggcctacatgtcaatcaggaaaaaagattttaaaaagtgggacacacatgtcagtgggtcacccctctctctccttccttcgaggggaggggggctaggcttcatccggtctctactccatcgccgcccccacatcccgttgcctatgttccatcccctggaccgactcgaagacaaggcatgacagcggtggacctagcagcacggtctggatctgtataggagagagagggggagttttcgagaacacaacaaacttgtgtgagaaaggttgtagttttctcgggtgaatgggagaagtgctgctaagatggtgatatttcgcaggatttattccctctcatgatggccacccgacggagagggcgagagaagtgctattgagatggggattttgcgcgcgtttacttcttctcgtgcgagtggcaagggattttgtgcacgttttactcctcgtgctagtggcaggggatttttcgcacatttcagtccttctcgacccggtgaatgggaatgttttgcgcatcttgtgccttctcgcaccagcggacggtggaggttgcaggggtattgttgaggggtgttttagacttctcgtgtttaattctcaccaagtctcgtgaattaacaaggtaggatggtggggagttggacggattaattcccaatcccaatcccttcgaaattcccaagccctccaaccaaactacttcctctgtttcacagtgtaagtcattctagcatttcccacattcatattgatgctaatgaagacttcattagcatcaatatgaatgtgggaaatgctagaatgacttacattgtgaaactgagggagcagagattaaaatgctcaatattctaaactcccatttcctctctcatactctggcaactggagggaaggggactgggagtttagacgagagaatggatagtgagattaaaatgggaatttgatttttagtcccaatatattgtttggtagaggtggtggaaattgatatggagtttagtttaatattagattttttttttagaactagggcgatggcgcccccatttctctttgtagaaatgatagtcattacaacaagtcttgagaagtagtaaaaaacagataactaacgacaaacctgaccactgagtgggacaggaacagaagaccatcagcctaaccattacaggcctaaccaagatgacgatcctagatacagagtactagggattaaacagacattccaaggagtatcaaacaagatcaaactgccagggagagactaagctggtccaattcttctgatgcctcctcgccagccatgacttgaattgaatacttcacttgccacctgtcttaggtggtgttttaactttagtccctgtctttagacactaatt

SEQ ID NO: 32678 - DNA, 1501 bp, Oryza sativa
acaagtatatccttccagagcaactacattagccgtatgatgtctagggtgttcatttagcaaattgtgtaaaatcatcagttgtttcatcctgtcaacatatgattcaatactaggatgatatgtaacaaacacaactattgcttaatctctagagttcaccccataaggacatgtccttaagaattcaaggagatattcgaaatgcagtaaatacattggcccaaaccttacaggaaatatagtgtaaagacttgtataatccctagcacatgggcttgcatcaaatgacactgtagggccatgaagaaaaatcttgttctggccaataaaagttgtattaaagctcaactcttcacgatgcagtctagtaacatgcatcaacaccttttgaatattgtagaagatgaaatccaagaaaaaccgcatcatggggtgcaatgattccaacatcttaaatatctggatgtaatggaatagtacagtacaataatccatcactaacattgcatttttgatcgattgtcattggcatgcagcaaaacacaatgttatagacatatataaataaaggaaattaacatcagttttaaatagataatattcactgtccggctctttctcgataacgaatctcaataattaagttcagtgtaaagggtactccgacagtgatttatcataatctaaaaccttgccataacattgtataggtgtcttaagcattgactcctatcttttgacatgcagaattaactagagaatcaatctttgtattaaatacatccacttatacagatacactaacaccgcatgccttgacaaatagtgattggcagagaaataacggtttgctcctggttgagaatgtggtgactgtcatggaggcagttgttgcgtgcggctggcaccgtgctttgctgttgtacctccgtgtttgactaacgatgtcagtgaagcggatagattggttaagtctcaaaactctttatgtgcaaaggagaatggacagattggataagtctcaaaactctttatgtgcacaacttttccaactaccatccataataaataagtacattccaaaaaatgccattcaaagtaaaatgagcacacataatttgggttctttcccacaaaaaagtgtttaggacaaaaaaaaataacaaacggtaacgatatgcgagagcgtgccagtgtaactaaggacacaaaataaacagaaaacatagggaacatgtgctttattaatctcaaggatcataaatacaaattcccaatgtaatatatatgtatatatgtatgtgcgctccatagcctgtcgttggacaaatctaaacttggataagtggtcttctaattcctggggtctcgaaagactcctagttaattactgccacaggtttaggcctacagagcacctccgattaagctgcatgtggtcgtctcgtcgtcttcgcttcacgttctccatgcacgatgaatgttggtgaagattgtg

SEQ ID NO: 32679 - DNA, 1501 bp, Oryza sativa
tgttgccaaaaatgccgatcaggtagcatgttggtgtaacatacccgaattctaggattaaggaatttctatcaaaactagttgaaaggaaagttcttcaattttgtaaaccaaaaatttccattttaaacctaggtgaagttgatctaactcttgcatgataaaattttaaaacaaattaaaacctttgcatctctaacctaggacaaaaatataaatttatgtgtaagcatgcatactctcatagacatgtttgacttgagtccttcatatgcatttggatttggattgcatttggattttcgatttgcatttcataataggtctcatgaatattaactaagatctagataaacaactaaaccattagggcctagtgctagctagaggaagttaaaatagaaaccatacaccttaaaatatatcaacaaggccaatgtcaagccccacaaaactattttggtcatccatctgaagactagtcatgaacatggaagtgaccaaataaattatatcatatagggtatattctatcttaatcatctctataagcattctcttaatttaatactaaagtaaacttgtgcataataggtaaggagcttatgacctgtgtaatgtaaattgtaattctaacatatcaacatcacctcaggttaatgagagtccaaatataacttttataaacatttacatgcatttaggaaagggaaacatatataagacataagtcttgcgaattatctaaaataattcgtgcaagataaaaccatgggaaaattcatgtaggctctaatcaacacatgcaactcactgtaattttggtatgatttaataactaaatttggtacctcaaataaatcagtcaaactaataaaaactagattaactgtagttcttaatcggctaaaaccatactttgtctaaaagtgcatttaactgcataaaagtgtataagtaaaataatttattcaaatactaggtcatttataatgaataaaaataaattttccagaatttatcttctctatttaggtctcctaaaaattcgaactagtttccaaagaacccatattcctctaatttctgtgagtaatctatccataatttttgagtgcaaccaaagaaaatggaaactaggtacatacacctacctccagtaaaatcaacactagttaatctgatcaacacattaagtattgaagctacaaaattagaggagaaaataattccggaaattcgtccaaaaaccaagctcacccatgtctctgcctacacatctctcttccacctagtttacttcgacctgggcccccttgtcagtccctccggcttgcccttcctctgtgcaacttccctagccgaccgagaaacactgagagggagagatcgagcgccgaccggctctggacgccgcgcgacgcgtggccacgacgtgtcgacgccctaaaaacgccgagctccatttctgcctctcccagacgcgtcgccactcttcacc

SEQ ID NO: 32680 - DNA, 1501 bp, Oryza sativa
cagaatttatagatgaaactatgcatgtaaacatagcttaaggttaccttgtatgcagcattcacaaattccatcattgctgaaattgcaatgttaaatcttatttcttgaatttcctctgtgacctataaaacctagaatagtacattatagtaaggagtggcatgaatcaccaatcacatcagcacaactacatgaaaaacatttatcactgcataatcatgtttagcagtaaggagaccctgagaattggctgatgatacaatcttgaaatagttagtacataggcaaaacttttcacaagataactgataggggcacagttgcgaagtaccattacaaataatccatctcaatattggaagcataaaagattcaaaaataattgaaatggtggcacatgccgtaaaattaattaataaaatttatattccccaagtgcatggcatgtataggaattatgtgcctggaacttggtagaactgttcaaatttccaaaccagactgctagtaaacctaaaattttgaatggctttcattcagagtgaattagtgaaaagatgttatttggtcatgctatcaactgtgacctactcttgcaatgcatttgtgaagaactcggagctaatacaaggttggttctttatcggtaaccgtagttctaactccatatgatccatctagtgtgaaactaaagcatttcttttttgactactgcaggaaaaaacaaacaatggagataccctaatactccctccgtccacctaagattgaaggcgatattccatagtagaactatttgtccagattttctgttctatgaaatatcacatccgattctagatacacttatattgggacgaagaaagtatttttgaataagatgagtggagctatgcacgccctaatgtctataagcaagaccagtggggttgtgcaattgaggtaggttgcatcttggcttagctgttcacgagaaactacccccagtcgagattggccacgccttgatttgagttgatggcgtcttcaggggtaagagccaaagatccacactggggatggcctaagggggagttttgatggtcaccatattttgccacaactttgataagctactttgatcaacttatcctagtgctactttgatcagcttatcctagtgtttatttggctgccatcttttttctgcgctatctttttcttttgtgtccccacctgtcatatatacatatctttgccaatacttgcctaacttgtggccaaagattttttagccacacaaattgtgtcatgccacaccttagctataaaaagtttgataaacaaaaacaagcatccaaatagccctaactcatgccgtgtttggaatgatatattgctatagtctaattagccacacataaaacgagacggataattagtgtataattaaattgaatattaacaattataattttgaaaataaataatttgtttcttaacaaaattttatagagta

SEQ ID NO: 32681 - DNA, 1501 bp, Oryza sativa
tataaattttatcaaatttattaagtctaattgatccgtagcatcacattgttaaatcatggcgtaattagactcaaaagattcgtctcgcgatttacatgcaaactgtgcaattgatttttttttcatttatatttaatactccacgcatgtatttaaatatttgatgtgacgcttttggtcaaattgttttggaatatgaacaaggctgttttcgatattgcatttttggcctcccctgatttctcgaactattagatgatgatgcagttttataaaaataaattaatagaaaaataattttgaaattatattaatgcacttttaaaagtttttttaagctgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttacaccaggcttcatcctaaccattacaggcaaggtgttacacgaaaaagggcaaacatgcacgttgttaagctgacgcgtggtgaacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagagggggacgggacttttttcccttttggaaggctgaggggaaagggagttaatcctttgtgactcgtccatacacaaatccacaaaaacacaggagtagggtattacgcttcgcagcggcccgaacctgtatacatcactgtgtctcgtgtgtcttgcgggcgggtgatctttccagatacagagagagagagcttgagatctcaccctaagcccccggccgaaccggcaaaggggggcctgcgcggtctcccggtgaggagccacgagctccgtcatctggcgcgccaggtagggggctcagtgtgtgttttctgagctctcatactcttccgtgtgcgccaagtttttcttgttctgcctaa

SEQ ID NO: 32682 - DNA, 1501 bp, Oryza sativa
tcatgtttccttaacataggaaaggatcaaatatatcatctatactttgttaaaagggaatagtggtggtggttctgccaccacccccatcaaactcccaaccttttttgagaggaaaaagaacaggtgaggctagagggctcacatgtcaaccacccccaccaactctctacattttggaaagaaaaatgacaatgtagggtcaaagggtccatatatcagtaacaaaatatatgtggcaactaagagatgatatgtgcaaagaatgttagtaataacgggttgtctatactcctttaaaagagtgtagtactcctttaaaagagagttgtcatggtggtgattctgccaccacccccaccaccaactcctaccttttctggagaagaaaaaggagaggtggggctagagggtccacatgtcaaccacccccaccaactctctactttttggaaagaaaaaggataatgtggggccaaagggtccacatatccgtagcaaatatatgcagcaattaaaagattatatatgtagaaaatgatggtaataacgggttaatgataattttctttaattaaaattttgttgcaatgcacgggccatatgctagttagacaagaatagcagaataaagtatcaagcgaacttggttctttacctcaattcttcgtgtccttatctgcacgaaccaatatgtctgacaaggttttgcttttgatgttgctcttggtatttggagttcctacagtgagggagttaaacaatacaacataagaaatggaactgtacttttgtgtacattcgtatacagtatgcaagagcatagcatcttgtctctgacacattcaacagataaaccatgtttatacactgaaacatgttcagctcagttggctgtaaatgcataattttccatcaccatttagctccacattgggctagtgcagatcaataacgtactcatcaacaaacagaataaaatggctatgcatgttgacagaaatttaggtaagtttcaagcaatttgcaatgggtatttctgtttttttttggatgtttcaacatgcctacctaaattcccagattacagcaactaattccaccattcaatgaacaactgaaattggaaatgacttatgacacaatactaatatcaaaaaacatccaactatatggtttattttcgaatgacatgtaagacagccttttcccagattgctcccaaaaggagtctaacaatctgatgccaacttatgggttcatgtttggaatctctactcggctaattttaagttcaatatgcatcagtaaacccaaagttgaggactcggccattgttttccataatgagaaattggaatcacagctccaattgcataataatacatcacctcaccgaaaagagaaaaatcctaatccatcagaacagcttacacttgttaaattttagaaacctagaaagcgaaagttaagcagtgggaacgtgcgaggggagtaagtg

SEQ ID NO: 32683 - DNA, 1501 bp, Oryza sativa
ttatccttttacgaattttccttatgttttcatatgtttgtatttatttatgatttttaaaatttatttacgaattttttttcttatttattccctgttttctatttatttccatcattttaaaatttatttacgaatttttccatatttatttcctgttttaactttattttcattttttaaaaatgttcactttatttcattttcttcaatctacatttcagcctctatgtggtgtgtgagccgatttctcttccaaatgtttcatccaaagtggctgaaatagagcaagggcaaaatagaccttttaaacctccgttagtctccgttagtgctgattccatccaaagtggcgcacaggtaaacgaaaatttgtgtcatggcatataaatgactcaaaacttttttatggcacatgcgtacctccaactttcttaatggcataggggtaaaacactcgaggaaggaagtggagaagccgaggcggtcggtgaggtccacgagagctcggttcacgcggggggagcggtgccgtgttttgaggtaatgaggtagggcccgcatgtcatgtcagggtggtgacggtgtcttgctcctcttccggcttccgcactgcttgggaaaaaaattgaaaaaatatattttttatcgcatttgtaagaaaatactggtttataaactttcatcacacagttcaagacattcgatttaaatttgaaaactttcatcttaaaatttaaaacattttttaaaaattttcaacttaaattggatgtgaaaattttaatttataaaacaaaaaaaaaatcgtgaagaaaatcacgcttgcggcgagaaaaaggtaactaatcacgggagaaaaaaagagcaacagagaaaaaaagataaaaagggaattagtgtttgcgccgccaacgcctacgcgctaattagcgtttcggtaataagcagccttatggcagatgctcattggtctccgtgcctgatgcagcaacgggggttcccgatctttcgatgagaggaggataaacttcgatttggggaaggatacgacgttggctgtccgactacaactaccacaggggtgctgcgccgtagcaactggtacaccgactccacgttgttgctgttcttgtcgtgccaagaacaaccttgaacctgcaagcaatcgaagaacaagcaagaaacaagttgacaaggaaacagctcacggcacttgtcaaatgatgaaacttaaacaaaccaaaatggggttctaaatacaagtatccgggtggtctagccgacacacgcgagtacaaggaagtagctgcagctaaacttacatcaaaacaaaacccaaagtgcaaaatggtggctgctaggagtgtatataggtggaggaatgaccaggagaggaggtgggagcaaaccctaggttttgtggacccctaatgggctgtaatgatacaaggcccaagcccaagtttctgatgtaaagaactattttcgtcattctgag

SEQ ID NO: 32684 - DNA, 1501 bp, Oryza sativa
gtaactaatcacgggagaaaaaaagagcaacagagaaaaaaagataaaaagggaattagtgtttgcgccgccaacgcctacgcgctaattagcgtttcggtaataagcagccttatggcagatgctcattggtctccgtgcctgatgcagcaacgggggttcccgatctttcgatgagaggaggataaacttcgatttggggaaggatacgacgttggctgtccgactacaactaccacaggggtgctgcgccgtagcaactggtacaccgactccacgttgttgctgttcttgtcgtgccaagaacaaccttgaacctgcaagcaatcgaagaacaagcaagaaacaagttgacaaggaaacagctcacggcacttgtcaaatgatgaaacttaaacaaaccaaaatggggttctaaatacaagtatccgggtggtctagccgacacacgcgagtacaaggaagtagctgcagctaaacttacatcaaaacaaaacccaaagtgcaaaatggtggctgctaggagtgtatataggtggaggaatgaccaggagaggaggtgggagcaaaccctaggttttgtggacccctaatgggctgtaatgatacaaggcccaagcccaagtttctgatgtaaagaactattttcgtcattctgagtagcctgggtcaaagttgatggtgaggccacacatagctgacagtagacgacgagatctttccaacaagtactcatttgccccgtttgccctccggagtgaagagcattgacttcatcaaatcagcgctgctagtgctgcttgcgatttggttcctctcccatattcctaacaacaagtagatcacaacaaccatttagtagcacctaattctgagaagaacttgtatgattagctaggaatgactttacctgataattaagttcacgagctcgagctctagtcattggtccttgctgtgcaataggcgtggttgtatcgttggaagggatgtcctcatcagtgcctaatcccatcatatgctcccgccaaaacggtgtttatgtgcttagttattttatgaaaaaaaataaaattatgcgctagagttaggatcgttttttacggatcctttagtcatatgactttgtcattaacatataacctaataaattctgaactaatatggagaaactcaatccgatggttttgtgcattttcagtaatggaatccgaagaaattgagcgagcatagaagattacgatttaatacaatttaccgtcgcatcgacctgtttcatgtgaaaggatgagcgtgttatcttgcaataaacacatcattataaacaaaaaatggcgccgagaactcctgccccgtggttggcacttggcacttggcaagaaagaaaggaacacgaaccaagagagaggccaagaaaggaacacgaacacagtgccggggagctcggttgccgaaggtaatggcgtcggttcgccggagatgaagaggcgatgattcaagg

SEQ ID NO: 32685 - DNA, 1501 bp, Oryza sativa
gtgtatatagctaccaacatacattttttcctttttttttttgaaataaagtttatccctgccttgccttgctcttcatcctatgcttagcttgatgcttctgcttcaatctttaatttgttgttagctcttttttcttttatttttttggtgagattgtgatgcaaggaagggcttattacggggtctatctttttccttgtcatcatttccttcatttgcttttttctaccctcttcttgagggtacataaatattggtcgttgggtgtgattgagtacaagataatgaaacctgagtatgccggtattaaaaccttgttagtgggtgcatttttaagtttagaaaaaagagtcacttaggatatttctgcacatcagcttgccaccccagcaaaatgataagtgcgtaaataacctcctaagatcttcctacatgcgtaaaattatgcatatctttgaaccatgcaaatcttcatacacatcaatattgtcgaatcacctatcccgttggattaacaaactactactcatcatgtcagattcaacggcttactgatccacaggctatagtggtgtgtttggcactacttgtttgtaactcattctcaaaacgaggtagtagctcattagcgcataattaattatatatatatgattaattaagtaaatataaaagaattgaaaaatgtagtaatacgatcttttaaaacaactttaatttagaaaaaatttcaagttcaggaagtatgcacatggaaaacaatataacagaggtcagcaaagtgtcctgaacacaccctaaccagaggtttggaaagcactactctttaacatcctccaattctaacaacacatgatttgttgttgaaaaaagtctttctgactctcatggcttaataattgagtttatctgtagctagcacattcgacaatatttaggagaaaaactttttcactttaattacatgtgtaactagggtgtagatttgttttgaacgtaaaacccacacttgcccagtggtggagagggctcgccaaagaggcagagcttgcgcgattgaatcccacgctgtcgattttattcccaatctccacccgcacgaattttatacatagcccaaactttaagtaccttcgcactggtaccttctatcttaatccgttggatttagagcaatcaatggctctaatatatcacatgcactgtagaaagtctttaatttttttaaacaaagtttatccttgccttgctcttcattctgcgcttagcttgatggttttgtttcaatctttaattgttggcttttcttttctttttttttgcgtgattgcgaggcaaggaagggattattgagggatctttatcattattttcttcatttgttttcttcttgcctcttcttttcctactctatgggcattcagctatgcatcctagtttacatcctccctcagttatcaaaacgagatcaattttcatttagtgactaacgtggcat

SEQ ID NO: 32686 - DNA, 1501 bp, Oryza sativa
attgatgggagtaactggcttcggatatcaaaataaactttgcttcgcgtgggatttctaattcaattgaggaacccaacaatggggatccaccaatcgaggataccaagaaaaatactgcccttttccttcttaggctctatatccataaagatctcaaatatgagtatatgttggagacgagcccactcaacttatggaaagctctcaaagggtaaggcaccacaacctcgtggcaacagcaacaagcattccaataggtctggatctaactataatgttgcttaagattgtcgtatcccaaaacaccttgttctcctgtatcagaaatctttcaaggagaaaaagtcttctgaggaaccaagatatgaagcacatttcaatcttacaaatgaagcaagacctgaggttggaagttctcagtaggctcctattaaaccagagaacaatctcgatcttctcctagaggatattgctccactttctgcgatggacggcatgctcatcgaatattactcaatgtacccacttgcagatttactgtaatctcagtgtgtcccacttggagatgaaactactttagtctaagtgtgtgtgagacaatatattgatatcctatagtttgtcaaatattagttgaaataataagtagataaatacaaactcccttaagttgcaagtttgtaagatttactagtcattagagtttgtactattaaatctatgtaaacgtcatactatgtatttgatgttttaaattattgtacgtatgtatatatattaaataaagaattcttcactaagcaagtattctttcactatagatgtctaaggatattgctccgattggagatgaattatgtcttgtggacagtggtaccacaaattctatatacttagggagatcaaatactttcaaactcttaaaaagagagaaggcaaagttttgaccatcgctgaacgcgatactgtgatagttggctctggacgagcaactattacactcctaatgggtacaccaattacaatcgaggatgccttactgtatcctgattcaacccgtaccctactaaattatagagatatccatcaaaatgggttccacattgaaacccatatgtataaccgagaagaatttcttctcttaactaaacaaaatggatatggcaaacgcatttgcgagaaaattccatcttgcacatcgggattgtactatacgtacattaagcccgttgccatgttgcgtataaagtaatttttacaaaaatgttgatgcattccacacttggaatgatcgacttgggcaccccgatatcgggatgatgagaaaaattattggcaactctattagtcatcatttgatcactggaaaatttcccaatcctccataggattttgcattatctagatatatgccgttgatcttacatcattggtaatacacaagatattaatgaagcacgtcatcatttaaagacagaatttgagatgaagtattggg

SEQ ID NO: 32687 - DNA, 1501 bp, Oryza sativa
ttttgagaataaatttcctcaagatcctactgatttagtgtatatggcttgtaatttggtggattcctagacttgtctacagaaacaagaagcaagtcgaagaagtttgcagctgggaaccatggtactaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagctttcatttatgtaattagttttgtaagtagtctatatttaatactctaaattagtgtctaaagacagggactaaagttaaaacaccacctaagacaggtggcaagtgaagtattcaattcaagtcatggctggcgaggaggcatcagaagaattggaccagcttagtctctccctggcagtttgatcttgtttgatactccttggaatgtctgtttaatccctagtactctgtatctaggatcgtcatcttggttaggcctgtaatggttaggctgatggtcttctgttcctgtcccactcagtggtcaggtttgtcgttagttatctgttttttactacttctcaagacttgttgtaatgactatcatttctacaaagagaaatgggggcgccatcgccctagttctaaaaaaaaaatctaatattaaactaaactccatatcaatttccaccacctctaccaaacaatatattgggactaaaaatcaaattcccattttaatctcactatccattctctcgtctaaactcccagtccccttccctccagttgccagagtatgagagaggaaatgggagtttagaatattgagcattttaatctctgctccctcagtttcacaatgtaagtcattctagcatttcccacattcatattgatgctaatgaagtcttcattagcatcaatatgaatgtgggaaatgctagaatgacttacactgtgaaacagaggaagtagtttggttggagggcttgggaatttcgaagggattgggattgggaattaatccgtccaactccccaccatcctaccttgttaattcacgagacttggtgagaattaaacacgagaagtctaaaacacccctcaacaatacccctgcaacctccaccgtccgctggtgcgagaaggcacaagatgcgcaaaacattcccattcaccgggtcgagaaggactgaaatgtgcgaaaaatcccctgccactagcacgaggagtaaaacgtgcacaaaatcccttgccactcgcacgagaagaagtaaacgcgcgcaaaatccccatctcaatagcacttctctcgccctctccgtcgggtggccatcatgagagggaataaatcctgcgaaatatcaccatct

SEQ ID NO: 32688 - DNA, 1501 bp, Oryza sativa
tagttctattttctattttatttttattcattgtgccccaatgtatatatcattttgtgccacttttgaacatgttcacgtcattattttagtgtgatctgctgaataaaaagttgttttccgatttgctaatttctttctaaagatatttgtcttaatactgtggcactaaaattgatgattttaactatcttttctctgacaactacctttgatgtgttcaaccctactccaaagtgccaactaatgcaaacatatatggtgttaaggcctggtttagttcccaactttttcttctaacttccaacttttccatcacatcaaaactttcctacacatacaaactttcaacttttccatcacattgttcaaatttcaatcaaacttctaattttggcgtgaactaaacataccctaagtgaaaaggttggtgtggaccttgcccattgtgaaactttggtcaaaatacatggtgcaatgtgaaatttactccaattaaattgatgtgcgtcaatttcaattttagatttgctcctcctttgatcatgtatgtttgttacttccctgcagcattgcttgattgggaagctgaatcacctacaagtcttccctggtctatagtatacaattttggataaccgactgccaacttttagttcatctaattttagtttccaagatttatcttgtcaaaaaaatgaatctcagtcatgtaatatttatcataattttagtttttcccgtgacaatgcacaagcattttgagttaattctaatgtctaaaattggatttcataaataaaggttgtttacttcttacatgaaactttttatttaacaattgagatataaaattatgtttcatgtatgtgggaatgtattctgcgtttgtattgattttgaacttcaactctatcttttacattatggcaatattaattaactggacaatcaacttaaaattcttaggcttctcatccattatcgaatcttgagaaatcatatccctcatccaaaattgagagttgtcaacatgtttatgcacaaagttgagcgagtttgttattttgagttaggatatatcatttgaacatttaactcttttggattttatttaaacggtgcccctcttttcaaccgaacccaaatttcccttttttttataaaaaaaaatactcagcacgtgataggagggttgtgtttttacccttttttttttcccctatacgcgtctcacccagtcgcccgaccggcctcctctcctggccacggcgacgcctcctcccccggccacgccgcgaataccttgggtctctgcaatagtccaataccgatctgcggcagctactctgctcgtggaggagagccgccgccggaagccggaaggccgggtagcgccatggtgagatcccgagaaccctaatcctctccgatgattggattcgatggatctggcgatctaattcgtgtttctttttcctttttttttggtggggggcgg

SEQ ID NO: 32689 - DNA, 1501 bp, Oryza sativa
gggcacgggcgctggcggcgggcgcggcgagaggagggggatgacaggtgggtcccacccgtcagcgagagtggcgggcgggcccgcctgtcagcggcgcgcgcgcgcggggagccgatgggccgcgggagaggagagagagggagggagggaatgggccgagccggcccaagagggaaagggggggggaaacagacttcttttagggttttctttttataaaacctttttaactttgtttatttcttttcaattattatttgtgctctgaaaattccactaaaatttatttaagcattttaggcttttaggaaatatacaaaaatcctccaagccccatttgacttttatctttgcacattttaattgttggaggctttcacattaattttaattattctttgcacaatttcgaggatgaattttagagtcgatttgggtcgcgacacttcttcattccagtactggctgcttccctccgcgattgcatcgtacaatatctgttcctcatcgcggtcagccatctgttcatacaagaaacatctgctaagtcacgagacatttatgttttaacaatctaagtcatgtatgctaagtgtaaatgtcgtacattacaaccatacacaaccttacgtgctaagtctaattacaaatcgtgatataagctaagtctaggtgacgtatattacacaaccctagctagtaaataattacatactaagtctaattacaaataaagtaatcttatattaaaactcaaataatattacatgctaagactaaaatagtcatctatgctaagtgtttcatgcgtatatgctaagtctaattaatactacaatagtcaattgctacttgtcgcactaattccgttgtcaataattatacatactaagtctaattacaaataaagtaatcttatattaaaactcaaataatattacatgctaagactaaaatagtcatctatgctaagtgtttcgtgcgtatatgctaagtctaattaatactacaatagtcaattgctacttgtcgcactaattccgttgtcaataattatacatactaagtctaattacaaataaagtaatcttatattaaaactcaaataatattacatgctaagactaaaatagtcatgtctgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattagaacactacacaatcttatatgataagtctaattacaggtctaataatcttaattaattgcattacaaatataacaatcatttatattattacgtcacttgcctgcgccaattccttctagggctagctcttccactcaggcttgacggacgactccgacaacacgtcttttctgcaagatacaaaaagatgtattaggataaatgcgaagt

SEQ ID NO: 32690 - DNA, 1501 bp, Oryza sativa
gatctacggctcgtcctagggtcaaaggaggctctgataccaacttgtcacgaccggaaatcacccaacaggcgttcctgacgtgcgtgtattattccttgtcccaggaggcaaggtacaccaaaagttgatacaaatcagagtttaacaagcggaagcgtatataaaattattacatgggcagcgaaggcccagcacacacaaagacaacgaaaaacagcggaagactagggcgacgaccacaggcgcttgacggcaggcacgagctagacaccaaagccttcatcttcaaggagctcctcatctgggcttgggaaaattaagcaagactgagtacaaccaccgtactcaacaagacacacccacaaatgcagaataaatgcaagggagtacaaaggaataataacatagaggggttagggttgcagtaaacagcatttaaagacatttagttgctcaaggccattttgtaaacacgatcctagaactaaacaatattattaatcaaggccgtgaacccacacgaacctgccttaacccaaggcctatgatgattcagaccgaactggcaacccgaccctgggtcccagctcgtcctaagccaacccaggccaaccattccacattttagttgttgagcaaaattttaagaattataacactgacttgggtacattgctcggcttgcccatatccgagggctcggctattcgaatagatttactctgatcagaggtgtacatctttacccacaagacacgtcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctctgccgtatgacatctcgactaccgggccgcagcccgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaattcccaaagtctaaagttataaaaccacctaatgttgactaattaatcagcgaagcatctacctaaattcatactagtggacccatgaatagagtacccactagttgaggttttgtttcatctagggtgaacaaggtaataataataacaataacaataataatatggtcataacaaaggtaaataggcatggctaaataaaacagtgataacgcggg

SEQ ID NO: 32691 - DNA, 1501 bp, Oryza sativa
catgcccgacgccaccttcatgttgtgagagattatttattagtaatcaacatacataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggcttccactgcatctgttagtcgttgcgcagcctctcgtatctgaacgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgtttccttcctcgttcaagtactggtttggatcctcgttcccctcttcttgtcacgaccggaaatcacccaacaggcgttcctgacgtgcgtgtattattccttgtccca

SEQ ID NO: 32692 - DNA, 1501 bp, Oryza sativa
gaggaatacccgtactgagctgtcaccatcagcggcccacctcgacatgttcgcagcatataaccccaaataacgatatccagcaatctaaacaccacgcttaaattaccaaatactatcctaatatcatcgtcatgacatagagaaatcgtatacatgatcattatgctcacaccattgcatttcccagataagctagcatcataattaatataatttggatatataataaagttggtattcatatactcggaaagtaatacaataccagagtagtataaagaagaatattctaatatatcaatagtaaaatcaaagaaatactaatcaagaaaaaaaacatcaaagccggccgtccagcacttatgtgttgtccatagcctttaaactacgattttgttaaaaatactacacagaaataagtaggggacaaaaattataactattttcatcacctcctccttgttgtccctctccgtccttcaatgcagggtatagtattcactatgctatcgtaaatactgcaagggtatacatatggttgagttcaggtggcatcagtgaaaggctaatgtaggcaatgtatataaagggacatactaactaatagaatcatttgtgagtgtgccaatagtgtattaagtgttaaatgatgctataggctgatctttggggttacggctacgtcgatgtgggactgatgttccagggcattacataagaaagccttggcaattatagtcaactttatccgttagagagacattcatgtctatttttaatggtgttattgtattattcgattgaagtggtatgtttagactatttatacatagatgtggaaataagtggtgaacaccaagttaagcggtgtagatgatttttagtgtattaataatgtataatttattttagtggtattaatgttgttttattaaaaatgcacatagcttttgaagcaagaacaatagaggagtttatatatgaccacgacaaaaagatttttatttaaatatgagagatattcttattcttatcatatttagtagtatattccatctattttacggtaaatatttttctttttttattgctagataatttacatttccttaattacattgtatatagtgatgtatgatttattttatcattcttttttttaacaacaaatattctctggcttatatcccatctttatagtgtttgaaatacagccctacgatatatacttacgcgaatgcgcgggctaccttgttgatttaaaatgaactctctcttgctggtcacttcggcagtggccaggttaaattcattggccaagctattatggaatcaagacagcacgaagccgcagaggaggagctccaagcacgagcaggctcgactctcgagtgcacaggcggacaagctcgagcacgacgggcggcgtgacgggcgagctcgataggtcggtggacgagctcaacgaatcagagcaatctggaaggaggcgagtagg

SEQ ID NO: 32693 - DNA, 1501 bp, Oryza sativa
aaaatggcaatcatatctctcaaaatccaatttggatacacttattatcaagtttctttgcaaagaagggacataaaaacgtctggaagtaaaagtgtgaagccattcgcgagttctaggcgaagatctccaacagcctcaacttttgcttcaactccattggcaactctaatggatctttcacttctttgcgtagtcctcatggaacggaatccctttaaacaattacacacatgaatagttgctccagaataaatccaccatgtggatctagaataaccaatcataatgagattctttacaaatgtaataatgttctcacctttctttgccatgatcactgtcaggaagtcaagatgatctttcttggaatgtcttgtcttcttgcagtgtagacactgatcttgtctcaactgtaaactgttgtttctgaggcagatgctgaggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatattgctcatcctaagaatgtggtcttttacaccacctccatggtacctctctgtaacaagctgctttatcagctgtgtcgcataaaactttgaagaaccactaaactggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccacctaagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcatataaattgtaacaaaactctgttatttactctctgtaaaattctcccgttggt

SEQ ID NO: 32694 - DNA, 1501 bp, Oryza sativa
ggccaggctggcgcattagccataatgaatacacctaacagatctggcttaataaaaacaaacttcataggtttgactagacaatttataatagttcgagggttttagagatgcattttcccttcaatttagctatctagttagcctccaaacttcttttattttatacttctaaatgtttatgtttcagtatgtcttgcattgttttggtgatgacgattgtgtcaagatacttcgacggtgcaaagatgcaatacctactagagatgctggaggaaaggtgataatcataaacatagtggttggatcaggctcgcagagggacatcttctgtaacagccctaaaatttgacaactttttaaaaccgatttagtttgctttgatcttctaaaaaaataaccgtcaagttagtagttcatttaaaatactattttccatgtttgttttcgatgtttcttttctcgtttaattttgtcgcaaagtgcatatcattcctcaaataattcctttgaataagatttaaatctatcccgaatgtcggaccatctaaattccacatcaattcaaatcctaactattttaatcttccccatattttcttcttttctctacatggctaggccaagctaggctgagccagcccgatgcaagccgcgctcgagctgcctcgtgccaaccctgtgccgcctcgcgtcgtgctcgcgcccagctcgtgccgcccctcgcacgccacacgcccgcacgagctctcacgaggatgaacgacgaacgaatgccgccgcgacacctccagcttccagcctccgtatttccttcgtccctccactagaacgctcaagaccggaggcaaaagaagcgcaatttcaacctctttcacctcctcaaatccgcccctactcccgttaactcaatcgtcgtcaccggaggaaaaatccccgaagccctaataccggcgtcattgattgagctccgaaactcgtcgcatacatcgccgatcctctgaaattgaaggtaaaatcggattccccatgccgagtactccctttcccctctctttacccatccaatctatcgtcggaacatcgccggcaccgcctctcggcgtcgcctctctgttcggccgccgccagccgcatggtgcgccaccgctccagggcccgctagctttggccgtcaccaccctgggactcctctcgcctcattgaacctcaccaggccgcctcccgaaccggagttcgccggagttgccgccaccatggccgcctccgcctcctgttactgcccgccgccgccagcctcaccgccagcgcttttctcgcagccgaccacaaaaacggaatcgcctcgagccctagatcacaaaaccggcgcccccttgtccaaaaccggcctcctctgccgccggcaatgtgggattctggccagttcctgtgcagaacgagaagaacagcaaatccaattttcctattgaaaaataaatcagaaaaatcctttttctta

SEQ ID NO: 32695 - DNA, 212 bp, Oryza sativa
cgtagcgttgtcctctccggccatattcccactacagttctcctacccgtctgctatggtccacgcctgttctcatatcatacctccgtacgcaacggctgtgtgccactcctccttcaccctgcacgtccgctggggccacctgccgcgcggaagttcaccccatccccgtttaacgtaccagaaccattaacgttcgaccgaacgaaagc

SEQ ID NO: 32696 - DNA, 1501 bp, Oryza sativa
gatgaggagctccttgaagatgaaggctttggtgtctagctcgtgcctgccgtcaagcgcctgtggtcgtcgccctagtcttccgctgtttttcgttgtctttgtgtgtgctgggccttcgctgcccatgtaataattttatatacgcttccgcttgttaaactctgatttgtatcaacttttggtgtaccttgcctcctgggacaaggaataatacacgcacgtcaggaacgcctgttgggtgatttccggtcgtgacaagttggtatcagagcctcctttgaccctaggacgagccgtagatcccaagccttagcaatattttcaaaaataaaaatcctttattatttgtgaaaacccgctattctctctttgtcttgctgcttcatttatcgtcaaaatctgatcttttaaatgttgttttcccttttgtttttgtttgtagatggccggcagcgttacccgtcgtggtttgcacatgactggcttcgtcttggagctgcgaggcatgtgcgtggtcttggggtatccacatggagtggattaccaggccaggccgcttccggatcaggagggtgaggatgcagagcctcacgctggttgggaggtcactgcagtgatcctctccggctctcccgagcggacttcactggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgggacgccagctcggaggatgacgctaccgtcgtgcatctggcacgcatggtggaggcgtacgacgcggctcgtatcgacttccatcagatggtgcgtcgtggcatggtggagaacaacatgaagatcctggagctgcgtcaggagaacctgcagctcaagaaggacctcgacgcgttggaggcgcagctgcatcagctcaagatcgcccagggagagatctgccgccccaagcgtcgccgcgtctgccgcagccagaagatcaccgcccgcaagagcacctccaggcctgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcttgcgcgtgtgtttttcctcgtttgtcttcttgagtcgtgtggggcatggttacgccggtgtgtggtgtaactatgtcggagcctgtcttattttgtttgcctaagcaacttgaaccttaatgaaccaatttaatatcagtaataaatttaagaataatggtagtcgtgggtggttagttttaatcgtcagctctccttctctgtttgctggttctgtgtggggttttc

SEQ ID NO: 32697 - DNA, 1421 bp, Oryza sativa
tgacaggtctaatggcatttttgcaattttctagtggcagttttgcaataacgattcaaagtagtggtaaatttgcaattgccccaagaatttaagtttgttattaggtcgagcggcagataagaagtcgtcttgtattgcaatttatttgagctgcgagtcgtggtttcatgatagtcgtgttgaactcagtttttatctgcccgctgccgtgcggacaatgagcgcccaccaatccaccgtaactgataactcttcgtcccattttaaatacagccataaatttttatatctaactttggttatccgtcttatttaaaatttttctataattaatatttttattattttatatgataaaatatgaataatactttatgcatgacttatgtttgttaatttttttagaaagtttttaaataagataaataattaaagttagataggaaaacttatgactgcatttaaaatgggatggatgaaatacttaataattactaattacagcatcacaaacaacggcttccttacgtggcacacgtaagccgttgcttgctttcttcgacctcccaagtagggctggacggaaaactcgaagctcgttagctcgctcggctcgtagcaggctcggctcgactcgactcggctcattaggataacgagccgagccgagccaagattttagctcgttagtataacgagccgagccgagctaactcgcgagctgctcgcgagctgaacgagctgcgctttctggactgcaggccgcatccacctgtgtccgcaggccacaacccagtagcccaaaagcccccccagcccacacgcacatataggagaaaaaaaaaccctaagcctcttgcccttctcacttcctcagtcctcagagtctcacgcgcggccgcacaggcacctggccgccgcaagctcgcggctagggttactgcaacagcgccagcacgcgacgcggcgcgccggcgccgtgaccagcgcctctccgtccgtgagtccacgagcaggtcccgttccgatcctcactcggtcactcatctttcctttttcctctagatagatctacatttgctgattgccgaactgctactgaactgctgactactatgctccaggtccaagccctcagtcggggtcgcagccatggagggtgagaataatgcatcgccgcatcctccaagtttggagtcgaggagtaagcttcgtggacgacgaggaacaagcactcggtcttcatcgaatcccactgtgtccttggaagtggtggtatgttatctaatttaaaattgctagttcgtacagtatagacttgaatgttgatttaattattgctatccagagtgctgtccagattatttagttacttccatgtagatgtagataatgaatttatccccaaaaatgaagaa

SEQ ID NO: 32698 - DNA, 1501 bp, Oryza sativa
aacgggctttggcacattcccccatggtcgtcttcttcttcgctcatccaatccatgggcgcacgcacgacaacaatttttcaaccccaggggtagcaaccgagggagggtggggagggtcatcggggggcaaatccatgatggccgacgcggagatcgatcgatcacgccggcgcgcgcgccgtcgccctcgccggccggagatcgccgacgggtagcgttggtgagatgagatcgatcgattccatggtgatgcctcctccgccacgccgtcgcgttggtctgtgttcttcttcttcttcctcctcctcttgttgcttttcccctgtgtcctcctgtttgatgtggcgggaaagcttccagttcggagtttcaactgaagaggctcccccaattgctcttctcccaccgtctaatatatcgtgagattaggtcttggttattgtgggatctcgttttactattccgctgggttgtctgaatcgtttagatacctagatccatctcaggcctctcgactatactccatcggatttggtagtaattttcctaaccagattctagaagggaagtacactcctatatgtgctttttcacaacgagcaaaggttgcaaggtgtgctctcagcaacaacagttcgctttgaaattgggcctttttttgttgtcattcggaagtagaggggttaggtcctgaaagttacttgcacgaatcaaccccggccacacaccagtatactagtacatgacagtgacaaaacctgataaattcagagaagccagtaggttttcgattgccatggtggccatggccattgacgattgtgccgaacagagttggtgtttcttggtcaccaaaaaacacctgctgtttttttggatctgatcttgcaaccttcaaggagatcgccaagaaaaatcatgcttctgcggagtcttgtttaactctgctcttccatgcatcaggtttgttgtttcagtatttctgtctataaaaatttccatcgagtttctttcatcttgtcagaggagggtgactgattaacaatttaacatggcagcctggcaggatgagatttgagttccagggtgcatctttctgatgtgttcatcctttcttgaacagttcccccttcggtagttccttgcatggtagaaaataaaatctccaagggaaaataagagcaaacacatgagaggtaatcataatcatcatctatttgggtatctatgatccgtgttacatatatatatatgaattaatatatatgttaaggaccaacttgttgcatttacatttggtccttactatctgtatagcctttccctcttggctataagcagttatgtatgccatcaaaagaggaacaaagactagcacctgcagaattattgcagtgtgtgtgccagttctgttaatatatgttcagcagacacttgcaggagccttactaccggcggctatgaagaagctgctgaatgaagggcgacgagggaggcg

SEQ ID NO: 32699 - DNA, 1501 bp, Oryza sativa
cgacctgtttgagtactctttttttatcctcatgcaaaatttcaaatagccgtgagcttggtaaaaactttgcttgtataaatgcagtttactttgtgagtttgtggtggcactgcattgtgtattctggtgcagtttctgatagcaactatcacgttctctgtgattcttctcacaactaacccttactctagccattgacatatatgcaagtggttgaaacaaactattatggctaatcacactgtagtcagtagtactaactttcatgtgcctatcgattgttgaatgcaggaagaaactctggcatgaggagttgacatccagcattccagctagccagctctccggcccaatggaaggcattgtgactgaaatcttagttgtggcaagtggcagttctccttgcctcctcgggcgattggcaccttcatgttcagttgatatagaatacattctgaaatctgaactgaaagtctgttcccccttcatttttgagctgtaaaaaaaaatgtaagaataatctgaacccggacttccagagagctttgcagctgttgtagatctgactgcacgactgtggtatatattattgaggacacctttgtaagagtaatgctgcctccgtttcaggttatgagacgttttgacttgggtcaaagttaaacggtttaaagtttgactaagtttatagataaatataataatatttataatattaaattagtttaatcaaatcaataattgaatatatttttataataaatttgttttggattgaaaatgttactaatttttatacaaacttagttaaacataaagtagtttgactttaactaaagtcaaaaacatcttataatctgaaacagaggaagtagtttcaaagtaagttcacttttacacatgaattttatgtccagatcaataggccatatctcatgtggaattacttgtatagatatattttgcgttgcctttataaagagagcctaccttcgtttttcaggtttttacacaactaaatttagaggaactgtgctatttcaccatggcaattctacttcggttctaattataattcgttttaaatataaactatttttgtcaatttttttcgctcgccttttcacatccttccatggcttgcgttctttttccagttcagtgtaaatgtacaacgatagtcatttgagcgagtactctcctaaattttcttcacaagtttaaaaacgatttgtttcagtgctactagagggaggaagcccaaaatataaatatacccgccaactgatctagtagggtttttattaagagcccaatccaatccaataaaaatatacaaccaagttggccggccaacaaatttgtcaacacagctcactgaccccaaaaaaaaaaaatccttgttgacaagaaaaaaaactagtaatcgacagcaaccgcctcagtaaacagccgcggttgaacgcaaaatgtcaacgggctttggcacattccccca

SEQ ID NO: 32700 - DNA, 1501 bp, Oryza sativa
gtcttatactcctactaggcttcatggtgttcggctctgccactagaaggaagtgaatgtcgatagttgatagggttactgccataactactagagaaagagtcataagaataagatcacatgtgggtgggttagagaggaagagggtaagagagaagaatggatcacctctccctcacgctaccccgtccaacgtggccatcttgtggcggcaagaggattgacacttagaaaggaactcaccaaagccttcaacgcctacctcatggtgctgctgttgccttgaccaggttgctcgtgtctcctaacgggccacctgatcgcatgaccatcgccttcgtcctcccaccgcagtagcctcaccgccgcaccgccctagccatgccatgctcctaccacggtaggctcgctgccacaccactccatccaacgcgccggcctcgtcgcctccgcgccgtgctcgccagccacgggccttcgtgccgcatactctatgcgcctcgctagcctccctccgccagcaatgctcctccatgccggcacaacttcccccctagatcatcatcggggtcgtcaccgctggccagcaccccaagcctctgtcgccacacttgctagccctctaatgccaccgacaagcgaaccgtgcgccctcgggatggaatgagggcgaccggatttggctatggggacgctaggtacagccgcacaagtcgcctcctccacgccctcttccccaccgccagcgccctccaccaccactccctccagccttgacccagctgaaggagccacctttgctctgcaccctcttccccgctgccgcgtcgacccacgcaagtaggagttgccggatccagctgcacgagcggctgcctcggcaccctctttcccatctgtgtcaccttccaccgctgttcaaaactgcgtcgctacccctcaccggatctggctagggagagcacagatctggacggcgccgccacctcttctttttaggtcgccttagaaacccctgtctgaatagtgcccttgggggaagaacggagctctgcccgccgccgtccttgcagagccggccgagcgacacggacgtgtttctcttttgatgtactagtatttagaacgcagccttaatccaaaagaatcttagctacggagaaagctaatggtccggtgtcaagtgaataaaatctttcttcttttgtgattcttgcttcaacaactttgagtcaatcaaaatattttcaaaaaaagaaaacagctcctctcatattggtcatgctccaacggaaccattttcagatacattttgcccaacggtacaaaaatttgtttcgcttgtttggtttattattgatcagacaaccgtgatttttcatccacatacggcataattgcatactaatcccatcaaagataacgcccccaacggcccaacccatacccgacacctctgacggctccaagcttgcaagtcaacatctcctctaacctccga

SEQ ID NO: 32701 - DNA, 1501 bp, Oryza sativa
taaaagtaagaacaaataacaaacaaagataagattccagaattccaaatatttttggcaataaaatgatacgagtatgttgagcaagaaaatatacctcacttggttctccccataacctgcgcaaatggaagtcagtttctggcacaacaatagctggtgctagtctctctgcacccttggggttcgttgggacataaatctgtgaaagcaaaatctttgttacaatggaccttatacttttgggatgaacagcggcaaggaatacaagctattacttgcaaaccatcatttactcaagcagaggattttgtgacaactatcaaatgaatatacataattctaatggttcatggtactctacagctaaactaatagtgcagaaaagtaatataaagtaccttcaaagtagtgtttgaacttggttcagaactgttttcccttgcatttcgggcggaagtccaggcgtgattaagcaaagcttgtgttgtgagcccagagtttctgtcttctatgtatgatacaaagctagaaggaaagtgaagctggcataattcaaacagagataattaagttattctcttacggtcaattgacatgatgcagttctgttgacaaaaccattgttatacttacctttgttatgctgactgatgggaatgaaattccaatgaagaagcccaagagcactccaataattgttaccataacaatcctcatgctttcatttgttaatctaagtacactgcaaatatcaacatgtcagttgaacaaggagatgatattagttctggtgctgagggtgtagggggtcaaaataaaaagagaagtatacaaacctgcgaacaacagctgcaagttttcccatgctgtcgtgtacgaatgtaaccgcaggagatggaaatcagcaatgtgcaattgctactcattgtccagcgagttcataatgagggcagctttagcaggagtggtggtgtggcattagcatcaaatggctccgaaaaattgaaatcctagagtgcatgcattcagagggtcagaagtctttgaagaagttgtcttatgtgcataacttgtgcatgacatgatgataaagtaaagatcaaacagaacccttttcaactgcttctaaaaacagtgacgtctaatttaatactactagcaaaacaagagacaaggcgttttcctcaatttgcaagtgaaactcaagtgctctaagaaatggcatcctgtagaatgaagagagaacagctggatgaaaactctaaatttctttgatgttaagtgaagacacctgcctgcatctatttatgggaataaattacttactattactcctcctaagagatgccaggtaatacaatgatgtaagagtgcaaacaagttgaacactaattatgcttacggctgcagaaggtaggcagctccagattcaattcccaacattaaaaaaatacaatctattattatagaaaaataatattgaacataaagagcaaag

SEQ ID NO: 32702 - DNA, 1501 bp, Oryza sativa
ttcagtgcactccctccgtcaaaaataaaccaaactcgtacgatgaatctgatatgaactgaggtgttacatctcatatgaaattggtttattttgatacagaaagaaagagtaactgcgagtctgcaacttctttttccggccttccgggttcaccggaaaccgtctcgagcgacgagtgttgcaatgggaaacaatcctcctatactgaagttctcaacattccaggattttgtgattgtttattacattaattaacagaaaattcatccccctataaaggagtatttacttacaaatgcagagctctgtgtgacaattggcatatactacctctctgtttccaaatgtatggcatttttttcaataataaaatgtatgacattgattaattcaacatcaaacaaaaaagagatgaagggagtagaagaaaaatgtatgtgtaaattagtgaaagggacatacataaaagtgttctgttttagctttcctcctgctgatgcttttccattagacttggcttccaagtttccaaaaaggtttatctaaacgcgataaaaggcaaccataaaaggagaaaaatgaaacatttaaagtaagacacgagcaagactggtcacaaagaacactaggctaatcagcaacgaccctctgctagcttgactgttccttttttcctttcactaattagcagcacaagttgcaatgttagtttatctacatgccacatgcccccaatgatctctacaccattttttcttgttttctgatggagttccgtacaatgcagtgtgttttgttagtgatagctgacaaaagatgaaagtgccttgatcaggcttcagcatgtttgtgtaatccaaagtactaactccgtccagaaacaccgtagttttgcaccgtttatgtctaacatttagtcatccgtcttatttgaaagatttctatgattagtattttttttatttagatgataaaacatgaataatgctttatgtgtgactttttttttaaaaaaattaaataaggctgacggtgaatattgaacacggaaatccataactgcatttaaaataagacggaagtaaattaagcctctatattgaccccacatgtttgtgtaatctaaagttggacactctggataagagcaagatgcatgagagtaacctatcttaatacgtagtactaatttctagctgactcttcaaattgctggcaaatgcagatgattactgcattacactattatattactttcattaacacatggagatatttctctacatatatttaagacagcttccatgtgatgttggctcatgagaatgtgcagtggtgtctggtgtgtcttgtttaataatttctgaggaaaagtagaaagtaatatctcattattttgcctttttaccagccttttatttccactttgccttttgagatgcacactgaaatattcctgcagctaaaagggctaggcttcttgaagtcctgacagcca

SEQ ID NO: 32703 - DNA, 1501 bp, Oryza sativa
ctgtgacaatgtatggacattcatcttgactgaagcatcattcaagaacgaggagactacagaacaagttggcaaggtgaagattgtggcctgtgattccaaactactcagccaataaattgataactgcgaggtcagggtttgcctggtatttgttagtctcttctgctagacctggctccgcctgaagtgtactgtaccaccacattgtttgtttcataatcaatgtgtgtcaatacaatcgtatgtgctaccagagtatatcacagcagcaactgttttaatttgtatgcttatgtaattgttatgctactgctgtgttgataatgtgatataaatgactaaacgatgagtagtagaaattgtgcggagtcaccctcccccttcctcatttctgaaccctttggttctgtgtgactctttgtatgtaacatgaacaaatacctcctttcccgtcttttttttggatcctatgttaatggtacctttacattatgatgtgctctttgggcatgtttcatttcttgccaaaatcaaccctagcaacatttggcattaccgaaatgccaaaaaaattgctatggttggaagtggtaacaaatcaaacgtgctggatcttcagaaatgtttggtgctttgtgtttacctgcttttttaatatcaagattcagagtattgtttggattataacttgattaatgttctaaatgatactgtcctgctacccagttgaggtgttctcataatcttgcagaacttggatggatttttgttccccagttgcattattagagatgaaatgagtcagaccttggtcataagcatgcatgtgtggcagaattctctaaggacaaaagtttaatccttgtcagtacaaagtaagtactataattatctgcgacagtttgatggccaattgcaaggtgatcatcaggacgcagattaattaagggtgtagaactagaagagccaccggtcgaaacgtgtctgagaaagttggaaatatcttgccaactctttgctagtacaactagtaccaaggtactcttcctaccagtaacaacaatcctagagggcatgagcatgacaggccagcactgcagggaatcaatcagctcagcacagcactgcacagctgaggctgatcagcattcagcaatggcatgcacaagccaacatggaaaaagacaagcaagcagatggatctgccttcaagaaaggacgatgagagaaaaaaaacatgattttttactctagttgttttccttaatctctttttcccctaaaccccaggacagagagaaaaaggtggcctctaactccaagttaagctccagtcgaaaggtcttcacatagtaatgttttttcttaattaaacgcagattttacattagtttccgttagcatgtctttaagctactaaacaatatgtttcataaaaaactttctatatagaagtcgctataaaatacagatataataattaaaacttaactaatca

SEQ ID NO: 32704 - DNA, 1501 bp, Oryza sativa
ttaattgtgctagagaaaaaaaaaagataaattgcagtttgtactatatattcttgaaagtgttcatattatatcatcgtttaaccatttttttcatatacacaacatctaactttacatttcattttggactaccccattctatccatcttcaaggccggtgactctacaaccattccacgcactaactctttctgccttttcctttttccttttgaaagctagggaatcgtcagatccagcaaggaggagtccgatctagcttccctgctctttgtcgggccagctcctgccactccaagtccctgcaaacccgacagcccctaacctcaacggtgaccataacaatagtgtgcatgatgacgggggaggggaaaagacatctcgatgactagagggtgtggctatgcatgtaaaggcggagaggaggaacaatggtggtagctaatggaaaaaagagcggtggtggcggtgtgtgtggagcggcaactagtggttattggtggtctaaggagtttgccgttgatacaatccccaaccttgtttgttgcattttttttctctgagtactatcaatatatttgtccatcaataatcataaagaaatagctagttttaaagtagtaaaaaaattgagataaaggtggagtactcgagtagggatgaaaacgctttggaaaaagacgaaaaactcttttatcgtttccatttccatattttgttcgaaatcgaaaaccacggatacaaaaatggaatcaaatattatcgaatacgaaaatggagcgaatacggtaacagatatttatcggaatataaaagccccttaagctgaacttctaaaatccatgaagagatatagctcaatatctctctgaaacaataaatcgatatttataatttttatcaattaataataatataactaggtgtataatttattttcttggagaaaaagagctatatttatctataattgcaattataaatactaaatatttccgattccgagaaaaagaaaatctgaattcgtttcctgaaattttccaaaattggttttgggcggatagcagcatttccaagagtggcaaatattccctgtaaaataactcgagtaatggttctctttggcgtaaaataaagagaaatctggcgtctcgtcgtctcctccgctcctcctctccttgcgccaacaagccgactcgcgatctccatcgggcaagaagagcagagcagagcaggggaggggatcctgcaggtgaccatcctctttctttctttctttctttctctgaattcatctctctctctcccaccgggactctctacttttgtctggaatttgctcgcgttcgttcgttaaccctagcttctcttctcttctcttctagatctggaagaagctcttaatttcagagccttaacctctcttaatactacaagtaacaacagttttgttgtttgttccccccaccccaaaaagtttaggcgcacgcatcgccca

SEQ ID NO: 32705 - DNA, 604 bp, Oryza sativa
  unsure (1)..(604): unsure at all n locations
ggacgaatactggttacagtgtattgtaatgtgcgtatgtaactctgtgtgaattataggacgatcgtatatagttgttatgtctcatatattctttatcagaatttaatnnntttnnnnnnnnaagtgtggnnnattgattgtcantcgtacagtacntcatcaaagnttttttttttgtgacagaccagccatgttcaactttctctcaggcgattagtctaattgaataccaaacttaagctcaatagtctggaaattactcacaaataattaggtgaatgagttctctactaattgagcggtagtacactgaattgaatagggaacggggctgacatgcactacattgttaagtcaaacattggttctattactatatatatgcccctcatcagaagactggttttgagattttatttttgacctctaccttgggctgatctgctgtttattttgtttggcccatgtagattgtattaagctgcaattgaatatatgctgtttatgtttccacttttaatcctcttccagaactatatgtggttatttgatctgttccagcttattgtctctactcacccttctttatccttacattgca

SEQ ID NO: 32706 - DNA, 172 bp, Oryza sativa
caagcaatgtgtatttgaacgcttgccgccgaattttccgattaaccttaagtgtgggatccttcaaatattgaatcaaaggaattctccaatcttcttctgtttcctaggcacaaatgtacgaattcacaattaattcggcttccaaattgattgaaacttgccccccagc

SEQ ID NO: 32707 - DNA, 1501 bp, Oryza sativa
aacaatgatttcaccggtaggattgcaagggggtaactcctcctttttatattagtatagatgcagctcgactgtgatcaattaaaaaatcaaactaaattcacagataattatgataccataacactgataattacttcattgccatagtttcgtgccaatataagcaaatgcacaagcttgatttctttacatgcatgtagtacaaggtgagtgttaggtcaacacaagaagcatactttattttacgtacatcgtacggtatattttctattgcataatttgttgaaacaataaatacacaacaaataatggaattacacgtgcaagtttgatgtggattagcaagttttcattattggtcattgtggtttcctgatttttctttacacatacaccaaaattattttttgacttaaagtattgccatggctttgcctcgcaatatgattttcatttaaagcaaaatatttacaaaacacatacaccaacatttattaaccatcttgaaattttgatattaaagcatataatttttttggttttcataattcttcacatacatttattctcacattgcaaatcatcttgatattttatttcagtttgaaatctatcattaacaaaacatttagagtaggttgtatatattaagtttattttttatgttatctaggccatttgtggattctgtacacacatttgtacaatatttgccgatttttattagcatatgctcacagttttgagtgattggtattcaactatctttgctgttccccattttactgcatgattgcattaaaacacatgccatacattgttaaaaaaagatactcctatgtagttactcctacttttgaatgaatagtacactatttggttggtacaaaatatacttgtgagtgaaataccataacaagagctatgcccccaatctaatacgagagatagtaactcaaatcaagaagaaaaccattgtgtaaaaattgtgtgtaggtacttttgatatgaaatgtatttgcatggtaaagtaaaattatacaactctataaaagatactcccactatcataagaattttatttacagagaaacacaaaatagccatgtagcaaatgcgtgggattacgtctagtatctcaaaatattcagtgacaagtttattgcaatactccatattccatcatgttattttaatatagttgaggacctacctatacaaatttggagttttcaattaattcaatgctaagagcatctccagtagaggtcctaaacacaacccctatactaattttgagagttgagactaaaaaatcaggtccaacaaggcccctacagagcatctccagtagaggtcctaaacacagcccctatactaattttgagagttgagactaaaaaatcaggtccaacaaggtccctactaaagcccctaaagtaggaaagcctccaaattatccccttaggcccccagtccctggggctttctccgcagc

SEQ ID NO: 32708 - DNA, 1501 bp, Oryza sativa
gcataatagggtttcatttgcaaaagcagcatttagcaaacatttcagaatttaacaaaacagttaagtaatttaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgaaactaatcacgaaagacattgttcgacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcacataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattatcaggttttagttggcacattaattaattaaccaatcacgattgtccatcgtgaactatcaataagccatcatgaaataatagtgaatcattagttatcccataagtgtgctaaggtttctaagcagggctaagcaattatatctaatatctagttgaaccaatataaataaagctcaactagtcaaattattataacccaaggtatcaaggaataaagtaatcaagaacaaaagggctataacaaacaataggttaattccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagtacataaacaagcatgaacagtacatgtggatatttttaatgtgtagatctcaattttagaaaaatttagagacttgaaccaactaaatcggatctaagatgaattagttatgaattttttaaagatttaatcggattaaaacacttaaatcggttaaaattgaattatgacgcaataatgaattatttttgaaaaggaaaagagggtttattgcgtcagcggctagggttttggtggaccgagcgtacgggcggcggttcacgcgaacggacggccgagatcgatccaatccaaaacggacggccgagatcgaacggtccacgaccggctcacggcggacgaccccga

SEQ ID NO: 32709 - DNA, 1501 bp, Oryza sativa
cggcgtgggcggtttcggcggcggctgcggttgtcagaggttgaagacgggggcgacaggtgggccccacctgtcggtgacccggggagaggagggaggcggcttgggccggcccagctgagaggagggcgggcgtgcgggaggagtgggccgacggcccaacaaaggaaaaagggaaaaagaaaagaagaaaaaggaaaaaagatttttcctaggatttaaatattacacatgctcatttttaattagttaaaattatttccaaggctctgaaaattccattaaaaatcctattagcatattttgacacgtagaatccaagaaaaattccacacgccgattccgattattaactgtatttattaatttagggtttctctcttgcctttaaacaaataatttcttaaaacaatttatcaattgaatttttgctaggaaggaaaacttcagggcgtgacacgcgcgctgtggggcaagtgtcattggggaaagccgcgacgacctagagagggatggaacctagaccacgtcctggtggggcttccttggggaaagtggcggcgccatacgtcgggaagtggcaccatctggataaacctggacgtcgtcgccatcttcggtccacatctccaccgacaagtccgagctctccgccggctctccaccttcaaacagcaacaaattgacccgcaccactgggacaatagcccatggccatgtccggtcgtgcacgaagccactccggagcttcatgtcggcgacgtcagacggctcatgggaggtgcgtgaggaggagaggaggcgatgcatcgacggaggagaagaggcgatgcgttcgtccccactcacgagaccgagtcaaagggcacggttttgagggtacccaggtcatttcgccttagctcgtatcgctttggctatgtgggcttggtcacgtccactgtgggctgtgtatccccatgtgtggctatagataggtttggatcttgtttgaggccatattgcattgtggatcctgagacttttaaaggacttaaatctatttggtcctccggggctgaataaatggatgacacattgcttttgcccttacaatcctcttgtcaaagaagcggtaagaggaggggtctcctaccttttcaaattaaccttttcagactggggtaagggtctgtttgggggaggtgtttgggggaggtttagattctgagaaacagctgtttggtagccagcttccgagaatctggaaaagctctaaaacccagcttctctagcttctggcttcttagttcattttttagaatctgtaactacatattctcagaagctatggactgcttgaggcagcttctagcagaagcggcttttggaaaaagctgcagcggggacaaactctcccaaacaggctctaaagtggggaatctggggattctgggatccaaccggtgcaaaaataagagaagaggaggatatacccaacgagggagaggttgaggagaga

SEQ ID NO: 32710 - DNA, 1501 bp, Oryza sativa
taatattttgaaaaggtcactttttttttattttgaccaacggttgtcaaattataagtatatttagtgcatagaagttataccaatagattcatccttctaagagcttttataaaacattattagttttataagtattgtaaatatattttataataaaacacatcatataattttctcaaaagacttcttcaaataatatacaccctataattttttgagggagttctttatagtatctgatgcacataacacaagaatggagaaatgcaccgtttagccttgcagtagatttggaccagtgtgtacaagtgcctagggggtttctcctgtcagcttcttattatatttgatgagcaaattcagaatccgaattttgctgtgcggtggatctcaaacgcttatagtttcatatgcagaatcatgatatctatgctcagctatcaggtaatagcaaggttcccaacgctaagagcttgccatccagatcagttggtagggccagaggaaggggtgagacaagatttcagcccaaaggttctagtacagaagaaaattcaaaggagcgagagcacagtattcaagaaatactgaaggctttctatattcgatttgttcgcctcaatggaattcttttcacaaggacaaggtacttcgtaaaacacttctgtgactcatcttattctctctttctttgtctcctaaaatgtcttgcttttttcctctaatagcttggaaacatttggggagttgtctgctacagttatcagcgatttgcaaattcttctttcatctggtccttacgaggagcttaattttggtgttgaggctgctgaaaacgcgctttctgttgttaagcttattgctatccttatattcacagtgcacaatgcaaacaaagacgcagataatcaatcatatgctgaaattgtgcaacgcagagttcttcttcaaaatgcatttgctgcagcctttgaatttgttggataccttctcaaaagatgcgcagagcttcatgatgttgcatcaagtatctacttgccagctattttggtcttcattgaatggctggcgtgccatccagattttgtggctagttctgagatggatgaaaagcaagccgatgcaagatctttcttctggagtcaatgcgtgccatttatgaataagctcattttgactggtctcgcacatgtcgatggtgataatgatgaaacttgcttttttgacatgggcacatatgaggagggtgaaactgggaacaggcttgcgttgtgggaggatgttgagttaagagggttttcgcctttggtacctgctcaaggtatcttggacttctccaccaagcaaggttttggaagtgatggaggtaccaaggagaaaaaagcacgtgtagaaaggattcttgctgcagggaaggcgctgttaaatttcgttcaaattgatcagctgcgaatatattttgatgcatcctcaaaaaagttccttatggcttcagaac

SEQ ID NO: 32711 - DNA, 1501 bp, Oryza sativa
tcgtaaaacacttctgtgactcatcttattctctctttctttgtctcctaaaatgtcttgcttttttcctctaatagcttggaaacatttggggagttgtctgctacagttatcagcgatttgcaaattcttctttcatctggtccttacgaggagcttaattttggtgttgaggctgctgaaaacgcgctttctgttgttaagcttattgctatccttatattcacagtgcacaatgcaaacaaagacgcagataatcaatcatatgctgaaattgtgcaacgcagagttcttcttcaaaatgcatttgctgcagcctttgaatttgttggataccttctcaaaagatgcgcagagcttcatgatgttgcatcaagtatctacttgccagctattttggtcttcattgaatggctggcgtgccatccagattttgtggctagttctgagatggatgaaaagcaagccgatgcaagatctttcttctggagtcaatgcgtgccatttatgaataagctcattttgactggtctcgcacatgtcgatggtgataatgatgaaacttgcttttttgacatgggcacatatgaggagggtgaaactgggaacaggcttgcgttgtgggaggatgttgagttaagagggttttcgcctttggtacctgctcaaggtatcttggacttctccaccaagcaaggttttggaagtgatggaggtaccaaggagaaaaaagcacgtgtagaaaggattcttgctgcagggaaggcgctgttaaatttcgttcaaattgatcagctgcgaatatattttgatgcatcctcaaaaaagttccttatggcttcagaacctcctcctcctgcttcttctgttcctcttgttgtatcttccaatgcgcagacaacaaatcacatacaacaggaacctgaagtctccagtaaaattggttctgtcgcagaagatctaggtgtgcttcagtcaaaggcacaactctttcttgatggagatgatgatgaagaaatagttttcaagcctccagtttctgaaaagcttccgagagttacttcagaacagactagtaatgagttattacagccagtggtggtgtctgatgtcaattggtcaaatgatggtgcaccaccaccaatgacatttcagagcaatggaccggttctgactcccaatgtttatgttcaatctctcccaatctcttctcttggttgggcagccaatgctgggcaacatgtgattcttgatgttggtgcaaggtcaacatctgatatttttgagtctctgaaagcacctgatcataactgggtaagcactggtgcaccacttgttggctcactggatacagtccctatggcgagcttttccaatataatttcggatcagcgtacacctccatcgtcactcggttgtttcagtaacccagataatacagccatactccctgggcaagattcattcttattgagtgcattaaacaatgttaacataggtg

SEQ ID NO: 32712 - DNA, 1501 bp, Oryza sativa
tttgatttgtatttttttataaattactatggctcatcatcccttcccttaagtactaaaatctggagaagaaatgtaggacttagaaatatgatgattgatattaaatttagagtaaaatacagcagcggtccttaaacttgtcgtgaggtttcacttaggtccacgaacttgtaaaacgtacgtcgagatccctaaacttggtttattgtatcatcccggtccaaagtctcgtttgaccgtggtcttaccaacgtggcacgccacgtggacgatgacatggaattttttttctcccttcttctttttctctcccttcttctccttttttttctcccttcttcattttcttttctctccggcggccgctgcaccacgagctccacagccgggcctccatctccttttccatcagcctctactccactcgccgagccaccgtgccggaggcaagcacgcgacaggagggaggacagtggcgctgacgggagggaggggacggcggcgactcggggaggaggatggcggcgctgacgggagggagggggacggcggcgcatagatgtcctcctcgatctcctccggggtgagtgccaccaagaacggcgcgctttctagcgtcgggacgaggacggcacgggcaccgccgccgcccacaacatggagcggctgggcgccgccgtgtccactgtagcaggttccacggcctcgctgcaccgtccgcttgcggctgtggcagggcgagaagtggaggcggaggcagggccttgaactcgggctcggagtccatctctgcaggtaggctctcgggctttgtcgtcgtcagcggcagcggggggtggggggctaggctggggcacgcggagacggttggcggcgtctcgtaggtgacccatgagcttcacccaaagctcctcgatcccaccatcgaagggagttggcggcggcggctgcccccacggctcgaggtggtgcgtcgacgtcgcggcgggcggcttcgcccgcggatccgccgtcgccgctatggccagcttatcgtcagcagctacggtggcacggcgcggcgcggagaggcggcggtggcggcggccgagtcagcgaggaggagacgagcggcagaggagaggaggttttgaggccacagcgggtccaaaaaaaaagggagaagagaaaaattccatgtcatcgtccacgtggcgtgccacgtaggcaagaccacggtcaaacgcggctttggaccgggatgatacaataaactaagtttagagacctcgatgtgcactttgcaagttcgtggacctaagtgaaacctcctgacaagtttaaggaccgctggtgcattttactcttaaatttatgttttttcctgaagtggcgaggctgtaagtagacacttcaatttatttctcaaatgtaacaaacattttttatatttgtctgaattaattgtatggaatttctaattatttgcaaataagaactaaaaaaagaagtttgttta

SEQ ID NO: 32713 - DNA, 1501 bp, Oryza sativa
tgggaagaacaatgccaatcctgatcggatcaagaggatcagatcttctgttagaagtttcctctcagaagcaactggtttctatcatgacttgatgctgaaaattcgggctacttatgggcttccgttgggctacttctctgagggtcctgatagttctgttgttcctgataaagatgggaagaaagtggttggggtgaaaaaaggcttgttgtcatgctatcgctgtttgatatatttaggagatcttacccgatacaaaggtctgtatggggatgtggattatgcaagtcgtgaatatgctgcagcctctatctactacaaggaagcagcttcgctgtgcccttcgaatggcaacccacatcatcaggtatgcagcatgtcgctgtagtaattttctgcaccattagtacaaaacttgttttgtgtgcttgaatggcgatggtactgatgaaaaggtttttgtgttcttgctcagcttgcaatactggcatcatatgctggagatgaggtaacagctatctataggtacttccgtagcttagctgtggataatcctttttctgcagcgagggaaaacttgattctcgcatttgacaaggtattatgctaccttcatgatactactttagtatgatccttgttttccagtattgtgattgggtgttgaagctatttttccttggtgaaccttgaaatgatactgcatgattttatctagctaggagatagtcgatcttgttggattccgttgttcaacagtttgtacacagaaaattcgtatctttactggtgtttagcctattattatccacttgtggaattcttatttagactagaaaaaatgcccgtgtgttgcaacgggtgaaggctattttagtcttatttttattgttatacggtttatcttgggtgaaaatcattgtgggaattcgcttgtatatatatatttttagaaaatcatgagttgtaattaggagtctgactctcgtctcaagttagcatgcgagtttttttaaaatgatttcttatacgactccttttgtatttccaaaagcgtcccaagttagcatgcgagattttttaaagagatttcttataagatgtcttttgtatccaaaagcgaacgaacttaaaaaccgactcaaacacagatctgtatttctaaaagtgaacgaacttaaaaaccgactcaaatacgaatgacctaccaaaatactgataaaaacatcttcaatttttataatcttatttagattccataagataagaaatgttctgcagtttaccaactgggtcaataaaaacgttcttacttatattattattgtacagctgttctttcattgattgcagcgtgtctttcatacttcctccctagaaaactatagagtgtactccctccgtggggtggaggaagtataatattttgaaaaggtcactttttttttattttgaccaacggttgtcaaattataagtatatttagtgcatagaagtt

SEQ ID NO: 32714 - DNA, 1501 bp, Oryza sativa
gggtcctgatagttctgttgttcctgataaagatgggaagaaagtggttggggtgaaaaaaggcttgttgtcatgctatcgctgtttgatatatttaggagatcttacccgatacaaaggtctgtatggggatgtggattatgcaagtcgtgaatatgctgcagcctctatctactacaaggaagcagcttcgctgtgcccttcgaatggcaacccacatcatcaggtatgcagcatgtcgctgtagtaattttctgcaccattagtacaaaacttgttttgtgtgcttgaatggcgatggtactgatgaaaaggtttttgtgttcttgctcagcttgcaatactggcatcatatgctggagatgaggtaacagctatctataggtacttccgtagcttagctgtggataatcctttttctgcagcgagggaaaacttgattctcgcatttgacaaggtattatgctaccttcatgatactactttagtatgatccttgttttccagtattgtgattgggtgttgaagctatttttccttggtgaaccttgaaatgatactgcatgattttatctagctaggagatagtcgatcttgttggattccgttgttcaacagtttgtacacagaaaattcgtatctttactggtgtttagcctattattatccacttgtggaattcttatttagactagaaaaaatgcccgtgtgttgcaacgggtgaaggctattttagtcttatttttattgttatacggtttatcttgggtgaaaatcattgtgggaattcgcttgtatatatatatttttagaaaatcatgagttgtaattaggagtctgactctcgtctcaagttagcatgcgagtttttttaaaatgatttcttatacgactccttttgtatttccaaaagcgtcccaagttagcatgcgagattttttaaagagatttcttataagatgtcttttgtatccaaaagcgaacgaacttaaaaaccgactcaaacacagatctgtatttctaaaagtgaacgaacttaaaaaccgactcaaatacgaatgacctaccaaaatactgataaaaacatcttcaatttttataatcttatttagattccataagataagaaatgttctgcagtttaccaactgggtcaataaaaacgttcttacttatattattattgtacagctgttctttcattgattgcagcgtgtctttcatacttcctccctagaaaactatagagtgtactccctccgtggggtggaggaagtataatattttgaaaaggtcactttttttttattttgaccaacggttgtcaaattataagtatatttagtgcatagaagttataccaatagattcatccttctaagagcttttataaaacattattagttttataagtattgtaaatatattttataataaaacacatcatataattttctcaaaagacttcttcaaataatatacaccctataattttttgagg

SEQ ID NO: 32715 - DNA, 1501 bp, Oryza sativa
ctgtcacggcctcttttcagtatgtcgtggtggcatgtcggcgcacggaaacgtgtcgtggggctgtgtcttgtgggtacagttgtacacctctgatcagagtaaaactattcgaatagtcgtgcccgcggttatgggcggtcgaccagatttaccgtaattagtctcacccctagttagctaatggaactggttagttcaggtggtggtttgggcctgtcttaacgtggtgtagcgttgagcagtgattggttaatattgattaattactgcaactgttttactgctttcaactactgcttttaaatgctagctttatgcaaaagaacctttagcctcccttggatatatcctgcatcatacctcctcttctggtatgacttgctgagtacagtgggtagtactcagtcttgctctctttttcccccacaccagagttgaagttcttctcagttggtgatgtctcgaagaggttggtttcgtcgctaccgtcaaggattgcctgtggaatggagtcgcccgctgcaggagtcaagtcttcaggcttatctcgtttttttcttttccactgcatttgtaatcttttatatttttgtaagacgtagatttgtatgtcaacaattgtcgtttgtgtaccctggctggtcctggacaggggtttaatgcacattcagcttagaaattctggttcgtgaatttttgggcgtgacaagttgttatcagagccgaccttgaccgtaggacaagccaactggaaaccctaagagccctctgaaaccttttcatctgcacatgccttttgcacttggatttgttttgggaaaattttggggtttgctcttttgattcgtgggaaaaatcttgatcgctatttcaattggatttatcgactaggaatagtatggtgttttagaaaaacattatttggaatttatttggcagtcagtcgggaatttgttaggtgatatgcactaagtcgtgtctaggttcgatgggcaattttatgtgtgtattatagctatgcatctattttgtgcattaatttatcgtttagtcagttgcattagtatctttgtctgggttcatgaaaaatgttccacgcataaaaatcatcatgctcggcgagttacttgagtcatttgttgctttatttaatttggttttgagcatgtgttggttcctatccttctgtcctctttagatgttagacctgttcctcgttcgcaagcgacgctccaagcttcagagtcgtcgcctttagccttatcatcttcttagttttgattgcttgctagtttctgtgtttaggtttgttgcttgtgggttagtcggcggtcgatatcaagtgccagtggtatggctgccttaattaggagttgtttgcttccttttcagttttttaatcaagattaagataattgcacttaaatttacaagaaagattagttgccgagccatctgttttattcctttctcttatttctacctatcctcgtccaga

SEQ ID NO: 32716 - DNA, 1501 bp, Oryza sativa
ataatagggttccatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatctgttactatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataagtgtaataatgtttctaagcagggctaagcaattatatctaatatctagttgaaccaatataaataaagctcaactagtcaaattataataacccaaggtatcaaggaataaggtaatcaagaacaaaagggccataacaatcaataggttaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaaagtgtaggtctcaattttagaaaaatttagagacttgaaccaactaaatcggagctaagatgaattagttatgaatttttaaagattaaatcggattaaaacacttaaatcggttaaaattgaattatgacgcaataataaattatttttgaaaaggaaaaggggatttattgcgtcagcgggctagggtttggtggaccgggcgcacgggcgacggttcacgcgaacggacggccgagattgatccgatccaaaacggacggccaagatcgatcggtctacgaccggctcacagcgaacggccccga

SEQ ID NO: 32717 - DNA, 1501 bp, Oryza sativa
ccaggtttgtagcagccaccatggtctacctgcaccaactactgagccaacggctattttggccgatgcgttgttcaatgtttggtataagtaaccgaggaggatcttgcctaatggaaattctttctttgattctaaggcttcggctacaaattgctagttggttgtagggccacaactggatccacagaagaggaacttttctagccacatgagcaagaaagctacatgctctcgaggggtaacagatccttggcccatatatgccgccatatagccagaccagccacctatgcttttggttctgaaatcaaactgatttttggtgttcatgctcatgggattagccgatgaagttacatctaaaccggtgatcatggtaatgtcgatcaaagttggagtcattggcccttggttgaacaagaaggcgttaatggtgttggaccaaaaataagaggcggctgccattaagggctcgtccttagctaagttgctatggttaggtcaagtgcttggccgattccaatctcatcccagtgaactttcttattagccgatacgcgctggtaccatgtgatccaacttttctcaggggtggttttctcaagagatggccaagacttgaaagtgtttttccagtggctcagttagggttggctagcctaaaggggatcctattggtttcaccaatgaaaaatcagtggagtcaagattgccgattggacccagaaaatagtggttttcatgcgacaagctgggaatcgcaattaggttggaaagatgctgcaaatccaaagcaaccggaaagaagaagagcaatgtgaggtaaggaaaatcgatctgctgttgagaaaggggatctagccgatggggacttacctcggcatactcagctgatggcgcagcaaacgggctggcggaggacgacatcgttgcgggcggagatctcgccaagggtgaagtcgcctggaaatcgctttgtgcattggaagaatcgccgttagagagaaggcagagtttcacttgagcggtgaaaacgggagtaatggtgtaagatttctctgcggcatcggtaaattgaaaccatgccattataattttgcaaagtttgagatatgccatcggtatctcaatgacatgcaggacccacatgagtcaatgacatgtgggtcaggatggcatatctcaaattttgcaaaattataatggcatggttccaattttccctagtatttaaagcgcttgaataacagtcggaaaacggtaaagtgcgaaacttgctcggagtcgatgttaagaaaatccgaaacattaccaaatattccggacttggggggcatgtgttaacgaccaaatttggtaatatcagcatcggaaaagaggattagatcgaagtggagccgatggcggagatcgattcgagaacagagcaagaatcggctggagcccagatcggctacgattagtatcggttaagtccaagtcagactgggttaagtga

SEQ ID NO: 32718 - DNA, 266 bp, Oryza sativa
tgcggcatcttttgtggtaattatcttctattccatgtatatcttgtgttcttgagtattaggatgccgtactattaagagggctaccacatgcatataattggtagaacactagtgctcaaaatcctttatttggactgttcctattttattcctgtcggactatccgatcctgataagactatccgatgctcagactatccgaaatttcttagaacttttccctctgtctttggtctgagtgttggctaaaaaatatcggacaa

SEQ ID NO: 32719 - DNA, 1501 bp, Oryza sativa
gatgagctccaatttgtttcctggcttgacacacgctacacaccctatctttctcaaaaagtacatttgttagaccaaggatgtgatcgtgctttagaagcttgtgaagattcctcataccaacatgggctagcctccgatgccaaagccaccccatgtcggacttagccactaagcatgtctcatgtttggctttagttgaggaaaaatccacaagataaagcatccccttaagaacacccttaaagactaccgaggagtcatcccttctaaatacggtcacatcaacatcggtaaaaagacaattgtagcccatggaacataattgagaaatggacaagagattatagtttagagattttaccaagaggacgttagaaatggaaagatcattggagattgcaatcttacccaatcccattacttttccctttccatcgtacccgaagagtatgttctcttgcaaagtgccatttggatcaagggaagaaaacattgattcttctctggtcatgtgatttgtgcatccactatcaatcacccaacttcttccaccggagagatattcctacaagagatcaatttctagttttaggtacccacactttcttgggtcatcttatgttagtgacaagtgccttaggaacccaaagaactctcttgatggaaacatttttgcccctaggcccaacatatttagcaaccacacgaccactagcattcttcctaagaacatatgatacatcaaaaggacaatgtgaagcatgaccattaggaaggatacttttggccttaacaaagatgctaagaccttggggcttcttgatcaacacactcttgtccacctttccttttggtggaggaacatacccaaggccttcatggttgaagttgtccctttgatagcctaggtatttctttagtaccttactacccatatggcacttaagcaagccattgtgaaggagtcccataagcttctcattttgcttttgcaaagcacttaaggaagtagagttagtagcacaagcatcaatatcaatatccttacacctagcacatggttcattgcttggaacaattttggaacaaggtgcctcgctagggagagagacactattctttaaggtttcgaacttctcttcaagagagagataagcttttgttgatgtaaaacatgaggcctgggagatctgcttaactctagtgcaggtccaaagctcgccttcgggtgtgttagcgtgccagttgatttgatcctgcaatcaacaagaaatagagacaaagaaaccgcggttaaacctataaatgatagacgatcggctaagtgccgatgacatatcatttatctttgagccgatgtcatatgtaaatcgatcggcggttataaatagataataaagtactaaacctactcgatcggctgtagatatcaacaatatataattttatatctatacttaaattgagtgattgggatagatcggtcgccatgtcgaga

SEQ ID NO: 32720 - DNA, 590 bp, Oryza sativa
ctataggactaaaggtatcttcatagtctataccatatctttgtttgaacccttttgctacaagtctagccttatatctgtctagactgccatcagctttcctcttaattttatatacccacttacaatctatcacatttaaacctctcttgggaggtactagatgccaagttttatttttcataacagcatgatattcactatccattgcctctttccaatgtttatcccctagagcctcatccaaagtttgtggttccccagaagatgtaaagcaactatatctaacagtaccatcagtataaattttatcctttctaatgccactttgtaacctggttttcggtctcattacctcagtagacacaccctgttgtgcggcctccatttgcacagatgatccaggtggatgggactgctgcacgtcctgctctgggcacgtgatgatgctgctgggctagcggggagagttgacggcaggcgacgtgccagcttctgactggcctcccatcggcgaacgcgtcggacgcgcaggagagcgctgctgctagtccccctggattccagatcccgagcctgctgtcccatca

SEQ ID NO: 32721 - DNA, 270 bp, Oryza sativa
ccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggatgtagactagccctcattgtaaaaagcatgtttcttttcttaggtagctggaggcccttgtggtgacccctgaccagataaaaaggaggcccaggcctagtaaaaaaaaaaggaggagagaaaagagaaaggggtt

SEQ ID NO: 32722 - DNA, 345 bp, Oryza sativa
ggggtcggggcgccccccccccggggcccaaacggaaacggcccgtcccctcggggagacagagggaggggtggccacgtcaccctcgggcccgacccccccgagggggtcaggccacgtgggtgaccgcggctacccaagcctctagtcacgataccaacggccccatgtcaccgacaggagcccccggcgttatgccagagcgatcgcccccctcgagggaagcgctcgggcgtgacgccactccttaggcccggtgacaggtggggccggtccctataggcgggcagaaacccagcggtcgcaaatcgcgcgcatcggcaagggaaaaccgaccgacaataa

SEQ ID NO: 32723 - DNA, 1501 bp, Oryza sativa
tatgtaattttagtgtatttacaatataagtctcaaaattacatatgtaagttcgaaaattacatatgtaagtcctaaaattacatataatgtaattaatatatagtcatcactcatcatgatgtatgtgagaaaataatcttcaatctcacggtaacacagttgggaggcctctgtgcagttgtgtggtatagcgcataggtatgcaaaccgactgtaatcaatggaattttatggcgccagagatttagcaaatccgtttaaaggataaaaatatcctcccttctaacacaattaaactttgaaaggtgggccacataaaaaattaaacgaatcggtcgtctcctcccgtgctcccgtatgcaacgacttcaaactttttaagagatgagatgagatttttttttaagagtttgtttagggctactattcaatacccatttttacttaaaacctcaataatctaggaattaggatcatgggcagtataggcactctgttggccacgctcttgtaaacatgattgcagttttttatttttcacaaaaagatcgcagtgtccttttcttgttagtaatgccaagttttgtttcctaaatgatttggtagctagtaaaaatatttctctgttattattgagttgcgtgtgcgtgcactactgtcgctttattatagggcattattctttttaggtgattagcataggagattagaatatgcctaagtagtaggttgctaccagtccctaaatattaagaaagggaaaagagaaagaatcgacctcgacatatatattttatgtttgtttcggaaacctcccccggataactcccgatcctaatcaccaagggtgacgcccccacctactgctgccggtcgctgcagcaattattctaagaggctgcaacttttttttttaaaacagaggctgcaactggggacgcatacactgtgcagagagatcaacccaatcatctatccaaatgcaggcttctaccactcgcccgttataagatacttcctccataaaagaaaaattaagattagatgcaacgttttatctagatttattatactcagatatgtctgtcggtgacatggggccgggggtatcgtgactagaggcttgggtagccgcggtcacccacgtggcccgaccccctcgggggggtcgggcccgagggtgacgtggccacccctccctctgtctccccgaggggtcaggccgctcccgtttcggccccgagggctggagcgccccgaccccctgtggttttggcgccacgtatgtgggttagatgagcacagcgggctcacctaaccgcatttatagcaggttggacgagcgcgccacgccgcatttaatgcggcgcagcgcacgcttatccggtccgtgaccggtcacggtgtgtgaccggtcacagaccggtcagatcgcgggttaggtggcaacaggcggcctgtcacacgcctcgccccgtcccgtcggaatgatgagagc

SEQ ID NO: 32724 - DNA, 1501 bp, Oryza sativa
gggtttatagaaaaatatatcaacataacattaaattagtttaactaaattcaccatgaaatatatcttaatattgtattgactttttattgtagatattggtataatttttataaaagtaattaaaatgagacaaatttaacttaggacaaaactaaaatcggaacgggtaaaggatagaactcgaaagaaagtgacttcttggtaaatgatttttttaagctttgaaccaagatggcgtgtgacaagagattctgaaaatgaatgttaaaagcataaacaatgtcctagttcgttttcaaaccaaatgactcccgcttctcgtcgggtctaatgatggcgaaggagcaggtttttattcgggcatccacgatgtaatgaagtagtggttaataagtattgaatgcatccctactaccagctattatacattgtggaggtggtaaagaactactaccagggtataagcttactaccaggtatactttatggtgggtcccatctatttttttaattgtggcaattggcatgactcatgtttaaataactttttagatgggtcccaccgtactatccactctacacactattaccacctgacatgggcccaccttactacctagttttgcaataaacattgatgatgccttagttaattcatggcaaaatgtggcatacaaaccagattataagggcatcctcaatgtatgtgggacttacaaaattaggttatagttgtttctatctctcacaatgtgtgagtaagatatggcgcacatgtaaagcaatggttggatagaaaagagagagggcgagagaggtaatagtttaatgtcttttatggcatagttgctatctcctctattatccacctccacaatgataaagtaaagggtcttacaacccatttttcatccatattgtggatgccctaaaggccatgtttcgttagacaaaattccctcaaataccaatatccatctttaacgaaacataaattttctcaaataccaatatccatctttatacttttttatgcgtataataagaggcatacacattagacaattaatatggcaagagaaatttattatattacacgaacgagactaccgatcgggcgctcgatccaggcgtggaaaaatcgggcgctgacgtcagcatatacgcatacgtgcaaaaccactttaaactattttttctcttaaattatttatccaaatcatgatctggttcaccattaaattcgttgcaattaaatcttcaaaacaagaccacacatggatatattccgatgaaaatttttttagcttattattgaattattttaaaatgttgcacgatgttccaccaagtatatcggaattgtttcattaagtagattgaaaatgtttcaatcgtttaaatcggtcattgtttcaccttatataaaaataatgtttcagcaagtagcgaaagaatgtttcagttcactgcaacatttgatccatacataatgaaa

SEQ ID NO: 32725 - DNA, 1501 bp, Oryza sativa
ttcaagtcaaaactcttgacaagatcctaaggacaacatgacttcccgcgtgttttcttgtcatgttggaacgaattctatctccagtcacagaatatgtgatgttttggacaacggcgtgatcactatgacactagctcaataaattgtactacatcgggtataaaccgcatcgtgtttcgttttgcactaggtttagcatatactttcactttacaccaggttatcttgaaataagtttcacttaagttcttaacaccaggatacatcatcaaacctataaaactatcatgaaatttcacagaatctgaaataaacattgtgaaacatggtatacattcaagaagtttcatatatttttcttcagttatagcttagtgaacatagatgttctaacccaacaaatcacatacacatgcattatattccctacgtgttctagagtacgataacatcgacttttaaatatacatttaaccatttatcttgttaaaaaaaatatgttattgccatttattttgttctgatttttttaatcattaaataatttaagcatgacttatgcttttaatatttgcaaaaaaatatgagacaaatggtagttcaaaaattaacgacattatccgtcaaaaaccagagggattatactaaatacaaagatatttagacagcattttggtgtacatgtttacgccatgaccgtgtgagtctagtgtttcgtgggttttatgcatcccattatacttttaaaatgtaataccattttatttttattctccataatttcctgaccgagagaaagagagaagaaaaaaaatgtgttgtttagatgtctgcacaatataccactatactacataaatgatcttttcatgccgacaaaaactaattttcacaggcgagtgagcactcgcctggagcgccaggtgtctgcaaaaatcggcattttgcatgcgggcaacacaattgcatgcataaaatcattttcgcggacagatgacctaagaaagccgcttgcaaagacccgatttttgcatgcgggcaaataaggatgcttgattgcaatgatttaaaaaataaaaaaagaaaaaaaaatccaaaacccaaacccttggtcgccgccgttgtgtgccgcgctacagcccttgcccccgctgcctgcggttgtggttgccgctcgcgatgtcgtgccgcccttccgcctcctccgtgcagcacgcgaggacggatccgccctcttccaagcactcacatcgccgtcgtggtcgtggtcgccactcctggtgttgcgccacccttccgcctcctctccacatgtgcaagggcggatccaccactctcgagcactccggcagcgaatccaccattcctaagcttgtcgacggtgggttgtccgctctcgatttagcccgcacgtacccgcaagttcgtggttgccgttcctggtgccacaccacccttccacctcctctccgccacgtgtgagggtggatccgccgct

SEQ ID NO: 32726 - DNA, 1501 bp, Oryza sativa
tactctctccgctcttattttttgaaaatgtatctattgactaataagtacactaataatatctacgccaagtattatataggttatatcattagatttgtgttttaaaatactttcatgtgatactgattttgtagttgttgatgatataatatacatgaaatagtttgatactacgccggaccaggtcatctctgacgggcccaaaccctcacctttgatgggtttggccttggtcagtgattagtggtcactgatgacaaaatcacctgtgacgggtgaaacacccgtcacagataactcatctctgaccggtatataagtcatctctgacgggtctaacaacttgtcacccgtcacagataagtcatcagtgacgtgtcataactacctgaccatcactgacgactaatctctgacgggttgaaacttacgacccgtcactgatgacaaagcaagaaatacaatttttaaattttaaacgcaacaaaaaaaacctcaaaaaaatattttgaattttactagccatcctatacatagttacacatcactacctacaaattcacaatttttcacgcaatataacttgcatgctaaacgtgagattcaaacttaagacctcaaccaccatagagagcttccttaccaactcacctactcagcacatattgattactcacccaatgttattattttgtctatgtttgtctgaatcatttaacatatatttaacaccctaaatgacttcaaatgaaaatattatcaactaaatagttatagatctcatcgtgttttataacttttacatagaaaatatcttcatccgatgttgtttgaagaattcaaaatttcatttttcaaaatagatctcactttataacatgtattttgaacatgtaaactttgtcaaatgaaaatattttcaattattaatgttgtagatctggttgagttctatgactttgatatggggcatgtatccatccatgtcatttgaaaaaaaactcaaaattttgtttttaaaagtagatctcatcacttgtaatgcatcttcggggatgtaaacgatctctaatagaaatgttattagttataaagttgtggatatcatcgagagctacaactttacttttatataggacatgtctcaatccgaggttttttgcaaaatttaaaaatttgaattttcactcatcactgacgggtcataactaccacccgtcagacataacgttacctgtgacgtgtgttagttaatgacccatcagagatgagtggtctctttttagttaaagagccatctgtgacgggttacaagtgcaagtcgtcacagatgacctcacatctgtgacgggtcctccctagtagccatatattgaagaggatattttttcggcccgtcagagatgactcatctttgacgagttgcgttggcccgtcacagatgacccgtcactgaagcctggatctgtagtagtaagttaaaatatgttattaaagc

SEQ ID NO: 32727 - DNA, 1501 bp, Oryza sativa
cgagattcagaggatgcctttgttttttggcaagaggtgaacgacatatacaaattaattatggctgtgtttagttaaacacaaaatttagattttagttaaaattagagatgatgtgattgaaaagttatgtgtgtataacagattgatgtgatagaaaatgactgaagtttggatctttggatctaaacacagcctatgtattttgatggtctgacttggatagacaaatgggttgatcgagcaacctaatcagcttattttttagtgccagaacaattaataaactggatgaccataattgaccgatcgataccaattttaaaatgagaagttcattacgtgtgccatacgtatacggtaagtatactatgtgtgtgcgctgcagtatatgcgtgctacgtgcagttctgctgttcactcggtggcgtgacgtgggctgcggcgagggcaaaattgagaacacaacctgtaccattcaagtattcaacctaccaagacacaaccctatatagcagcttcacgggttaggaacatattgatgctcattagcgacatgatgaaacacatccgcactggagctatgcgtacacgcgtgcaagttttcaaaaagcgattggcatggaaaagaaaacattggaggaaagaaagaacaatgtttaatcctataaaaaagagtgatttgtccctaaaagacctcgtgcataattgagaactcatggaagtttaaatggaataacttgctgatacaaaattctcacaataaacgtactattggaaccatttgagaactaatcaatacttcaagtttgcaccctttttaacaggaattagagattatacagctatcattcttcacattaatttggtggggtgatcaaaaaataagattgtctcttggcatacagttaaggctactgaagaatatgcaatgatgtttataaatatgatgcatacaatatgtctgcccttactatgatccttggaatataccaggttcaacttcctggagatgttagatatggagcagtaatatttttgcatttttgcagctttttttacaaataactgcaaacttttgagcgtcctgtagcgaatttttcaaaacattataaagatcaagggaaaggtcacccttacacatcacgataaggggtctgctccatcaagtagactgcaggtgaaatcattgtttaccagaactattttctctgcctccttgataacagcgtctagttgaagaggtgcaaaactccgaccagggccatagaaatgaggaaaatagtttgaatcatcagctgcctcataaactaagccatctgaaagctacaacaaacaagaagagaaaatgctatgaatgtgaagtggcacaacgaacagatgaattctactgaaatacaaacaggcatgggcttgctacttgcctagttaccagggcaaaatacatgtatagtttttgttcatgaatagagataaaaaaaaacctggtgcgttctgaagt

SEQ ID NO: 32728 - DNA, 1501 bp, Oryza sativa
gatctacaacattaataattgaaaatattttcatttgacaaagtttacatgttcaaaatacatgttataaagtgagatctattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaaacatagacaaaataataacattgggtgagtaatcaatatgtgctgagtaggtgagttggtaaggaagctctctatggtggttgaggtcttaagtttgaatctcacgtttagcatgcaagttatattgcgtgaaaaattgtgaatttgtaggtagtgatgtgtaactatgtataggatggctagtaaaattcaaaatatttttttgaggttttttttgttgcgtttaaaatttaaaaattgtatttcttgctttgtcatcagtgacgggtcgtaagtttcaacccgtcagagattagtcgtcagtgatggtcaggtagttatgacacgtcactgatgacttatctgtgacgggtgacaagttgttagacccgtcagagatgacttatataccggtcagagatgagttatctgtgacgggtgtttcacccgtcacaggtgattttgtcatcagtgaccactaatcactgaccaaggccaaacccatcaaaggtgagggtttgggcccgtcagagatgacctggtccggcgtagtatcaaactatttcatgtatattatatcatcaacaactacaaaatcagtatcacatgaaagtattttaaaacacaaatctaatgatataacctatataatacttggcgtagatattattagtgtacttattagtcaatagatacattttcaaaaaataagagcggagagagtatataagtaacttataagtgtactggagatacaacgaagaagcatctgtaaagttgtataccatttacaacgttttgcaaatgacactggtacaaaaatgtttcttgcggactgtccaaaaggggtttttgcgtgcggtatggctagctgcatgcacaaaacactaccacagaaagggctttcggtgccggttggcaaaccccgttaggaaccggcacctttgaggtatacgatttacaaaaaaaaaatccggctcgccgagccgatgcttcaaagcaccaaaaataaatccaaaaaaaagagaaaataatccacaatcagacaatcaacaattaagttcatgggtcaaatgttcatgtaattttcacatcagacactcaacaacaagttcatgcatcaaatgttcatcaaattttcacatcattgaatcaaacatcataaatgttcagacaatcaacagcaagtcagcacaggttctcaccggaggtggaagcaacaggacaccatcgggcaccgtaggcgaggggaggcggacagagatgccgccggatccgaagc

SEQ ID NO: 32729 - DNA, 1501 bp, Oryza sativa
atgccctaaatgaatcaaaagattccaaaggaaatggcatctaggatggccaattggacacacgcaagaagcaggagatctccacacgaagctctgtaggcaaacaaaagatgaaatcacacatgctgcgagaggcacctctaatagcattactgatttgcgtccaacctccaacctgggttgtaatatttggatggctttatccctaattttaaacagcaattttcagcaaagtagtctagcaccctagatccactgaaaaatcagagaaccaatgactaggcccaaatctccacttgaaatgtgcatatgataaatagagagatccatggggatcccgcgagtcggaagaaatcagacgtccctgctttctaattgggaattacctgactgaggtcgctgaggtggatacagccggtggagcggtcgaggtcaccgccaagggtgccgccggtgcgctgaagctgcgcccactcatccgccgtgctgatacggtatacgaacgcctgcggcgctggtttatccatttcggccgcccgctgacagtgctgagggttgaccatcagatacgtctcctctacgtttctgctccagaggacagaagatttcacttgttcctttttttttaggaagcactattggttctggccagcaataaagaattttatagaagaacggcagtccaagttacacgctacaaattacaaaaccaaatgtatgtaggccatgtttagattcactttaaaatttttcaccatgtcacatcgaatatttagatacatgtatagagtattaaatatagaaaaaaatagataaataattacacagattgcgtgtaaattatgagacgaattttttaaacctaattagtccatgatttgataatgtgatgctacagtaaatatttgctaataacagattaattaggcttaataaattcgtttctcagtttacaggcgaaatctgtaatttattttattattagtctacgtttaatacttcaaatgtgtgtccgtatatccgatatgacacgccaaaacttttcacccttggatctaacatagccataacctatctaaatttatttttgggtgtgttagtcccggcaaaatttaaaggttgggtggaaatgggacgaagggccgaaagttggaaatttgtgtgtgtagaaaaagtttggatgtgataaaaaaatggaaagtttgaaaaaaaagttggaaactaaacaagggcttccttgactcgttgtatattctgtaaatatgcaagagaattccattctatttacaccggcccatgaagaagccggcctaattagtaagatcaaataaaatgttgttacaaagttcaataggaaagttactgaaaagaaaatctaaaagtcacactgcttagaaccattaggaggagtgagtggcggaagctggattaaaaataagatttaacgaaaatgtttgtttcataaggccaactaagcacaacaaataccatatctatacta

SEQ ID NO: 32730 - DNA, 1501 bp, Oryza sativa
tcatgcaaatttatgcaaatgtgatatatagaaaaatatgcatcaactttgagttgtatctttatatactaatcattggaaagtttttatttgatttttttcatacattattggactagatcagtatatatattgtgttgaaatttctcatatagaaaaaatagtatgctttattagttcattgtggataaacaattggtgattcttattccaagataaatactggtcttgttgctgaaatcacataatagtattcttatccaatgcaagttttcattgtattatctgtgttagattcattttccttatgcgcagaactgtatgcaccgtccttttatccattggactgcatgctttaattttttcaaagcaacaatagcatttctcatccatcacaatatttgtgctgccaaatttttagaaataaaagcattgaactccaattctgtgtgattatttaggagatctcacaaggcactgttctattcatttacttccgcagtctcaaaatttgtgaattgccggacatgtcaaacttaattgcttatccatgtaagattcaataaaagtagaataacatgaagttttaagtttgtcaaacatatttcagatattgatgttaatatggcatctatccaaattatctgtcacagttacaaacaggtttacttcttattacttaataatgattagcttgattggcaactgttatgtcttagatacttccgttctcgcttaactcattttgtggcgtaatccgtgtttgatctttcatatgtacaattcaatgtaaattttatgggcttaacagggatattttcatcatgatcaactgcaggtacagtttattgtacacattacacatacaagttgatactcagttggaacttaagagcaaagatgcacgttcaggtgcaacaatggatcaagcagcaaataattttatgaagaatatagaaatagacacactttgtaaaatcgtttagaaattgtacttattgttgatatgtggattgatgaaaataacatttgcttcgtatgcaattcaaattgccatgttgatttgtgttatttgagatatgtgatgcctataaaggatattttgaaatattttggcacattcctgaaaattaaaaggcaacaatgtaaaaaaaaagctaattagagcattattggtaatcaaatcattattgttttgctgtactgtgcatttgatgtgttactagtggccaagatatgtgttaccgggacctatagcaaggtgttccaaagtgcaacctgaggttaaaaaatggtgttactgttggtatttcttaacgacattactagaaatataattcccagcaatggcgcataaatacttttggtatattatagttacagagtttatccgcaagcgcacggatataccattatagcatttcacccgagagtattccaagggtattgtatttattttatcccgtgggaagatcatgtagagaggacttgactaataatt

SEQ ID NO: 32731 - DNA, 1501 bp, Oryza sativa
agcccggtcagaccggctgtatgcgctgaccacccctcgtcagtttgttgcgtcttcaccccatcggttttactacttatttgatctatgggggcttggctagcactggtagaggctttatctttgaacataaaatcggccatgagagggccaaatttagtcctcataaattcttcacaacgagtttcgatagatgcatctaacttattatttaaagtaaccatagatgaatctatcgtatgcgcaatttgttgttggatagattgtgatacctcttcagcacttaccatgtcgaaagtatgtttaggcaatgatcccggcttgaaaatcacaccttggcgggtcctagcgcacgccttcattagtagatcttgagtatatgccttgagatgttcatctaaagctttgcgtgctccctcatcaagctcctccaatgcgactggtatcacattgaccggttccacctccgccttggttgatggaggctttgtcatggcgatatcgaagttgagatgacgttgagcagatttccctagtggagtcgccaaaaatcatcttggcaactttttgtgacaagttgacaagcacgatcgcagcacgtaaacgccttgcgttgatactagagtcaccaaccatctcaatctagcaaaagctaaaccaagataggttttgataactaaactggctaacggagccgattctagataactacccgtctcgtgggcaaaacggaaggttttcaggacaaacctacaaagagatgtcgcactcttgtaggggcggtggacgatttacggcgcaaatcgacaaagatggacaaactaagagaaaactaaaagcaatatgaaaaacgattcgattgattgattgtagattggtttttacaatgaaccggccttacccccttatataggggttggtcttaccctttacaggccctcctccacgtccaactcgggatagaatccaaaggaaaccagaaacatgccttcctgagcaaggaaacttcgagacccggtgaaacagacctggactcggactctgccggtcagaccggccacacaccaccggtcagaccggcccacacacggcggtcagaccggccccacagaggaaaaccggcagacttccaaactttggcaatttttcttattttactcctaggtgccaaatttgggtgtaaacacattaatcattatatgcatccataataattactaatgttcatgaggttatttgcactccgattttcgccatcaaatttgggggagcagccggagtaatctcgataatgatgcccgtcaggtgatcgggcgggggaggagaaatcgggcgctcccctaccccatgcacgcgcgctcccctcccctgacccaccacgtgtcctcacacacaactctattgcaacaaattacccatatattttggaaactctctattaagagaatttggtttattttttgttccagcaaaaatgtttcatctagtgtactgacaatgt

SEQ ID NO: 32732 - DNA, 1501 bp, Oryza sativa
atttttctatatatcacatttgcataaatttgcatgaagataaaattttctactttttttcggtttacctgaacctctgaacttgaatgctgaagaaatccttctaagttacaaacaaagaatactagattccttcaactacaatcccttttctgttccttgaactacaatcccttttctgttagaaacaatatacaaccatagatcatggaaataattagaagtgaagcaaatactaccataccagagaaaagttctgaaaagctatcaccattgccaattctgattgcactatgtatctaccataactataccaacttcagaaaatctcagtttttccaacagtatggatatttcaatcagaggatgcatgcagcaggctattttaagcatatattatagcccgttataagcatatattagcatgtatagcccattattgcttaccatatcatagtttcctcctgtgacattgagattagtgacaggcgtagccatgagctaatcactactaagcaataataagaagaatatcaaccatggtctgtagtaaatgccatattagcatcgactgctagagaaaaatttgacaaagttcagaatatatgttttattctagtgttattgaaccatagatcagcaatcagctaatgtgccttgtaaaatttcgtaagtagtcaaagacagagctggagttcaatgctcccattgctccaaattttggtgagtgccattgtaaatgttgggatgaataaacaatgatctaatcgctacatataaactttgaaatttcgcttcttgtctacccacttaactagcatatcattatataaactgagctggtattaatctagcaacaaaaaaacaagaaacaaaaacaatgaagaacagacaacttcaccttctgttatagctaggaatatttgtgttccccctttggttgcaaccaaaggccaaatctcgtcatacacaaaacaaaaattgctgagattagtttacgggttggagattagagagagagagagagttgaggtctgaggagtaggggaagagaaggactggtaaaggaacatagctgttgaaccgaggggagcaccgccctggtatctggcctgagggagaagccccacgtactagcacatctggccatcgcaagcggaactagtcaccaactcacctttgagctcgtcgggatgcgtgacgccgccgagcgctgctgtggggaggcgccaatgtgctgccaagatcttcgccatgggggtggagacggtggctgagagctcgatgacctggctacaggccgggagacggcggcgtgggggccggcgggtagcgacgactgggggggaggcggaggagaaaatggccattttgccatgttcaaaacacggtttcgctagaatgccattccgaaaacgtgattcgataaaataccaatatgaagcgtgcgtctaccaccactttgctattttcaccattttattcattttcgaaaagattt

SEQ ID NO: 32733 - DNA, 396 bp, Oryza sativa
ctgcagcccataagatatgagttgtgcaagattgtacaggaagctgaaaaattatatgaaaggaagggcattgtcggatgggtgaattatatctgatcgtccaaaatgggttaatagtgatcgttggcgtttgtacccgtctaacctttttggtctgaagtctaaaccgcagagcaccgctccaacaaggcgcccacataaggaaaggaaaacctgcaacaactccatggtctcctcccgtttcgatcaaacaaaagaccagaaaataaaagagaaaaaggtaatagtaagcctccgttcccaaactcccccaaaggcctccaagctcgagctcgaccccgaaccggaaacattcctcgtcggcgaggagcggcgagatcccccgggccccggcca

SEQ ID NO: 32734 - DNA, 1501 bp, Oryza sativa
atgttgcggagtgatcatgaactaacaaaaataagccttttgtttgctctaatttaatgccgactcctcgtaaagatcggcaaagtaaggttaagtatagttttgacgtggccaaatgtgatatgatttttttttatcttttgcaagaaaaacaaattagattacctaaaggccatgtcataccctctcaagtagaattgaagcgtcaagcttattgtaaatggcatgattctcactctcattctactaatgattgcaatgtgtttcgacgacaggtttaatcggccatagatgaagggcgattgaaatttaccgatggttccaagatgaagcttgatcatgatcctttcccggtgaatacaattaatttcaacaataagaaggtgttgattggtcaaggagtggtcattggagagcctaggccaaagatgatggtgccaaagaatccggaggttggtgtttggaaggagaataggagcgaagtttcaagttctaaagctcctaagaggactaaggtgaccttcgatatgcttttgaataagtatgagaagcaaggtggtgagaaagctcgcaacaaaaggaaaagaccaagatcacctcctagggagcgatttggtcattcaccaagacagtcggaatcacctacatatcatcgttctcaaaacatgtcatgggggccttatccaatgctgccgtcgggttatccttttccttactacatgccatggggggcaacaccatcaatgttcaatcatatgcctccaatgcaatacaaccggggccagctcgttagcgtttatctttaccaaacaatggccagttttatgctaagaaccgggccaatgaggagaaaagggaaggaaagcgtgtcaaagtggagattaggacttcggaggtgattactatcaaagtggggtctcatgatgagccaataccttctggagatgaagttggagagtcttcaagcaataaatccaacgccgggaccagctcatcgcaggcggccggtctgactaggccctctggccggtctgaccgcagccctaaggctggtctgaccgggccatcaggccggtttgaccgtcagcccaatgtcggtatgaccggcgcttctggctggtctgactaatggtctacgtccggtctaaccgggctccagcgccggttcgacaggagatttgcaaagggtagttcaggggcttcatcgtcttcgagtaaaatcaacagagggcattatttacctcctggaacagagccgaaaccgaggtggatgcctaaggatttgacgggtaccaaaagagaaggttgcaacatctttgggcccaagaattaagagagagagaggccgaagagcaaagagatagaaggttcaatgagttgcgaccactgcctacaaagatgtggaggcataaatccatagagattgaagaaccggttgttgtgcaaaaggagaaggaagaacaatcggttgctaaggatgaatcatctccaaaggaggaca

SEQ ID NO: 32735 - DNA, 320 bp, Oryza sativa
aacaagtagaattttggaagggattgattaaagaaattgaaggacttctacggtacaatacactagcaatatatatttttggcatatacaaagatacactaggaatttccatgtacaagttcgcgtgagcatggtggagagtggggagttgggcatcattgctgctgcctcctccaggtagaggaactagctagggttttgggtgggtcggaaattgagaagacgaaagaaaggcaattcgaattaatttacaggcaggcaggcacaatagcgtggtgcgcgtgaacttgcagtgcgtgtggcgtctctctatggcggta

SEQ ID NO: 32736 - DNA, 1076 bp, Oryza sativa
gaccatccccttcgtttcccccttcccacctctttctcgggcgccgctccgccgcgccggtggtcgccggcggtgaccatgcggggcgcgggtgcgcgccgctcccgtcggccgtgccggcgaggccgcctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacctcccgtggacccggtccgcgcgcccgcccctcggctgacgcaataaatgggatttttaattgaaaattaaatgaagaaattcgcaaatatccatttaaagagcatataaacttcaaacggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctattcacctttgttatgaccatattattatcgttattgttattattattaccttgttcaccctaggcaaacaaaacctcaactagtggactctctactcaagacaccactagtttaattctaggtagatgcttcgcaatttaattaggtaaccttaggtggttttacaactttagacttgggaattatttcatatcacctggacactctggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 32737 - DNA, 1501 bp, Oryza sativa
aggtctcgtgcgctatccccttttcatattgccgaaaatttctttcgacaataacctcctcgctttcgtggagaagcacgaccgtttttcagcacaaaatggcaaaggttaaccaaatcctaggattgctagaatccagctatgaaaacaaaatagaaaataacggaaaagtaaagaatgagaaaaatagtagattgatagattgttgggggttctcccgttctactgttaccgatatactccctccgtttcgaaatgtctggcgccgttgactttttagcacatgtttgaccgttcgtcttattcaaaaaatttaagtaattattaattcttttcctatcatttgattcattgttaaatatatttttatgtaggcatataattttacatatttcacaaaagtttttaaataagatgaacagtcaaacatatgctaaaaagtcaacggtgtcaaacatttcgaaacggagggagtatataccggcaaaatgataatggtcccacacaaaataaacaaggaaataaactaataaaaatccattcttatctttaccgctgaacgcgctaactcaccggttcccatgatcccatctcctgccaaccgacgccaaaactccatatcgcacgcgggacgcagcggcacccaaatttgttcggtcagcaacacgaactcctcaaggatctgcaaatttgcatgcatctgactcctgctctgcttctgctttcagactggcatcaagcaactttaactccctcacatgatcaaatgataaagccaccctccaatttacatggaaccatctattgcatcacaaattctacacatgtaaactgaattgatttcaagcaaatcataagataatttcaccatctattccaaaataatttggcctgcacaaatgaactaactataagccaaattatgatacaaacacatgcatgcatgtccaagaggttgattaggtcccatagatggtgcatgtgcaaagaatcgatgaggggctcaccagcgaaggagaatttggtcatggcgacagtggccgaagttgaagacgatggaggccgatctccgtccatggtgctccattcttctcggttcttgaggggtttttaagaggatctcatggaggagttgatggcgcgatggctctgcttgatttggtccagaacgacgggaacagcgacgaggtcacaacggcgtcgcgcagagcacgccccaaggccggcgatgacacagtggcgttcccgttgattcgctgtacgaaagaggatgaaatcaaaaggagaatcttgggcatggtgaggagagtatggaacgtggaagagatagggttggcgaagactcgtcggcgacgacgagcatcgtctttgtcacggctggtggtgagatcgaaggcgaggagagcagcaagagctctctccctcggttctctcggcacaggactggaggatgaggcgaggcgatgcgactgtgggagagatggagagtgagctcggtgtt

SEQ ID NO: 32738 - DNA, 1501 bp, Oryza sativa
aaatgaatcaaaagattccaaaggaaatggcatctaggatggccaattggacacacgcaagaagcaggagatctccacacgaagctctgtaggcaaacaaaagatgaaatcacacatgctgcgagaggcacctctaatagcattactgatttgcgtccaacctccaagcctgggttgtaatatttggatggctttatccctaattttaaacagcaattttcagcaaagtagtctagcaccctagatccactgaaaaatcagagaaccaatgactaggcccaaatctccacttgaaatgtgcatatgataaatagagagatccatggggatcccgcgagtcggaagaaatcagacgtccctgctttctaattgggaattacctgactgaggtcgctgaggtggatacagccggtggagcggtcgaggtcaccgccaagggtgccgccggtgcgctgaagctgcgcccactcatccgccgtgctgatacggtatacgaacgcctgcggcgctggtttatccatttcggccgcccgctgacagtgctgagggttgaccatcagatacgtctcctctacgtttctgctccagaggacagaagatttcacttgttcctttttttttaggaagcactattggttctggccagcaataaagaattttatagaagaacggcagtccaagttacacgctacaaattacaaaaccaaatgtatgtaggccatgtttagattcactttaaaatttttcaccatgtcacatcgaatatttagatacatgtatagagtattaaatatagaaaaaaatagataaataattacacagattgcgtgtaaattatgagacgaattttttaaacctaattagtccatgatttgataatgtgatgctacagtaaatatttgctaataacagattaattaggcttaataaattcgtttctcagtttacaggcgaaatctgtaatttattttattattagtctacgtttaatacttcaaatgtgtgtccgtatatccgatatgacacgccaaaacttttcacccttggatctaaacatagccataacctatctaaatctatcttcgggtgtgtttagttcacgccaaaattaaaagtttggttgaaattggaacgatgtgacggaaaagttggaaatttgtgtgtgtagaaaagttttgatgtgatgaaaaaattgaaagtttgaagaaaaagttggaaactaaacaagggcttccttgactcgttgtatattctgtaaatatgcaagagaattccattctatttacaccggcccatgaagaagccggcctagatttagtaagatcaaataaaatgttgttacaaagttcaataggaaagttactgaaaagaaaatctaaaagtcacactgcttagaaccattaggaggagtgagtggcggaagctggattaaaaataagatttaacgaaaatgtttgtttcataaggccaactaagcacaacaaataccatatctatacta

SEQ ID NO: 32739 - DNA, 1501 bp, Oryza sativa
cgagattcagaggatgcctttgttttttggcaagaggtgaacgacatatacaaattaattatggctgtgtttagttaaacacaaaatttagattttagttaaaattagagatgatgtgattgaaaagttatgtgtgtataacagattgatgtgatagaaaatgactgaagtttggatctttggatctaaacacagcctatgtattttgatggtctgacttggatagacaaatgggttgatcgagcaacctaatcagcttattttttagtgccagaacaattaataaactggatgaccataattgaccgatcgataccaattttaaaatgagaagttcattacgtgtgccatacgtatacggtaagtatactatgtgtgtgcgctgcagtatatgcgtgctacgtgcagttctgctgttcactcggtggcgtgacgtgggctgcggcgagggcaaaattgagaacacaacctgtaccattcaagtattcaacctaccaagacacaaccctatatagcagcttcacgggttaggaacatattgatgctcattagcgacatgatgaaacacatccgcactggagctatgcgtacacgcgtgcaagttttcaaaaagcgattggcatggaaaagaaaacattggaggaaagaaagaacaatgtttaatcctataaaaaagagtgatttgtccctaaaagacctcgtgcataattgagaactcatggaagtttaaatggaataacttgctgatacaaaattctcacaataaacgtactattggaaccatttgagaactaatcaatacttcaagtttgcaccctttttaacaggaattagagattatacagctatcattcttcacattaatttggtggggtgatcaaaaaataagattgtctcttggcatacagttaaggctactgaagaatatgcaatgatgtttataaatatgatgcatacaatatgtctgcccttactatgatccttggaatataccaggttcaacttcctggagatgttagatatggagcagtaatatttttgcatttttgcagctttttttacaaataactgcaaacttttgagcgtcctgtagcgaatttttcaaaacattataaagatcaagggaaaggtcacccttacacatcacgataaggggtctgctccatcaagtagactgcaggtgaaatcattgtttaccagaactattttctctgcctccttgataacagcgtctagttgaagaggtgcaaaactccgaccagggccatagaaatgaggaaaatagtttgaatcatcagctgcctcataaactaagccatctgaaagctacaacaaacaagaagagaaaatgctatgaatgtgaagtggcaaaacgaacagatgaattctactgaaatacaaacaggcatgggcttgctacttgcctagttaccagggcaaaatacatgtatagtttttgttcatgaatagagataaaaaaaaacctggtgcgttctgaagt

SEQ ID NO: 32740 - DNA, 1501 bp, Oryza sativa
cagtacctagagtactgtagaactatatacttatgctccaatttctcaaccaatctcctccgtgaacaccgacgcttgcacgtacaccttgtgaagcccgttgcgaagatcactcccacacggtgtccatccactgtgtgccatctcgtatccaacttcatcacccggtatccttaaccgtctggacctcaactcctccctgagtctagtcccgatccccaccgttgaccgaagttgacctccaagaatcctgactctagtcgccttctcacatggtatcccgaccgtactagacctctgctccaccctgagtatagtcctggtcctcaccattgaccaaggttgacctcaagttacctgtacacaatcagataaaacaactgttcctgagcacaaatatcacaacctgacccacattagtcacacgcactcccaccaacatccacaaatcttttaaaaccaattcattgattaaatcatttacaaaaccaattgttcatcataaatattaatcatgacaatgatttcacaaccgtcgttgtcaggtccttccgcctcgaccgctgtcttcatcaagctccaccagacgtcggcatccccatccgcctctactgccgcccgggggatagacccacgtcttcaccgcctctccgcctgcctcctccctcgtggcaggcaagacgccgctggcccgtcgtctctggcgcgggccgacacctcgccaccaggatctgcaccattgtcgccgcttgcggcctcgacgccctccgccggtcagcccctacgcatccgcgtctgtcttgcctctcgctccctgtattgtctggttgtccgtcactttgctagtcatcttgcacgtgattagcaagggagaggagagagagacaagatggttgcagagagtttgttggctggctggctatggacttgtggagggaatgcatgtgtcgctgctgctggtacagttgggcagagaggttgctggacgtggacttggtctatggaccatgtgtgagtgggtaagcttgcaactgatgctgttctgctgctgcatgtatctgtttttttttcccgattagagatcgagtttgcgtcgcccactgcctcgtcgacatctatgtgtctccgacatcggcatcgactctgcttcgatttcatcgttcagccctgcgcatcttcggcttgatcacccgttcaggtgcccggctacaacgacttctgtaaccaatcgttatcgagcatgcgtctacgccatcaatcttcgggttgccgctgcgttgcccccttgggctgcagtgccgccgcccgtggtccacctccactggttgttggaacacggagaggcgccctcctcagcgtggcctcactaccggtggagttctcgccgctatatcgacatcgggccgcacctgtgtcgccccttcgggtcacagcgtcacccctctcgtcgtcttcatcgccgttcatgcatcgacatcctcgtcgtccgcattggtcatct

SEQ ID NO: 32741 - DNA, 1501 bp, Oryza sativa
gaccgggtttatagaaaaatatatcaacataacattaaattagtttaactaaattcaccatgaaatatatcttaatattgtattgactttttattgtagatattggtataatttttataaaagtaattaaaatgagacaaatttaacttaggacaaaactaaatcggacgggtaaaggatagaactcgaaagaaagtgacttcttggtaaatgatttttttaagctttgaaccaagatggcgtgtgacaagagattctgaaaatgaatgttaaaagcataaacaatgtcctagttcgttttcaaaccaaatgactcccgcttctcgtcgggtctaatgatggcgaaggagcaggtttttattcgggcatccacgatgtaatgaagtagtggttaataagtattgaatgcatccctactaccagctattatacattgtggaggtggtaaagaactactaccagggtataagcttactaccaggtatactttatggtgggtcccatctatttttttaattgtggcaattggcatgactcatgtttaaataactttttagatgggtcccaccgtactatccactctacacactattaccacctgacatgggcccaccttactacctagttttgcaataaacattgatgatgccttagttaattcatggcaaaatgtggcatacaaaccagattataagggcatcctcaatgtatgtgggacttacaaaattaggttatagttgtttctatctctcacaatgtgtgagtaagatatggcgcacatgtaaagcaatggttggatagaaaagagagagggcgagagaggtaatagtttaatgtcttttatggcatagttgctatctcctctattatccacctccacaatgataaagtaaagggtcttacaacccatttttcatccatattgtggatgccctaaaggccatgtttcgttagacaaaattccctcaaataccaatatccatctttaacgaaacataaattttctcaaataccaatatccatctttatacttttttatgcgtataataagaggcatacacattagacaattaatatggcaagagaaatttattatattacacgaacgagactaccgatcgggcgctcgatccaggcgtggaaaaatcgggcgctgacgtcagcatatacgcatacgtgcaaaaccactttaaactattttttctcttaaattatttatccaaatcatgatctggttcaccattaaattcgttgcaattaaatcttcaaaacaagaccacacatggatatattccgatgaaaatttttttagcttattattgaattattttaaaatgttgcacgatgttccaccaagtatatcggaattgtttcattaagtagattgaaaatgtttcaatcgtttaaatcggtcattgtttcaccttatataaaaataatgttcacaagtagcgaaagaatgtttcagttcactgcaacatttgatccatacataatgaaa

SEQ ID NO: 32742 - DNA, 265 bp, Oryza sativa
gcggcatcttttgtggtaattatcttctattccatgtatatcttgtgttcttgagtattaggatgccgtactattaagagggctaccacatgcatataattggtagaacactagtgctcaaaatcctttatttggactgttcctattttattcctgtcggactatccgatcctgataagactatccgatgctcagactatccgaaatttcttagaacttttccctctgtctttggtctgagtgttggctaaaaaatatcggacaa

SEQ ID NO: 32743 - DNA, 1501 bp, Oryza sativa
gcaactaagtgacttttaaatgctgtttactgcaaaacttaacccctatattattaccccttgtacccccttgcattaatcatgcatctgccggtgtggcttgctgagtactgtggttgtactcattcttgctcaatctttccccccttcagtaagagaagctttggagaagtagtcttaggtggagtcctggcttataccccagttgagcgcctgtgaagatggagccgtaggcccgctagtccgctgctgtttattttcgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatcggcggagcgaacggctcgggcggcgcacgcttgccggcgaacggcggcgttacggcacgaacggagggcaccaacgggtagcggacggcacggcgaactcaccggcgaccaaagcgacggcgaaagaggaacggacggcgacggcgacgagattgaagcggcggcgctcttcggcttgacgacggcgacgatgctccggcgatctccggcgacagcgaaggggcggacgaggacggcgacgcgacggcgaccacgacggcggtcttcccgagcgacggcgacggctggagcgacggcgaagcacggctggagcggcggcggcgacggcaaagctagggcacacggcgctagggcttttccgacgacgagaggcgaaggcgaaggcggcgacgggtagaggagacaccgggggtccttttaaaggggctcggaggcggcggcaaaggcccacggcgaccggcgacgaggaaggaaggttcggcaaaaacgaatccgagacgaactcgaatccctcgatttccaaaccgatttaaccgatgattccaaaggagaaaaggtagaggagatcccggagaatgtttcccctctattgattcggccggagaaggaaaggagcggccggattggaaagcggcggcggcggcgcgaaactagggtttcggcccgaggaagacgaagatcccgacaggtgggacccacctgtcagcgacagcgcactcgcgcgtgggcggctgcggctgcggactgggccggcttgggccgaggagagagaagagaggttttgggccgactttcggcccaaagccaaaagagactttttaaaacctttttcaatttaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagattttcttttcaagacttttcaaaattatttctaaaaattccaattaaacaacaatttatatattttgaattttcagggtgtgacaaattt

SEQ ID NO: 32744 - DNA, 1501 bp, Oryza sativa
agcctacaatcggctaacatctgttaatagagggcagccgattaggttaaatatcgatgttggtttagattatataagatatccaccactctatgaaacttccagcgacttgattgtctagatattgttcttcttttcatacttaatgttgtatcagttgagtttgatttattaagtcatgcttagaatatcaatctctagcctgccttctggttgccgattagggtagtatcggagtttcagctgatcttatctgatttaattatatttgctttatatgtttcattgacatgttaaatctgccctttatgtcaggatattattgcatctaagtatattaagcttatgtttggtatattctgtttgtttcaacatcttaacatagtgttgtattggagtattagccgatacatactagatctatccgatcggctatgctataaacatatatagttctgttattaatatatatttcaatctaagtgatttatactgtctcgacatggcgaccgatctatcccaatcactcaatttaagtatagatataaaattatatattgttgatatctacagccgatcgagtaggtttagtactttattatctatttataaccgccgatcgatttacatatgacatcggctcaaagataaatgatatgtcatcggcacttagccgatcgtctatcatttataggtttaaccgcggtttctttgtctctatttcttgttgattgcaggatcaaatcaactggcacgctaacacacccgaaggcgagctttggacctgcactagagttaagcagatctcccaggcctcatgttttacatcaacaaaagcttatctctctcttgaagagaagttcgaaaccttaaagaatagtgtctctctccctagcgaggcaccttgttccaaaattgttccaagcaatgaaccatgtgctaggtgtaaggatattgatattgatgcttgtgctactaactctacttccttaagtgctttgcaaaagcaaaatgagaagcttatgggactccttcacaatggcttgcttaagtgccatatgggtagtaaggtactaaagaaatacctaggctatcaaagggacaacttcaaccatgaaggccttgggtatgttcctccaccaaaaggaaaggtggacaagagtgtgttgatcaagaagccccaaggtcttagcatctttgttaaggccaaaagtatccttcctaatggtcatgcttcacattgtccttttgatgtatcatatgttcttaggaagaatgctagtggtcgtgtggttgctaaatatgttgggcctaggggcaaaaatgtttccatcaagagagttctttgggttcctaaggcacttgtcactaacataagatgacccaagaaagtgtgggtacctaaaactagaaattgatctcttgtaggaatatctctccggtggaagaagttgggtgattgatagtggatgcacaaatcacatgaccagagaagaatcaa

SEQ ID NO: 32745 - DNA, 1501 bp, Oryza sativa
attgaatcccagtttataaaattattttgatttaaattaatgcattaccgctttatttaaattcccgcgttatcactgttttacttagccatgcctatttatcattgttaagacattattattgctattgttattattaccttgttcaccctaggaaaataaaaccccaactagtgggtactctatttatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaccctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccggaggttccggccataggtgggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatatggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgctgtttactgcaaaacttaacccctatattattaccccttgtacccccttgcattaatcatgcatctgccggtgtggcttgctgagtactgtggttgtactcattcttgctcaatctttccccccttcagtaagagaagctttggagaagtagtcttaggtggagtcctggcttataccccagttgagcgcctgtgaagatggagccgtaggcccgctagtccgctgctgtttattttcgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaa

SEQ ID NO: 32746 - DNA, 1501 bp, Oryza sativa
ccgtcggtcgcccggctcgtcgtctcgcggcgccgcctccgtcatcatcatcgctgcggcgtgttccccgccgtcctcgtccccgtgcagccgctgccggctgtcctcatcgcctcctcgccggtccaggtcatcgtcgtcgtcgtcgtcctctcgtcgttcccggtcgtcgtggcgttcgtccctccgtcaagccgttctcgtccgtcgtccgcgtccgtcaagcaagccgcggcagccccgtcctcgtcttcgtcctcgcctccgcgtcatcaagcctcgtaccggccgtgtctcgccttcgttcaaggatcgccgccgaagtcgttccctcgccgtccgccgcgcccgttcgtcgttgtcgttcccacgcctcgtcgcgtggtggtaaggatccgtcctctcgctgccccgtcctcgtcctttcagtgtcaccccgtacccgttgtgcggttgtcgaccccggtacccgtgtaccggtatcggtagtcgttcacgcgtgcgggtggtgaccgtgtagtgtccgtgttagtgtgcccgctcggtagccgcgtggtttccacgtgtgcaggccgtgtggtgtctagtggagtccgtttgtcggccacttgcctcggttgacacacggggtccgcttccgtcgacccgtggaccgtctctgtgtacccggtctaccgcggtcctttaggttgacatgtggggtccgcatgtcaacggcgcagccctcctgtcttttccaggctagcgcttacacatgttttataattgcaaagcttaattataataatccgcaaatctccatataacagcattaaacttcggatgatcatatcttggtcatacgagctccgaatcgacccgttcaagtctcttaatgtttgttataacctaaagaaccctgtgctttctttttatgtattgttattgcttctttataggcttgtagctttgcttgtgtgcttcgtgtagctttcgtcgttccggaggttcccaaagcgtggttcgtggtcgtcgccgaaggttcggaaggccgttctctctgagcaaggcaagtcacatcatccttgagcatattgaatcccagtttataaaattattttgatttaaattaatgcattaccgctttatttaaattcccgcgttatcactgttttacttagccatgcctatttatcattgttaagacattattattgctattgttattattaccttgttcaccctaggaaaataaaaccccaactagtgggtactctatttatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaccctgttttcggtggggtttgggtgcatgccagttgtgggaagtagcaccccggccactataaggattaa

SEQ ID NO: 32747 - DNA, 1501 bp, Oryza sativa
ctatttcccttgattgctttgacagacatgcaaattggtgcccatttgtagtttatgcaaacaggttgtaggtaaatgctagcgaaaagaaaacatggcatctcattatatcaggatgttaaatttcagaaattgtggcctattaagaaagggcctgctattcatattgcgttctttggctgtgttttcatatatgatatatggaaatggttttgcttactcaacaatcccatatacatttctaaactgtgacacctattgtttggtacactcaagttctacaaaacaattttgtgcaaaagtatgttactactattgcatataagtacttcaatttatatacttttcgtgatacactgaataatatatttgtcttgtaatttgatctgggcgttgtttatatatgacctccaaccattcctttttggcactgtatatgtattctttagaactcattctcaacctgttttaggtgaggaaaacgcttaagaactttttcctaggaaggaatgatctatacctactacaagttgacacttccaaggtaacgtgtgtcagtgtatttaaactccattggatgtagtcacataatagatcattttaaattaaactagttgcgcggctagcacccatataaaattatatatttttttaatatgattttacttaaaacttattagataactatcttgttgtcttaagacttaagactttgaaagaccaaactttattatccctgtgtttttaattttatagtttttaaaagtcataccaattgctacaactttcttttgtcatttcttttttttatttgctaactcgatctaccactttttctattcattctccttagaacctttacaaattggatcgtatagtttttagagtttattgtctcgttgggtttcgtttttataatttttagaagtcccatcaaacgctgccattatactcctctacagctcatccactgcttcttctgtttattgtcattgggattttaaaagtcgaatgtaattatcgattgggttcagtttttactttctagaagtcccaccaaaccataagtgactttgccactgtactcctctacggctcacccactgtctcccttctttattgctattgcgattttaaaatcaaacatgattattcttttaccttttagaagtcctgaacctttaaaaattggacctcgtagtttttaaagtttattgtctcgttgggtttcattttttataacttttagaagtcctgtcaaacactgccactatactactctacgactcgtctgccgcttactctttgttgtcattgggattgtaaaatttgaacataactatcattggaattcattttttactttctagaagtcccaccaaccgtcgacggctctgccattgtactcttgtacaacccgcccgccgcctcttctttttattgccattgagattttaaaaattgaatattattatatcattatgcttttttactctctaag

SEQ ID NO: 32748 - DNA, 1501 bp, Oryza sativa
tatgtaattttagtgtatttacaatataagtctcaaaattacatatgtaagttcgaaaattacatatgtaagtcctaaaattacatataatgtaattaatatatagtcatcactcatcatgatgtatgtgagaaaataatcttcaatctcacggtaacacagttgggaggcctctgtgcagttgtgtggtatagcgcataggtatgcaaaccgactgtaatcaatggaattttatggcgccagagatttagcaaatccgtttaaaggataaaaatatcctcccttctaacacaattaaactttgaaaggtgggccacataaaaaattaaacgaatcggtcgtctcctcccgtgctcccgtatgcaacgacttcaaactttttaagagatgagatgagatttttttttaagagtttgtttagggctactattcaatacccatttttacttaaaacctcaataatctaggaattaggatcatgggcagtataggcactctgttggccacgctcttgtaaacatgattgcagttttttatttttcacaaaaagatcgcagtgtccttttcttgttagtaatgccaagttttgtttcctaaatgatttggtagctagtaaaaatatttctctgttattattgagttgcgtgtgcgtgcactactgtcgctttattatagggcattattctttttaggtgattagcataggagattagaatatgcctaagtagtaggttgctaccagtccctaaatattaagaaagggaaaagagaaaagaatcgacctcgacatatatattttatgtttgtttcggaaacttccccggataactcccgatcctaatcagcaagggtgacgcccccacctactgctgccggtcgctgcagcaattattctaagaggctgcaacttttttttttaaaacagaggctgcaactggggacgcatacactgtgcagagagatcaacccaatcatctatccaaatgcaggcttctaccactcgcccgttataagatacttcctccataaaagaaaaattaagattagatgcaacgttttatctagatttattatactcagatatgtctgtcggtgacatggggccgggggtatcgtgactagaggcttgggtagccgcggtcacccacgtggcccgaccccctcgggggggtcgggcccgagggtgacgtggccacccctccctctgtctccccgaggggtcaggccgctcccgtttcggccccgagggctggagcgccccgaccccctgtggttttggcgccacgtatgtgggttagatgagcacagcgggctcacctaaccgcatttatagcaggttggacgagcgcgccacgccgcatttaatgcggggcagcgcacgcttatccggtccgtgaccggtcacggtgtgtgaccggtcacagaccggtcagatcgcgggttaggtggcaacaggcggcctgtcacacgcctcgccccgtcccgtcggaatgatgagagc

SEQ ID NO: 32749 - DNA, 775 bp, Oryza sativa
ccctcttcagtaagagaagctttggagaatatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcgtgtttgtatggtgtaccccggcttttcctgggacggggattaatacactagcgttcgggaaaatgcaattttcccggtcgcgacaataatgcctcaacttggtgcaagagaaatataaacataagcacaatttttccaccggagaataccttgtctctgcatccaagagcctacgacttaaataaaatatagccctttcttttccttcaagctcttgaatcaatactgagccaatcgacttatcaccagccgataggtacaatctgaaaggtatccctttttgtggagaaatttgtcacaccctgaaaattcaaaatatataaattgttgtttaattggaatttttagaaataattttgaaaagtcttgaaaagaaaatctaattttaattaataaattccaatataaaatgggcccagataaaatttcattaaatactttgcttaattctataattcctagatttttctgggatttatttgagctaagaaagtatttttaataaatggaattgcatttaagaaataatttaaattgaaaaaggttttaaaaagtctcttttggctttgggccgaaagtcggc

SEQ ID NO: 32750 - DNA, 366 bp, Oryza sativa
acgtggcgccaaaaccacaggggttcggggcgcccccacctcggggccgaaacgggagcggcccgtcccctcggggagacagagggaggggtggccacgtcaccctcgggcccgacccccccgagggggtcagagccacgtgggtgaccgcggctacccaagcctctagtcacgataccaacggccccatgtcaccgacaggagcccccggcgttatgccagagcgatcgcccccctcgagggaagcgctcgggcgtgacgccactccttaggcccggtgacaggtggggccggtccctataggcgggcagaaacccagcggtcgcaaatcgcgcgcatcggcaagggaaaaccgaccgacaataa

SEQ ID NO: 32751 - DNA, 210 bp, Oryza sativa
aatcggagctaagatgaattagttatgaatttttaaagattaaaccggattaaaacacttaaattggttaaaattgaattatgacgcaataatgaattaattttgaaaaggaagagaaggtttattgcgtcagcggctagggttttggtggaccgggcgcacgggcggcggttcacgcgaacggacggccgagatctaaccgatccaaga

SEQ ID NO: 32752 - DNA, 173 bp, Oryza sativa
caataatgaattattttgaaaagaaaagagggttatggcatcaccgggctagggtttcggtggaccgggcgcacgcagacggttcacgcgaacggacgcccgagatcgacttgatccaaaacggacggccgagatcgaacggtccacgaccggctcacgggagagggcgacga

SEQ ID NO: 32753 - DNA, 1501 bp, Oryza sativa
agccccagccatcagttgataagacagaggccagtatcggcattgtacctttggatgttccagcacagcagccaagaaatcaagtacaagatgaagaacccgagcgtaagaaagttattgtctgttacaactgtagtacctgttaaggaagcaggcatgccaatcgccaagtggtcactggagcaaatgcagtacctgttaagcctagcgctagtcagaagcaaccataatactcttatatcagtgttcaaatacttttgttttatagttgttcccgtcaatcatgtaataacagagaaacatgagattatgaaggagtttgataagtttatgaaggatccatgttaagattgcaagtgctgtgagttgtgtacattttgttgctgattagggagacctagggtctcatttccgtaagctcataatcttattatgaatcaaataacctagcgattgatggcgaagaaaatcaagtgatcaaccaaagagatatttgtttggactaagagtttcagatatgtcttcttcggatcaaaggcatgcacccgttgtggagaaattggacacgttgctagcatgtgtctcacactctgcactcactatgaagaagaccatccaccaggggagtgtcccactcgcaaggtgacatgttttctgtgcgaaggaacaaaccatgtgcccaaggattgccaactcagtgtgttgttgaccaagaccgcagaaatccaacgaacaaccctacgattgtctcatcagctagtcagctccaacagcaacattgacgacatcatccacagcaccaatgctcctcctgctccacctaactctgcaataaatcatagcaataatacctttagcaccaaccattctctgcaccgacagcctcagcaaagaattgtcgtcgatggaagaagttgtgtctctccccgacctactccaggccgagccaagggcaatcaacctctggagggcgataccaagcagaagaccgtcatccgcttcaaacagcactcagaaggaagcttctcctgtgaatgatggcaatatgcagtcctatcacatcatcacagaaccaatcaaggatgatgcagtcactagaacaacgccagctatatctctccagaatcaaaatgagcagccacgcttgtggttttcagttcgctacttatcattgtgtaatcgaaagtttgcagcaatcatgtaattaataaatatattcatgtctgtaaacagtgagcttgctatgtttagggatgattcatgttgaggatacaatgtaccgatgataagcaccttccctttttgtttaaggcagtgccttgtattcgtgtaataagggagaaatgtgtaatacagacaagttctaagaggattcttttggaagatgcggatatgtgatcatgtgtataattgtttactgacaaaggagacctagggtctcgtgtcagaggaactatattctaacctcgagttaataaccaacctgtggatggaaaagaaa

SEQ ID NO: 32754 - DNA, 494 bp, Oryza sativa
ttcccccccccctttcccctcttgggccggctcggcccagctccctccctctctctcctcctccccgcggcccatccggccttcccccgcgcgcgcgccgctgacgggcgggcccgcccgccaccctcgctgacgggtggggcccacccgtcatcccctacctcgcgccgctcccgccgcctcgcccgtgccctagcgccgccgccgctgcgaatcccgccgcctcccgccgtccccgcgcacattaaagtggggggaattattccccgggattccctctctctttccccccatttctccctctctctcccgcgttcaaacgggcggatttgcccccgcaaatctcgccggcgccattgaaggcggccgacctcccgcgccggtttcctcccttcccggccaccctctctcgccccggctctatttaaaccctccccgcacctcctccgtccggttccgcctctcgctgcccttcctgctcgccggattcgagc

SEQ ID NO: 32755 - DNA, 1501 bp, Oryza sativa
ctctagtatctctataagcaatcggttctggttaatcaggtgttggaccagtgtcacacaactggtgtctggtgcttcattcattcgggagcttgaggtaccaatgtcctgacttctgaccttattgcctttctcattgtcagccatctgttgcaaaggtttggagagggagagagggaaaacaaaggggagagacagattagaaactaaggatgggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaacgaaacactagagggtggcttaggttctgcgacgggttcccaagatcttcactcctgcttcacagctggcttcactgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggagaaggagaaaaaaggaactttcgcaaatagttttatttataaaatatgtccttaggttttatccacttggcttatcctacagtcgagatggctctgataccagcttgtcgcgaccgggaaaattgcattttcccgaacgctagtgtattaatccccgtcccaggaaaagccggggtacaccatacaaacacgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcgtactgaaaaggggaaagattgagcaagaatgagtacaaccacagtactcagcaagccacaccggagatgcataattaatgcaagggagtacaaggagataataatataggggttaagttttgcagtaaacagcatttaaaagtcacttagttgcccaaagccattttataaagacgatcctagagctacacagtattattaatcaaggccgtgaccccacacgaacctgccttaacccaaggcctacgatgattcagaccgaactggcaacccgaccctgggtctcagctcgtcccaagccaacccaggccaaccattccacatttcagttgttgagcaagttttaagaatttaaacactaacttgggtacattgctaggcttgcccattaccgagggcgcggctattcgaataggtttactctgatcagaggtgtacatctttacccacaagacacgtcttcctcacgtgcaaccacgtgccacataccaccacggtatacagacggaagacgtgacatagtttccaacccatcctagc

SEQ ID NO: 32756 - DNA, 733 bp, Oryza sativa
attctccgggccacatttgaatttttcttatacgcattttagtgtttgccaatttcttttcgaattttaattaattctattattccttttagaaaatgatttttatttcgggatgaatttatcaggacgtgacaattatctatggtccaatgaatgtactgtgatatgtaaagccgatgtggttaagtatatgctatcagctccgattctaaaagatagggttggaaagtggatatttgctttgacaaagtttgaccttcggtacgaatcgccaaaggcaattaagggataggctatagccgattttattgtggatcatcgtaatgattcaatcggctcagttgatattgtaccatggactttattcttcgacggatcagtatgcactcatggttgtgatatcggcttggttataatttcaccttggggggcaaattttgagtttgcctatactattaaacctcatgtaactaacaatcaagctgaatatgaagcagttcttaaagggttacaattacttaaggaagttgaagccgatgctattgaaattatgggtgattcattgttggtgatcaatcaattggcaggagaatgattgcaagtatgaaacattgatgatttatcatgagaagtaccgaaagttaattgatgaggttcggcttgtaacctttgagacatacatctcgaaaacaaaatatcgaggctaatgacttggctcaaggtgcatcgggat

SEQ ID NO: 32757 - DNA, 1501 bp, Oryza sativa
cgagggcgtcggacgccgccgcggagagcatccgcgcgggcgcgggggacggcgagaggagcgtgcgccccagggaggggaggctccgccggagcggggcggccatctcgtcggagccgtacgccggtgaggcggatggtggaggagagaaggggcggacgagaaggccgaaggggaaacaccgagagagagagagagagagcacttcagaacttgggagaagagacggctggaccgaggatatgttggaagcagctcatgttgggccaatcttctcggcccagtgttgtgggatccgattggtttatgggccgggccttgcggcccagactggtgcgaattcgatttgtttctgtgtgctgggcccagttatggtccagtgggtgatctgcagccttggagttgaaggcccataccgaggttagactagctcgttgggttttggtccagatgaaccactgacttatctgggccggcaatgttatattgggctgcctctggaataattcttgatggcccttttgataatttatagaattcatttttcagttccgttatttcaactacaccgtgatgaagttcatcaagagcataatcacccataataagtgtattcagataatttaatacaccatttggtcgtgaatatttgatggttaggccggacaatatttggatggcaaattttactacaaaacatctaaatttcgtgtaatttgctgatagacatcgaaaaaacattcacaaatgaaagacatctaaaaatactagtaatttgttagagaacaatatcgactcaattaaaaagataaattcttgagaaagacaagaatgcccctagaatcacatgcttcaaacataacgttaaagtacgaatttagaaattatgcaactccaaatttagcatcaccccaagtacatcactagtatacgtgatattttatcttcaccctagtctcagttcaaaatcttttgaccgtgggggcatccttgtcttttttaagaacttttcttttcaattgagccgaaagtgtcatttagcaaattatcagttttttaagagtgtctttcagccgtgacacgtttttatgatttctatcaacaaacacaaattttgagtgtcctatagttaactttacctatttggatcttacttttgaaactttaactatcaatagtctttgaaatgcttagtttaaaaacaaaagacttggtagtatcaatgttttatgcccataatatagactaattaaattttataaacttaatactaattggccgaaacttgttttaaacgttaactatctagaaaacgagggagtaagtcttttgtatttcgcctaagaatgaaaagtgattaacattgtgtaggaggacaaatacgtatgactatgatcacatgaagttctgaaaaaaaaaagatcacatgaaaatgcaagattacatctctaaatcattttcaatatcgatgccaaagaaatccacaaataagtccacctga

SEQ ID NO: 32758 - DNA, 1501 bp, Oryza sativa
ccatcttgaaccaacaaattgaagatgtgtgcacaacacctcacatgaaactgtttaccttccaaaaccaactcatccttaagagttttcactaattcttgacaagcaacggtgttgttactagcattgtctaaagtcaaggtgaacagcttgctacttaagccccactcagtcaaacacctcatcatggcttcttcaattgcaaaactagtgtgtgaatacttcagaggcttcaaacttataattttctttttattttgaatactgcatcaacataatgggccgtgacaaccatgtatcctaagttttgatttgaggtccacatgtccgatgttaggcatacacgcgaatcaagattttctaattcagcatgcaattcttgtttcagcctattgtaatagttgtaaatcttgtcacggattgattgacggcccacaagtttaaaggttggctgcatggacgccatccaatcatccaagtagggatcctcaattttatggaatggtatctcagcatggatgaaatattttatcataagctctttagtttttttagatcaaacacgaaattttccacaggttttttcctaattgttgatataaacctatttctaacttcaccatcaactagtggataagattaaataatatggtttatgagatggctagttccttattttctagtcgctgaaaacattaatcaacaatatttgcattgtgcttttggaaggccatctatcatgacaagctcctgctcaaaatgttcccacacttttgctcttttacgtgtttgtgaaggcaattcatggctagagctattggcagatgaactttcagaattttgcatagacatgtttaataaacctgtgtttgacaagactagaaaattaatatacttgtgcagaattaatatttacatttactgcttgtgctaaaaactagtgaaatgataagcaccatgccaccatgagtccatgacaatatcagtataaacagagataagtgcgaaaagtaataagaatagtgataatcaacagagttaggagatagtcattcagatccaacataaacctctagttataaatatataatgctttgaaccaacatacgcctaagtttccttttactaatgacatatattacatatgggagggattaatatctgcaaatcatggtataatcttgctaaattatccacttttcagatgcaaatctacacagcagaaaaagaaaatgacaaagatagactctcccgaatgctacaagctaatctgcatgacaaaaaaaaagagggcagattgtcctcccaaccatccaggagtacaatgggggcaaattttttccatggttgactatcattgaagttcatgccactaacagcataatcaagaactgacaactacttcctacatttcacaatataagtcattctagcatttcccacattcatattgatgttaatgaatctagataaatatatatgtctagaatcattaacatca

SEQ ID NO: 32759 - DNA, 321 bp, Oryza sativa
cacacccccccttctcctctcagatccgcgtcgcggcggccccaaatcccacacgcgcacagcgcagcaccaacgccggaaggagacagcgcccctcgcccccgccaccccaaccctacgagagggagggagccagccagccagccagccaggcatggccacctccacttccactggccaccgcgccgccgacctcgtcctcccctcctaccccgaggcacgctctctttctaaaccctagctgttcctggccagatgcccagatctgtggcggaattgaccgggtttcttgggttgtcttctccttctctttgctgcaga

SEQ ID NO: 32760 - DNA, 258 bp, Oryza sativa
gtcatatatatgaaggttcatcccaaatgtcagcaacttttgagtccccggcgattgtgtcgtttatcccaaatgtaccaacaaattctcttttatacggtcgtaagaatctcctttattaatgcgagctacagcgagatactactactatactccctctgccgatgtgccctttctagtacaacaaatctggataaaggtctatccaggtcctctcctaggttagcttttttttttggacggaggaagtagatgtaa

SEQ ID NO: 32761 - DNA, 267 bp, Oryza sativa
ggagacaagaagaagaaggaagagaaaggtgcagcttaactgatggctaactgaatcttcttcacttcccatctgaattttcatcgaattcatcagctcggatgattggtttaatttaattcgttttcaagacaaaagttattttcagatgcaaggattaattaattaagctagcttgcctctttcaatatttgaaagttcatattgtttcagtattaacatgtgagtggtttttgcgtggaaatattgatatgatgctgctgcagt

SEQ ID NO: 32762 - DNA, 228 bp, Oryza sativa
gtagctagataagagtttgccaatagttgttcaaaatctcatgctaatttgactatatattcattagattagactgcaactcatatatatgaaaactacagttaattaatttatcatagcacgcacgtaaccatcaatatggccaatgtcataaaaaaatgcaatatgacactcatttgcacctgtataattctccaagcgttctgcaattgggtgttggtgtgcagg

SEQ ID NO: 32763 - DNA, 1501 bp, Oryza sativa
tttactagcaacttgctcatgccgcggatgatgccatatattgttaattaatgcttgatcgtcgttttatttaatttttttaaatagtattttactattattagatgatcaaatataaatagtaatgtatacgtgatttattttaaatttttttatagtttttaaataagacgaaaaatttaacattggacatataaatgcatttaaaataggattgtagggagtaattacccttaccaacgcccacttcgcgtggctttgcgctgtcccgctcacacgctgtcgcatggtcacattacacctggacggatggagccaacaggggagggggttggagattcgagacctgcaaagtgcacagccgaaagctacccacatgagtcacagtcaccaagcgttggttttctttccatgtcactttctcgtaggcagcagttgtgccccgacgtctaggatatttttgttttcatgcttatctcctcaagatattggtaagggggtgatgtcataggttttaatgatgtttggtgttttctgctggtatattagttatgtttggagtacttgtcacatgtaaagcatatgagtatcattctaacattaaatatgagacaattaattgggttcatagttgtgcttaattcaggttactatcctaataattttaaaatgttatacaaaattttaagaccatatgatcaattataacccataattctatgcgctcttcgtatatccataatataaaatattgaactgctaatgataatataatcgagtcaatgtgatagagaatcaagtagatatcgatcagataatatcttctcaaacaaacggtcagtaccaacatttgctatttatcatatccatgtatataatcgttgttctattaaagctatatgaacagatatcaatagataataacacatggtcttgattgtgttgcaccttctttcttcacaaacatcaaggacaattgtgctaatcacagtcatataatatgcattgcattttactacacgaagttatattctcaaacggacacataaaccagtaatatatacaccttcattatagtattaaacatgagtttattacagtatcgtatcgcgtttataatagaagattctcatggtaatgagataccgtgaaatgggagaaaggctaggataccattccatcaattcatccaatgagtaataaaacttctcaattttaacaacctgacccaatcacaaaggacgcgccgactttggtgcacatctctttggttccccaagccaaagccccccaaaattatctaaccactctcttcatccctagcctaatcatccctatcaacacacctaagctcaccaaattccaaaataaaaacaccaaaaaagagagaaaaagcggaaggccacctctcccatggcaccaccaccaccctgacgccgacgccgacgccgactgactcacccgccggcgagcccacgccgcccaccgccggagacggcca

SEQ ID NO: 32764 - DNA, 1501 bp, Oryza sativa
gctgctagctgcaaaatcgttcatggccctaaatacaaatcaacttaaaaagttgaacacagcttacatctgcctcctcccaaaaaaaagaaggagcggctggactaaattgcttgcaaataggcttgctccccgactaaatgaattagtctctcaaaaccaaagtgctttcgtcaggaaaagggcaattcacgacaatttcctcttcgtgcagaatttagtgcatattctgcatagaaatcacaaagaagcgcttttcctaaaggtgcacatcacaaaagcgttcgatacagtgggttggccttacctgttagaagtcctccagaggtatggttttggtactagatggagaaactgggtatcaaacctccttgcaacctcctcttcccaaattcttctaaatggatccccaggtgcttcattaccgcacgcacgaggactctgatgagggagttaggtcccgatcttccgatatgtattgataaacattcgatttgggcggagtagcgacacaaattgatccggcttcttgaacacgtacgctcttgagccccgcaatcgcagcaccacgtatcctctggttatcaaccgtgctgaaacccggttgacctcgctgagaaggctaatccctgcatgtgaatcgaagaacacaagcaagaacaagatagattgcagccaaattgcatatgaatgattaagcacacgaatttggggttccacaaactgatctagcggcgaaactgttcttgacagattaatctaagcaaaacccgactctaaacgatgacggctactgaataaatgtgattagggacgtcctagggttgccctagggcgcacacccccttgggctaagcccacaacacaattataaggcccaaaacccaagtcagattcggactggatgagatacatggcttgttttgcagattcccggcagctcggcaggaattttgacatgggaccaaaaccatctgaaagtagactccataagctttccaacaagtactcatgggccccgaaattccttctatatcagcggctaggtccgtttgaagttgatgctgtcaggaggcccgaatccgaatccaaaacgtgtacaactttatgtcttgtcttctatggtccaaaagtgacgtggtgaggtagaagtagacttggagaaggtcttagtttggtccccaatcaacttctttaatcatccatgcattagttatgctcggtttcttttccttcgcccaagcaagtatctctgcaaacgaaaacacacaaaactcattgtgtagcaacgtttgttcaaatatataacaagtaaatctaatgtagaacatatgcacctttatttgattaatacataaggtagtcatggttatatccgagctagttatgtcctcatcagactccggcaaggagatcccctatctcctttgctttttatccttgctatcgagccccttcataaacttttccaagcaacggaagaggcctcgtagctcactcc

SEQ ID NO: 32765 - DNA, 1501 bp, Oryza sativa
gtgatttatgtcttttataacatcaaatcacttgtgacttcaaaatcatttttggcaaaataaaaaaaaacatataattaaaagcgttggcttactgtagcatatgaaaagcgactgcggcggcagcatggtgctgcacatggcgggaaggagcaccatgcggaccggatcgatgggcctggagatcatcctgctcatgtcgccattgatgccgtggcagaggcagatgagcgcgctgccaacgagcgacctgaatccgtcgcagcaggcgcccggcggcgcggtggcgtcgttggtgaggtagtcgacgcacggcagcagctccacgagcgacgtcaggcactccgtcggcggtggcgatggtggccgcggccgcgtcgtcgtcgtcccgggtgaagggagcggcggcaatggcggcaacggtggcagcggcggtaaggcgggcagcggtggaagcggcggcagagcggggagcgctggcagcggcggcaatggcgggaggccggggaacagcgaagccaccggcgctgcggatgaagcggtggctgctccttccatttcttgctctccggcaaggccggtccatgtcggtccttggcttgcggtcgcgggcggctgccgcgacgcaccagccacggcggaggtgaggagcaaggagatgacccacgtgtgccgcgccatgatcttctctgcattgtgcgagaccgtaaaaggtgaatttaatcccgttctactctcttggcttcgggatcatgctcttggtcgccatgcttgatcttaaccgaagtgacttttatactcacttgttgtgacggaacattcctgggacttagttggtagcttcacgttcttggcacttggcatggtctcttctgaatacagaatgcatcacaaaatcacccacttgtttatccttcacattgttacgccagaagattaagccttggggtaccagaatctctgaaccgacaaactcagtagtacctcatagtctcaaactctcgagtactatggattattagggtgtgttctaactggatggttggatagattatagataagaacttgtgtgcataggatacattccctgacaagtaatttggaaaaagttttatctaatggatgctgatgtaggaagtttttagagaaactgtacttttagaagacaagccatactttcataagctacttagaatcatggtttgtttcgcacgtgttgcctgaaattcgttagaacatttcttgggcagtgttctgtctgtgcccgatctgcctagcagcccacacattgctatgcaagttcactttgactctaatttgattcctatcactaaaccgtaataccggataccttggctcctaatctattaaaaccggtgtaatttgtcttccttaactgttttagaacgcagtttcgctggcgtggcactttgacatggtccaacccgccaagtaatcttgtggggccgacccgtcatcagggcaacggcacgggatttgc

SEQ ID NO: 32766 - DNA, 1501 bp, Oryza sativa
aggtttattaaacatgtctatgcaaaattctgaaagttcatctgccaatagctctagccatgaattgccttcacaaacacgtaaaagagcaaaagtgtgggaacattttgagcaggagcttgtcatgatagatggccttccaaaagcacaatgcaaatattgttgattaatgttttcagcgactagaaaataaggaactagccatctcataaaccatattatttaatcttatccactagttgatggtgaagttagaaataggtttatatcaacaattaggaaaaaacctgtggaaaatttcgtgtttgatctaaaaaaactaaagagcttatgataaaatatttcatccatgctgagataccattccataaaattgaggatccctacttggatgattggatggcgtccatgcagccaacctttaaacttgtgggccgtcaatcaatccgtgacaagatttacaactattacaataggctgaaacaagaattgcatgctgaattagaaaatcttgattcgcgtgtatgcctaacatcggacatgtggacctcaaatcaaaacttaggatacatggttgtcacggcccattatgttgatgcagtattcaaaataaaaagaaaattataagtttgaagcctctgaagtattcacacactagttttgcaattgaagaagccatgatgaggtgtttgactgagtggggcttaagtagcaagctgttcaccttgactttagacaatgctagtaacaacaccgttgcttgtcaagaattagtgaaaactcttaaggatgagttggttttggaaggtaaacagtttcatgtgaggtgttgtgcacacatcttcaatttgttggttcaagatggaatgagggtgattcatgtggcaatagataagatccgtgagatcctaaagtacattgagcattcaccctcacgcattcaagcgtttaattcaattgcttctagtaaaagtcttcctccaaaatctggtttcgctcttgatgtaccaacccattggaactcgaccttcaagatgattagagaaatattgtcttacaaagctgtcttcaatagctatacctctgaaaattgtgaagttctaccaactgaccaagaatggttgcaggctgaatcaagagtgaagtgcatcagcggtccctaaacttgtgcggatgtgtcatctaggtccctaaactctcaaaatgtatttttatgtccctaaacttgtcttaggtgtcatataggtccaaacgggcaccgacccgctccatccgctgacgtggcatgccacggtagcgcctacgtatcagtggggactcacatgtcagtcatatttataatatgatatgataacaatatttacagaaagaaccttacatgttttaaacttactctaatcaaatcctgtacgtgctaatggagcggagcccacctgtcataggcacagggagaaagcagcagcagccgcagagttcgccggccggcgttccttcaagacga

SEQ ID NO: 32767 - DNA, 1501 bp, Oryza sativa
gttatttaaaaaatgcataagtccctatgttatatgtatatgtgtgtgcttagacttgtgattgacttggtttgtctaaaggtagtacagcacctctagcttgctgcatgttgatgtttacgacaacactgtattgtaatgtgcagtgcattaattagttaacaattctataactatttgtcaagtgatggtcctctaccaggccaaatccttgcatgttttgtggtgtatatactttcagctctccttttgacaactccggttcttttgtggtgagccaactaaccattgtgaagaatatgtaatttgggtaggaggatttcttttggctaggggaagtatgtaattggcattatcaatagttcttttaaatagcatgaaaaatctatgtaattcacatttggcttttaaatagtgctggaaatctgtagtgctggaaacctcatgtatcgataaattagattagacattttttatgcttctctcgtgtggcaatatattgccaaatttttacggtgaggaactgattgttcttgttgtgataaatcataaatgagaataacttactacatttctttgatggtgttatgttctttcaggtatttgcttcctgtaatcaaagaactgtaacagtttccgtgatttgtggctcatgtgaggttcttcatgttgacaagtttagagaagaaactaagggaagtcaggttgtcagtagtaaactacatccaattttcctctgcaagtttgtctttttgatgctttgtcttgaattagttggtgaataatgagttaaaatttgaaatcaaatcctttaaaaaatttaatattaactaatatacatttgttggaacctggctgtgcaaccaacccattgggcagccatagccctaccttacttggagaaaatagttgacttggcttgcaagaatcgcactcttggaatagaaatattttatcatgatcttttttttatgtaacaaacatttgaaacttgcattatctaatacattatcctacttggccttgattcatgtcaatgcatatattgaatatagtaccaaactaccgaacataaaggccacttcctccagggtcattcaattgtcaaaatattttttctcaaaatgtgacaaagggcaaaggagatttgtaatagttgtccaaatttttcccttcacacaacctagtcatatgagactattgtaaggttagaaggcaagttagaaggagtgttactagcttatctttttataaatgaattaccacaaattatagtgagaaatagttgcagctaacaaattatttgggatccaagtcaaagaattaatcggagcatatagtgatcttgtctactctgctttgatatttgtaatttgctgatcttttttcagtataatatctgattgatctccatattagtctaagtcactattatatgttggcatctcacccatgcttaacatatttgtaattatattctccagctgattgactgatcaga

SEQ ID NO: 32768 - DNA, 239 bp, Oryza sativa
caaaatcccttatattatgggacggagggagtaaacaataagtatattaattatttatatgacaattatcattttgccaccatagtctagcctgtcgtgctttatctgcctagttgtacagtcggattggaaagagcacccccgaatgtgtgcttcactagttagctatctagatttactgaatctgaaatctgcttccaaattttggagacacttatgtttagctgtgtgatttgcag

SEQ ID NO: 32769 - DNA, 467 bp, Oryza sativa
agaaaccaatcaagcgagacgggattaagcggcagctctacgttggccttagcattgcagaactgcaggtcgcttagcttagcgcttaggcaggagatagcgagcgagggaggcagtggagagggaagctagagggtgagaggcgataagaggataagggatatatagctgcttctagctagctagcaaagctgagagttgcagcttctactaactctgaacctcaagcactgttttctctgcagaacggaataggacaaagggtgaaccggtgaagtgtttggtgaattattttagtctaaattaatactacctctgcttttttaatagatgacgtcgttaattttctgccacacgtttgaccatccgtcttattcaaaaatacgtaattataatttattttgttgtgagttattttatccctcaaaatactttaaacatgatttatatcttatacttctgcataa

SEQ ID NO: 32770 - DNA, 191 bp, Oryza sativa
aggaagaagataacctatgcaagtcatgttggattgtttagtgacagatagctaatatctgtagtgtatattctctatctgtgattttcccatttcacttctattggttcataaaatatggggacggtcataggtagcaactaggttgcattttagtgctgttgttttcatgtccatgctttcttttcagg

SEQ ID NO: 32771 - DNA, 163 bp, Oryza sativa
agggggtttaagtgtttccacaacgggcgccttgttaaccccaagatggtgtttcccccctccaggttggcctaataatccaacggttgtggggtgtaagtttttacgaccggccgccttgtccgccagccaattggtgttccgcttccacgctggccttata

SEQ ID NO: 32772 - DNA, 226 bp, Oryza sativa
ttcatttttccatcttgcctgtactgccacatttgtactgatgaacctttattgaaagaaaaacgtgaacagcctgaactaactgaatgttgatagggtgaaatggacgttgtaacaaaatagaagtaaactcacgccactaaatgtacttcgagttgttcagtgctggttgttttgtatatttaatgttactatgcaatctgccttgatttttgttgcatgcagt

SEQ ID NO: 32773 - DNA, 455 bp, Oryza sativa
tcaaagaatccacaagaggatcttatgggaggtaaaggtaccactaaaaatcaaagtatttatgtggtttcttcacaaaaaagtaatcttgacaaaagataatctcataaagagaaattggaggggaaacaagcaatgttgtttttgtaatacacaagagaccatccaacatcttttctttgactgtcatgttgtacgttttgcttggcgatgtgtcttctttgccttcaacatcccccctccccacaatgcaaaagatatatttggtgactagctaaggggagtgcctagacccacaaaaaaaatgattttatttggagctagtgctttatgttggtcaatttggcgttgccgtaatgatatagtttttaaccataaaaaaatgcctaacatcatgcaggttatcttcatgtgttccaattggctccactcttggtgtatgatgctttcacagg

SEQ ID NO: 32774 - DNA, 943 bp, Oryza sativa
  unsure (1)..(943): unsure at all n locations
ctcaacaataatcccttttttgcctccctgaacattaccaatagcaagatcagtgatgcatctgtcagctgctgtagctctctgctctgaattggaggattgaagggagaatctgttgttacattgtctgaatttttgtgatccatatgctgaaaggacgtttcatggcggctgtgcttcttcctttgctaatctccaggcaagttcttgtttttctgcaatggaaatggaaagctctgtcctgcctgaggaacataaactaacatgacgaatnncaggttaatctgaatttctgaacaagttcttgttgagttcatgctgtaaaaagaacatctttttgcaagctgaacactccctgaaaatgcaacatttgcacagccactacattcaccctgccttcctaaccaaccatgtaattttttcctgagcaacagaaactaaaggttaataatcctttttatctgatggagaacggtagttaatctgaattcctgaacaagttctggttgatttcatgctgtaaaaaggaaaaaaaaaataactttctgcaagctgaaccactcctgaactgaatgcaatgttgcacagccactacatttcaccctgacttcctgaccaaccaagtaactttccagtagcaaaagacagtgagatgcatagctaaattacttgaatttcagaagagagtagagagggggagaaaaaaagaaaccaaattgctatggcttagaatatagataccttatcctggacccaaccaatccccacaacgcctcgaaaatccccctcctctccaccacaaaccctcgcattccccccggccccaccatatccgccacgtcacctcccgctatatacccaaaccaccatttacacgagctcgcgagatcaagagagcaccaccactcgatcgcagcgagacccaccctcaagctccaagctc

SEQ ID NO: 32775 - DNA, 769 bp, Oryza sativa
cgctacacttccaatctttcatggtgtattcttctatagttaatttaaccagtattatatatttatcttttggaatttgagagattcccttgtcttgaggttttgtggggattctaggcccccatagacttgatgatagtaccaaacacttgtacttttactccatttcacagggtgtgtggattcccacatctggttcttctacttagtggcttcgaccttcaacacttctgctcggtggtggccatgcgagatgatggtgacgatttgaagattactgaaattcacatggcattatggttctatgtggcaggaattcttgctactatccgttctatcgtttagtttttctttgagaacctccacttctgttttcttgaaggatttttgaactcttgctgtctgtcatgttaaaccagtgatgttttagtcaccatctatattatgttaatggagttttcatggctattattatatccatggaaaattttatcgctgtattagaaattcatacggttcgattacatgctagacctcttggagagtggcctgaaatctttgcaaaagcaaaaaaaatgtggtcagtttttgcatagaggtgtgatcccaaccaggatgtgagataagcttgcatgaggcccatgctgttcgctcttcttcaaccaaagtttgagcataagagtacgcaaaccaaaagtgaaatcgttttttccgaattcgtaatcccgtagcaaaaacgtattcctgggagaaacgtgcttctaggcct

SEQ ID NO: 32776 - DNA, 1501 bp, Oryza sativa
tattagttcaagctacattttgtcgatttatcagaacaatgatcttacaattgttgtggtcatatgttttgccaatttatcagatcaatgaacttacagttgctgtggtcgactggtgggtacctttactgcaattattgtaattgtaaggactactcaccagcattcaacaccaatatcagcaggggatgggagaaagtagacgggttaggaatacaaaggttgacttatttcttgcatgccgaaactgatattatcaactccattgtaaaacactagcacacttcaattcctaaggcatataatgcatatattttcctgattacttttcccagctgagtacgaatctgaattggctccatcctgctttgtcttaccacaagttttcactgatatctggactgctttctaatttctaatcccaagattttagccaaacaaattataccctttagtttggctttcgtcggttaacatacatgatttcaaaggatgttcacaatggtggtactgatccgatcaaattgagcttgcattcgcagcccattgatcaccccagaaacataaaaaatgaaaattatccttcagagagcatgcggcaaaaaaatgtaacataaattattgtcatacttccatcatgaatactagaagcaacaactgaagatataagaaatcataaaatgtatcatggaaaagtataaacaatgcatctttgttgctaacatatttgggctagcagtcactatgctttgtacaatagtttgagtcttttgtaagggcaggttacataaaaagaaatctaaactaacctaatctccatcttgaagatcgtatgttgtttcttctcgccaattatctaacaacgtaatcatgatcaactcagactttaatccttcaacataattcactgaagcacttaatcatgatcaactcagactttaatccttcaacataattcactgaagcactgaatatgccaatgcctaaaaactatcctatataaagggaagcataacagctacacatttttctgtcatccccattaaacttcatgctacaacagaaagctgaatagttgatcaagatttaatctgacacagacatggtcaccatcaaacaaaatgtttttgagaagcgtgactgcatgagtactttaggttctcatatttcaaaatatagtacttttggcctcacatgcaatttatgcccacagatcaaaatgccaacaaaaaaaatatatatataacaaatattcatgcatacgaaacaatctggaacattactgaagatataatagataaacaatgcaatagtggagccacaaggcacttatgaaactctagaaatcatctcaccatgtcccaacaaaagaacaccatgtgccacacatctttcccaatgatgattcaccctttccaatactcatttttttatcccattattttgttcagcacttaagctcctattttttcctcatctctcatttcataaaaccccttcc

SEQ ID NO: 32777 - DNA, 1501 bp, Oryza sativa
tttctaaaatatttgccgtataaaatgaatactctattgtaacatacccaaattctagaccttaaaaatttcctatcaaaatagttggaagctaacttttctatttttgagagccaaaaatttccattttaaacaaaggtgaagttgatcaaactcttgcatgataaaattttagaacaaattaaaacctttgcatctctaacctaggacaaaaaaaaataaatttatgtgtaagcatgcatactctcatagccatgtttgacttgagtccttcatatgcatttggattgcatttggattttcgatttgcatatcataataggtctcatgaatattaattaagatctagataaacaactgaaccattagggcctagtgctagctagaggaagttaaaataggaaccatacaccttaaaatatatcaacaaggccaatgtcaagccccacaaaactatttggtcatccatctgaagactagtcatgaacctggtagtgaacaaataaattaactcatatagggtatattccaccttagttacctttataagcattctcttaattaaatactagagtaaacttatgcataaatagttaaggagcttatgacatgtgtaaggtaaactgtaattctaacatatcaatatcacctcaggttaatgagagtccaaatataacttttataaacatttacatgcatttaggaaaggaaaacacatatataaagataagtcttgcgaattatctaaaataattcgtgcaagataaaatcatgggaaaattcatgtaggctctacttaacatatacaactcactgtaattttggtataatttaataactaaatttggtacctcaaataaattagtcaaactaataaaaactagattaactgtagttcttaatcggctaaaaccatactttgtctaaaagtgcatttaactgcataaaagtgtataagtaaaataatttattcaaatactaggttatttatcatgaataaaaataatttttccagaatttatcttctctgtttaagtctcctaaaaattcgaactagtttccaaagaacccatattcctctaatttctgtgagtaatctatccataatttttgagtgcaactaaagaaaatggaaactaggtacatacacctacctccagtaaaatcaacactagttaatctgatcaacacattgagtattgaagctacaaaattagaggagaaaataattccggaaattcgtccaaaaaccaagctcacccatgtttctgcctacacatatcttttccacttagtttacttcgacctgggcccccttgtcagtccctccgacttgcccttcctctgtgcaacttccctagccgaccgagaaacactgagagggagagatcgaacgccgactggctctggacgccgcgcgacgcgtggccacgacgtgtcgacgccctaaaaacgccgagctccatctctgcctctcccagacgcgtcgccactcttcacc

SEQ ID NO: 32778 - DNA, 170 bp, Oryza sativa
cgcgccaaagctcaccgctttcggctatgtcgtgatcagctcgtccaatttcctcctcttcgacgaggttattgagaaggtggtttcttgtttcatttatcctcgtcgttctcctactctactctttagttgctctcactgagttatttttacttgtgcattgcatcagg

SEQ ID NO: 32779 - DNA, 1501 bp, Oryza sativa
gacatatgggcctaggtctgcgtgttgattcttagaaacctcagagatctttttgtatattgatctctcactgacagtggaccccttggaaacaaaatctgaaattataaaagaacagtaactaaaacatgtaaaatccatataaaattaaatatagctcattttaagatgattcaaatttctgtgaaatcaccaaattgagaactttgatgttatggaataaaaacttgcactcacagtacaaatttagcctctaaaatttatccaagttaaatcacacataaagcatgcacaaacttataaaatgcatacaaaattcatttcaactcattttggagcaatctcagtttctacagatccaccaacttatgttctcctataaagcaaaatgaaatagtatacatactatacatcaaatgcctctaaaactgttacctttaaatgactagttttagataagctgaattttagaagttcatataaaattcatcttagatcctttttgagtaaacccaagttctgtagaatcaccaaaacatacacttccaagttataaaataaaattatatacttactgtatgataaaagcctctaaatacttatgtaagtaataaccatcatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaactttaaatttataggataggtgctaatcacaaagtatcgattgagcaatatgtatatatataaatgtatatagaaatacactctagctataatgaaacccaaataaaacttgttagaccagtgaatgcatatttctatccccatccaccaaaacttaaggcacttagctcatataataatttctaggttgatataataaattgctaacatggactagagctcccctagtttataaaatatgaaccatgataataaagaccataagcctatgaactaaggttagattggttaactaaaatactcattttatacatcactagctagatgaggaaagttttggacctaaacctctaaagccatgaacctatagaacactatacacctataacacgttataacttgtaaaatacataaagaattcatattaactctaaaaattatgaaaccaaatgtgttagtcttagaaaatacatatattcaccccccacaaacatgaacttaataagaatcaccttacgacagcggttcataatagtacctaagtaaatcctacactataccgacgaaacttctaaaattcataattctcaaatgaaacgagataaaatagaaattctttcacctaaattcattttagaccagtacctattcactgtgctcaaatcatgcattttagagtattttggatttttcgcatatttcggtgtttaattgcataacgtgtactttgtataga

SEQ ID NO: 32780 - DNA, 1501 bp, Oryza sativa
gagttaagaatatttgagatgttgtagatctttagctatttttgtcaagtctcctgaatgtgtaacacatctggtcgtcgccttcgagtggtttgacgggcacatctcaggctgaagttgactggcaggctaaagacctagcaatgtctccaatattcttctctcgaggcgtcggatgtttcattatgtttgtttgatgacttgaattattcacttcatccctcaaatataatggaaggtccgtaaagcctacgacatctatgaatagaatgtacttcaccaaaatcatatacatttgttaatcgggatcgctaaaagctgtcacaagtttttttttttgcaaaatactttcaaatgtaattataatgtagttatattataactacattataatctatagataagttagatataaaatggcatatattgttttagtacatattatagttataatatagttatagtggaattatattataattatattatagttagatttgaaactttttccttaaaaaacttatggcagtttttagatagtccctctcttaatatattgtaatagaaaatattggtcaaagtttctatatagtataatgtaaatatttttggagaccgtgttatgattcaaaatgatagcggagagtaccactgtgtctttatcgttaaataattaggcttctttataaataaaatagtcgttgttgtcatgatttattctcaaacttccaacgctcatatttgtaaatttacatatatacatacatgatcaaatattatcgaaatatattttgcatcataaatataatgttcccatgcaattctcattcatgatatctaatcattttcttactgatcagagtaaaattatattgattaaccctgacaattatttgaaaacacagagattatcaaccttaagtccttaattccttggtctcctaaaataacattaaccttgacccacttcggttccataattcttgatattttagacatgaatgaagttaaacttttattatttggattattagtaacttaaaaacaaatatttagtttaaagacactaaaacatagatttttcatacaagaataatgtaatataaataaaaggttatttatttattatgtattataataaaaatataatcaaagatatatttaattttagagaccgtatcattgtctaaaacgtctacaactatggaatagtttctactgtaatactcctgtatctacaactatcaacaaatatataattttgttgaaataacttttaggattaactaagaaggtggcccgcacgatgcgtgggcatttattttgttgaaagataagattatagtttatttagaaattgtctcataggtaacaaacttaggatcgaacaatatccttttaaaatgattcgggtgttctattttcttaacatatctcaaaaaacattcatcaactcttgaatagaagatggattaagttagtacaactcttgcatcaaata

SEQ ID NO: 32781 - DNA, 1501 bp, Oryza sativa
acaccgtcggcgaggagagagtttgagcttgtccacgtcgacccctttctcttcttcttcttccccaccgtcctctccacttcaatccgcgttgctggctgaagctcaccggacacactgtccaccgagctgcgctgcctcacatgccacgctgccacctagcgctgggctagatccaggtggcactatctaggtcggatcccgctcctccttgatgcctaagaggggaggtgatgacggtggtggccaagctcccatgccgtcgttgttgaggtcgtcgccttctgaggggctccatctcctcatcgtcggtcgggaggggtcacgcacccctgagcttgttgtcatcgtccgcttggtggcttcgtcgccgcctcagcctcctcgaccgccatcgtgcccccaatctccttgactaccgccgcgacatgaggagaggagaggagggcgccatgggctcgtggtaaccgaaggaggtgggcatgccggggaggggggtgaggataagggagagaggggttttaatataattttttttagattttagggtgtttagtgtaaattttggacctccatacaaattgaaaaaaaatgagaactaaaacaaaagatgttggggagctgaaatatagaattatagccactcctagagccacttgcatcgtaaagaactcaaaatttagacccgtagccctagcctacatggctttccggggctcctcttatgagtaggaggcgctatgaatgggcctagagcaagtgctatgggcatctaaacatttactccaagatgccacatacactcgtatgatgagctggagagaagagaagagagaaatagtcacccctcctataaggggtaaccttcacataaattataataaaaaagggaaaaaaaaggaagagaagattgatcaaacaaataaaataaaactattagggttagtgcactacaattaatatatgtgtgatttattgtatatgctatcttttaattgatgaatagtctacatgaataaaattaggggtgaaatctaccttttccataagacttgctcttgtgccaagcgcagctaccagtctatttcaaccaatgatttgtatggatcttagtccagacaattatcaaaattttggtaacttccaaacattgcccctgcgtaagttttttgtgaggataggtattggcattgatccaaacaagcctcgattgctttgaggtactgttccttgtctacataggaagccatatccgtttgatcacaatagaccaaacatacgagaaactggactgaaattgcacatacacataataacagatgcagatcattatactttaaaaaataatcaggattgttagaatacggctgtgtttagttcacattaaaattggaagtttggttaaaattagaaggatgtgatagaaaagttggaagtttgaagaaaaactttgaagctaaacacggcgtacattgaaaagtagaaggtgacgtgccatcca

SEQ ID NO: 32782 - DNA, 322 bp, Oryza sativa
ccattaaacaaaaacgaatgtttaagaaaagatgcatataaaatgcagcgaatgttggaatgtgcaacaatatgaaattcctccaaaagactatgcaacgatataggagtatctcgcaaggagatcgaaagcgcgaaaaagtagcacaagcgcgaatatcaattttcatcattgactaatcaaacacagccaaaattttaaattttaaagcataattctatatttctatagttcgttttgaaggttttttttttcattcattcttctgcggcccatttaaatggttttctgctctgattgcatgcattgtcttatctcaaga

SEQ ID NO: 32783 - DNA, 1501 bp, Oryza sativa
aatgttttctaatctgtaaactcaaagtagcagtccgagaaacactttttttttgctttgacctatttcattattgtatcgtgtgataaaaaaaaattgagactatttttcagtacacagtacttattatcatgttccataactttgaaatttttaaaaatgtatcttactttttggcctaaagtggtttgccaattgctttgggattaaggcatgtattgtgttgccctgaagaaaatagtatttacataatagaacaatatattaaatgatatgtttgcaacaatcatacctctgcatctagtagaatcatccgcgtataccatagaactcatcagccattataggattaaccgcttcccatatcctaatcactcttactttaattatccacctatcatttttcttgttaacgcagtaatcaaattgcaaggtgccatgttatctgcaaatgcgtatatgcaatataatgtatacatttatgttatttaatagatgcaatatagtgtagccctaattaattaatacatgatagcactattgtgttcttctgtaggtacacgattaccttcttttgtcaaagatgaccagcctgaattgactaatgtcacaaaggtgtcgcacacgtcttatgctaagatgagtcgccagagccgtgtattgtagagattaaaatgccatctggtcgtggtgttcctaaaggaggtaaataatatgagattctacttaggagtaactaatcttgccggcctcatcgatttaaaatttgctaatctgctgaccggtgtgcatatgtatatgtagagataatctgagattacgttgacgtaagtagggtaactaatcttgcctactttattgattcaaagtaggaaactaaccttgagataaatgcgctccatgttatgatcacggtaaatacatgaactgcacgtgtgggtcctcaactcctatgcgtgggttcttattgtgccatgtcatgttgagagcgttttgagaaagccatgtggcagttcaagagtgtttgtaggaagtttaatggacttttagtatataataatagatagaagataatagatagatagacagatagatttaatacatgttatccccatatttctaaagtagtaaatattttaaaagttatttgtagttagagttttaaaagtttgacatcggtcttgtttaaagcaataattatttttaactggagtgagtacataacaaattcttcctgaattatctaaaagaaacaaattcttcctgaagttagtagtgtcattaggcttttatttgcattgaccggctggaagctgcttccattatattaaaaattattagaatttcttttactgatatttcgtattggacgtgacaacttcatcaatattttaccaaagctaactcagagcatccccagcagatagtctgtcatgtccttcatccacgaaatagcgtatggtgggagaaaatctagctccagcggatacactatccgggc

SEQ ID NO: 32784 - DNA, 786 bp, Oryza sativa
ttgagtttttgcttgcaacatttgaccactcatcttattcaaaaatttttgaaattattatttattttatttgtgacttactttattatctacagtactttaagcacaacttttcgttttttatatttgcaaaaaaaaaattgaataagacgagtggtcaaacgttgcaagcaaaaactcaaaatcccttatattgtgggacggaggtagtaagaactaagcaatgtttcttaaatcgaaggaccaagctaacagcaaaggtactgcagttttgacttgcagaagagtgaacgtgcatcctcttgtacctcgaaggtttagcaaatccaagactgtacctaagatatgtataattaataaagtgcatatctgcactatgtgaaaagaatctacaagtcaacaactagtgtactgcaaatctgcattgcgtgttagctagcatgatggttttcttaatagaaaccagggctgaattaaacagctttgataataatcaggtagtagaaatctacctaaactcaggtacgtgcacagtgaaccttttcctccgtctaggtttaatgtacttttcagtacttattataatggtaatcagacttcaatcaaactctaacaggtgaattcgttggatactgttcggtacaattatccaaaagcttcagtcacaccaaaagctcaaacccaaaatctacacttgaaaatcgacatactagaaatcttgcaaatcatacccaaatatccaatcccgatatgacattagcaaacaagaggaatgtaaagttgaaa

SEQ ID NO: 32785 - DNA, 1501 bp, Oryza sativa
tcgcagccttgccaacaatttccctaccggacaacatcagggaaccctggtcatcttggataatcaccccgaatgtaaatgcactttgtaactgcaggtaataccacgagagattaaagtgagtagttctcagcttattccattctactctcttcgtcccacaaaaaaccaatctaggattggatgggacattttccactacaacgaatctggacaggagcgtgtccagattcgttggactagggaatgtctcatccaatactagattagttttttatgggacgaaaagagtagattggaacatggcatccatagcagacaaaccgctggattccaaaaaatcaatgtaacaaaatagagaaaagaaatcacaggaaatggttgcactgtgggagtttaatcagtctcatgtgggcaatttggaagagacatagaaacagagattgctaattaagaatgatcttctatcaaaccaagctgatctaattcattacatttgttcttggatttcttcatggtcaatattgcagagctcacaggaaaaaaaaaagagaacagaatccaccactggaagtatggcttgaagaggagatggagaagtttgcagggaggaagagaatgaaatatacgctgtattttgctccaatttgttggccctgctacgtactggtggttctacctggatggtgattctggcatctaatggctaggtgcagcgttgttgctggggacttgaaattgaacaacaaagagaaccttgcaggtaggttaagcagtacaggattccagagggaaaacttcacacgaacttctttcttcctgatgtcactcattctgaacaagtttacgcaagtgatcttggggaatctcaaaagcatgactaaaagattaattggcttgttaagaaataatatagcggtaatatatctagctagaaagctatgcatagtaatttttttattgatatacatatgttagatgagaaagacgaggtggaataacgagagaataggtgtctcatgtgttcaacttataatagttgaatgcatgatcgaacaggtgtataattaatacggccgaaatgagtagagtgctgcaaggattgcagcatacaaatgtgtgcatttatgtgcaacaattttcatttggagctgaatttcttgaaactcttgcgcggcactcgggactcgggaggtaagcatgtttttgagaaaaaaaaaacaggtcgaatgaaaatgtggtctttcttattatcatagaaaagaatactagctcttcaataccccctcatggaaagtactgttagatagtcccgtgatttctcttgataaactaatgtgcataaaagatgaaaaatatattaatagtagtatttttggcatggcaaatctaccaacaccattttcacaaatcgctctaatcatttgagctacggctgataagcaaaaaaataaatgaacgaaaagaaaattattggtaaagcttttattctgtatttttg

SEQ ID NO: 32786 - DNA, 890 bp, Oryza sativa
accggggacggtactagccttttccagataccacccaaatcctccgtccgccccagtcgaaaacagttatttagtttatttctcctttcacaaatcatgttatcaatatcatggcaatgtggcgctcatgtctccacatgccgcatctcaattaccttcccaaaggtaattgcccaagcatatagcatttgataaatatgagtatgcatgattctagaatagcatttctaagcaattgtcataattgactagggactcatacgtaaacatggttacgaaggaataagggataaacaataatcaaggcatggcataatcacaagtaggatgttcatctttgcatgcaattttatttgtaaacaaaataactccaattgggatcaacatgttcaaggaatagtgatgacttgcctgctcaggataatccttattctcgatataatcttgatcaaccttcacctcctggaagttgcagacgttgcctcacgactaaccgatacacaaagtctataatacgcgagaaaaaccaatattcaagcaacaatcaaatatgcacaaacaaaatatatttgctgaggtcgaacctagggttgctcatattattcgcgcttgctaatggactctaatcaagctaagagctaaggttcctcagtctttctgttgtcatggtggttcagtctagctaatggctaaggaaggattatggttacacatgcatctatctaaatagaacggttatacactagaggttctgttgccggatggattttggatcggtcaaataattactgtgaatcatttgtattattattttattaatggaggctttaatttaattatgtacatatttcacttgtcaaaataaatcataaaaggttagcaattaccca

SEQ ID NO: 32787 - DNA, 1501 bp, Oryza sativa
tctaagaaacagagagaacatagaacgactgaataggatgattggcacaactgtaaagaacaacttaaggctatgttccagttccaccttcccgtatggaaaatggaacgatccattaacaacgatccattaacacgtaattaattgaggactattagtttttcttttgtaaaatatatcaatattattttttgctatagaaaacttttgtaaaggacatactccctccgtactcataaaggaagtcgttttggacagcgacacggtctctaaaacacaactttgacattttatttctataaaaatatttattgaaaagtgatatatgtatacttttatgaaagtagttttcaagacaaatatatttatataatttttacattttcaaacttgagagttgatttatattcccaaggtttgacttaaacattgtcctaaactacttcctttacgaatatactcccttcgtcctaaaatatagcaactttgtactggataggacacatccgagtacaatgaatctggacagtatgttcagattcattgtactatgtactaggacgtgtcccatctagtaaatggttgctactccctccttccaaaagtttaagacctatttcattcttttttttttcaaaagtctaagtcctatttgtagtcattatgtgctaaattaaattgttgataggaaccaagaagccattttaatgcttattggttacatgttcattggttttgtcacatagtgaatgaattaattgtttcttggtcttggtgaaaaagaaataagactcaggttttggaaatgagggagtatattttaggactgagggaataataatttaaaaagtgtgcgcatgaaaaagagggaagtaagtttagagcaaggataatagtagagctcacttcctactattagcccatcttaaagctgttggcggatggcatgaggcccttcgaccaaatctgccgaaacccgtggcgaaggctatggagcaagaacggcgtgaggcgaagagtcgcacgagtgccttgccaggccaggggtgtctcgggcgaagggtgcaaggcgaagactatctgccgaaggaagacgactttgccatggcaagttcgcccccgcaagggccgaggaagcttttccagcccatcaagcctaagggctatagggccggcgatcgccagacggcccatcaggggcccatgagtccctataacattatgtacccctgtaaatgtccctttcataagggtaatcatgtaaattcccctgtacaacctaaaccctagtagcaagaacttgtagtggggctataaatagtcccctagggccatgtaatagggggattcgaagacagaaattcaaaattcaatacacttcgtttccttccaaccactgttgagtaaccacgtccttcgacgtatgcagttgtcatttcgacaacagctggcgccgaccgtggggaccttcgagcgaaaccactgagagcgaatgccaccg

SEQ ID NO: 32788 - DNA, 680 bp, Oryza sativa
cctgtattgcaaaaaaatattatgtttttgattattcttaaggggattttcatttgtggtatttaggttcctgaagggcttgcacagcatgttacatcacctatgcaggcacaggttacatggttaggagaagatccagatttaacagcttctgaacttaattttccattaaccattacattttgtatacataagtcaataattctaaagctgcattgagtcctatagttcaatatagaaatccagttagccacccaaagctgatactctcttcgattgctatcaggtataataccctctttataatatccaatgatttttagcaatggaactatcacaattaacactgctgtatacatgtattttaatgagcacatacacagttttttgaaacaaatttgtactttatttttttggtataaatctatatagcttataaataatgaatttatatcctgtaggcctcgtgatcatctgtaagacatattacccaagccactgtatcctaaacgtagaggtttaaaaattaataattttcattgttttttttaactcggaacaatatgctttagttctattctttgcgaagaacaatattcttagtcaagggccattcagctaaaatttttgtttctctaactaaattaagataatagttttgcacttttacttttgatagg

SEQ ID NO: 32789 - DNA, 1501 bp, Oryza sativa
gcagcgtttgataggacttttagaaattattataaaaaagaagcccaacagaacaataaactctaaaactataagtttttagatctaatttttaaaggttccaaggagaatgaatagaaacagtagtagatcgagcaagataataaaaaaaataatatgacagaagtaagggtagcaactgatgtgtctttgaaaaactataaaattagaaacacagggatggtaaggttttgtctaaaaaaatttaagacaatgagataactatttaataaattttaagtaaaatcatattaaaaatatataattttatatgggtgctagccgcgcaattgcgcggaccacccagctagttacattaataagataaatgatcatactatgttcaaaagtcaattacgttatttatttaaaaaacagaggtagtatgttttttttcaaaaggtagacgggggagagactttcccccaccttaaaacttccattaccaaaattaacagaattattgtcttttaaggattacaaatgaaggtggagaagagttctttccaatgcgaaactacatcgtgctctcttatattctttcttgctatccaaagagttgcatcttccacacagataatctcaaaatcttttggattgatgaaggttctccgtggaatacattgtcatgtcgatgatttcataggcgccaccgcgccagaaacaaaggagatagaatgccttgaacacaaactcagaattggtagcagggggttgaagaatctcgcgatctatcactgaatagatgaaagatgaattctgatcgatctccacaaatgccctgtgaagacgcaagtgaaaaacatgttattatttgcatattcagctttgccagagcagaccttgcaccacaccggccgtagtatacgtactcaagagagtagattacttgttaacacaaaaaaaaaaatccccagttcaagaaaaacatatgtttacatcattgcatgaaagacccctggatcttttaccaacgttgatgattaaaaaaaagcaatttagagcagtagatttgaaccagtatatatatacaaaatttgtatgtgacaacgacctctctcttaaagcgagtgttaaggtcgcgaattcgtggatgtgcgtgtgtgcgtcttctttgtcacttgaaaaagaaaaggtaaaagtagtgagcacttgtatgtaatacatggaaatgacaggggttgggctgctaaatgtcccatgttccatatgcctgttttcgacaaaaagagtggccatgtccggacgcacaggcactgtgctataccccccttacttactcgaatcaaacaaaacaagaatccagtgagacacaccaggggacagagaaacgtgcccacaattactagttccctgctatctagcttgcttgctatctcagctcccagacgatcgatcgagcgatcgagctagctagtgtctgcatatagactgatagcgagtgggataagctggacagcga

SEQ ID NO: 32790 - DNA, 155 bp, Oryza sativa
attctccagggatgagctggctctttggtcgagattcttcacatttaaaacacatcttattccgtgcaaagttcatgaagtggcacctgaaacaaaaataaataagttatcaaggcaaatatataataatgttgaacagtacaagaaaacaaata

SEQ ID NO: 32791 - DNA, 164 bp, Oryza sativa
atagggcgaattcgagctcggtacccatattgtaatgttctttgtggatcatagaggcacacctcttagatgatatcaggttatggttaactatggtgttagaagattatgatattatggtggcctcttttatcgtttacttcactgttattatttttattccc

SEQ ID NO: 32792 - DNA, 192 bp, Oryza sativa
cggccccggccctggccgccgccgccgacgcgaggccgcggatcggcgcgcgccacatcacgcacgcgaccaccgcgccgcgcgccgccgcctccccgccgctgccgctgccggcgtgcgtgcgtgcgtgcgctccgcgtggtggcgcggtccgcggtgaagcgacggtgcgcgaccgcggccaaggcagaa

SEQ ID NO: 32793 - DNA, 182 bp, Oryza sativa
tttttccctaaagggggtagttattgcccagagtcgtgggggttaacaaaggccctttgggttttattaatatttgaaaaaatatatattgtgggacccctttgtcattcgaaaaaaaattaggacccccattttcatcctctccagcctctttcgctcatgcctcttttgtcctttgtagc

SEQ ID NO: 32794 - DNA, 442 bp, Oryza sativa
tggttgtaccagttctcaatgagtgaatccaaataatctgggtttcggctggtagtcgctctttggtactccctcgttcttaaaaaatagcattctagtactggattagacccaacctagtacacgaatctagacctccctatccaaattcatagtacttggtttctatattttgggatggagggagtacatttatagtgtaaatatgtctttgcttcaacaaagaaaattgcacggtgcttaaagtaagtattgagttaaatggttggacaaggaacctctagtattactatggactttacaatatttgtaatgttctttgtggatcatagaggcacacctcttagatgatatcaggttatggttaactatggtgttagaagattatgatattatggtggcctcttttatcgtttacttcactgttattatttttattccc

SEQ ID NO: 32795 - DNA, 310 bp, Oryza sativa
cgactctagaggatccccatgtaaagggataatgagagcgtttgttttgtttttcaattaaactataatccagaattaacaatgccgaaaaaaactagatactgacatatcttgggtgcctggcatttccaaaactgatagcaaatcaaataaccataattaactaaaatttaatgagtcaatgacccagccaaaaaccagatatggttcccaaggcgtttccccaaagggcaaacctttcccccaagggtgaagtttccaaaaaacccctttggggggggggggaaaacttgtgatgttcatttgtaga

SEQ ID NO: 32796 - DNA, 1501 bp, Oryza sativa
aaaggagtggcaccttttagttttcgggggaatcggatctatagtcggactttttttcgtttctgagagggaatcggataggagtcggacttttttttttaattttttcgctaattttttttgttttgacggacgaaggattaattttttttttttgcatcagacagttacggtttttctcgctcgtctggttttttacgacggtttttttggcgcccttctttttcacggaatcggatttttttttgccttttttatcggacagttacggttttttcgcccggtttttttgaccggttttttgacgaatgatggaagcatctcttattttcaaagtagtagagatagagataatgccgttaacttttgaacacatatttgacaatttatcttattaaaaaattttacgcaaatgcgtaatatataaattttgcttaaagtatcttgagtgataaaaaatctcacaccaaaatatattatagttacataacttttttaataagacgaatggctaaatgtgtgataaaaagttaatggtatcatttattaaaaatgacgaggtagtatcaatgacgatgtggtaaggcagcgaagacggcggacgtcccggtgtgctctgtgtagagctcggcgagaccgttcggccacttcatgccatccaagcagtatcgccgtcgttgctgtgatcacctctgcacacgcaagaaagcaacgtgatgacactgatgagattaattagtagtaatcaagatgagctctgagctaactatcttacgttcacgacgaactggacggtgccaaagacgtgcggcaaaaaggtgttgacctcgcaacatggtttctcttatcgtttttggcacagttaccacacatccacggtaagatcggcatggtaaccacgagacattttgtggttttaaaaaataaaaaggttaccacgcatggtaaccacgataaccgtatgattttataaaccctaccttacaaacagtgaggttcccaatgaggagacgaagcctgtgttcggaaatcggaaggagaggtagggacctcgtgaacggaaatcaagattacttattaacacatgattactccctccgtcccattttacatatagtagtgggttttttatccaacatttgaccatccgtcttatttaaaaaaaatataaaaaataaaaaaataagtttatgttttatcatctaatagcaataaaaatactaattataaaaaagttcaaataagacagacaatcagacgttacacataaaagctagcaactgcacctacagtaggatggagggagtattagttaaacaatttagaaaaatagattaatatgagttttttctacaacaactttcttataaaacttttgcaaaaaaaaaaaagaaaaaaactgtttagtagttcagaaactctaggaagtgaaggttgaaatcctttacttgcgatcatagccaaagtagtcgtttatcggttgcaatgtacggacatgttg

SEQ ID NO: 32797 - DNA, 226 bp, Oryza sativa
cgatgtgacggaaaagtgggaagttggtgtgtgtagggaagtttgatgtgatggaaaagttggaagtttgaaaaattattttgaaactaaacatgacgcaaataaattgtagcaaaatccttaatcatccaggatattctttggattctatttaatgtaagttggcataatagttcaacaaatcgattctatcaccatggaaaaaaatgtgtgtttggttcacagg

SEQ ID NO: 32798 - DNA, 1501 bp, Oryza sativa
acactaacaccacataaagtcccaaccacttggtttggtaggccttgctaaaatgtctaatcacttttcaattagattaattcctgcatcgtcatgataaagaccagatctcaccagactctgcagccctgtaattagcattagtcattacttttttttcctgaaatcatttacctcaaataatcttccattgttttccttcatggaataattttgtgttcatgtcgttcaactggtgttatcattagcaagcacagtactacacttaatcatcaattaatgaaacattccatgaactgaaaaaggaacaggctgtgatgctggacatattgggttagcattaaacccactcgagtgattagctttgctttctttgcaagctcaattagttggttaatcgcattcattggggtaaccggtaacctctcaaatctttttcagcaacagaaggcacaagaaaacagtgtccctatattctggcgacacaaaatccatgcaaacacaaaattcatgattgattttgtagtggatcaaccttgccaatttttttgtaaattcgatttttcatgatgtgcaagtggttagctttaattgaagtaaatgttgggtttaatatccgttaaaaaactaggaaacgaataacggtgtaattaaccattaggcagaattgcttcgatattatcttcttagttattatatatctgaaaaattaggaatgaaaattccaagccgacacccaacatatctacaagataggacattgcattcgcatcatttaaaacagagcaacatcatctctccagtacttgcacccatcatccaccacatccatctgatataactctcgatatatctctatctccaacaattaatagataccgcaattaacaaaaatcccaatccaataacccccaccaaaaactaattaatctctgacatccataatgtctgcaattaatcaatctgttaatctgttattagtagttactactaacaattatagagtatattaattaatttaagctaaaaaaatggggcccacaaagcagaggaagagaacccatccatccaaccattcataaaatctatctagaattccaacttaacaccaaatctattggtctcttgtcctcatcaccaaaccccatcttcatcgtcgtcatcttcaacccccatccccatatcttcctttgcctctccttcaagcatcatcaccaagtaaaaagagaaaaagaacccataaatttgaagaattttagcttcattcaagaactcgatcgaggagggccaagaaaggtgtgagaccttgatttggtcgccatgtcgagccccatgcatgttcgcaaggcgatccacttcgtctccatgaaggccaagctccagagcttcggcggcctccgcctcctcctcgtcggctgcctcgccgcgctgctgctgctgttcgccgtcaggacgctgtcgttcacgacgtcgtcggcgacggcgacggcggcgagggagg

SEQ ID NO: 32799 - DNA, 1501 bp, Oryza sativa
gccaggacgcccggggcgggcgccaccgaggtgttcgtccacgacgtcgaccgccacgtcgaggacaccttctccaaggcgttcctctgcgacggctacctcgtcgagcaggtggggcgcatccgccgcttcgtcatccccagccaccgcgacaaggacggcacgccgttctgcccttgatgagagatgagcttcgccttcgccttcgccgcgcacatggacaccgtgatgacaccattgccatcgtcgtcttcttcatcttcttcatcttcttcttcacatatgacaccaccattgctgccgtcatcgtcttcttgaattcacatgtcttttgtgatgatcaaggataagtaggatgatgagtgcacctttgggatcatgcaccaatggaggcggtggcgcgatgcgtgtgagccgtcggatcgagaacggacggttcggatcggaccgtggagatattgttattatatatagtttcttttttttttcaaatgcagctttttctttgttgttttttttatggacggtgggtgagatggatatgcaggcgaattataattcttggctatttttcatagattatcgttgtgtttctttttaattcataattgagatatcatcttcagtgggtgactgatgagtggtgccatttgagattcctatctactgaagcaataatgctaagatagaaacttacataatttgttgagaaatgcagttgatttttagatgattaacaattaatgtggcagaagtgagggtgtgaaattaatactctactcactttaaacagaagagtagagtactagtaccattcaactgcactactactacagtactatctttgcacaagctgatgtgtgagaggagggtgtgacctgattttgattgcctattggaatacctggagtacattgccttttgccaaggctgtgacatgcttggcattttgtaggcaggacattgatttcctggcacatggcccaagtatgatgaactagtaccatgaatatgaagtcaccttgggagatgggcatcaacatatgaactgccgaagacttgacaatcgtcctatgctgtgtagcagcacaaccctttcttctgggcaagtgcatggctctgattcaacaagtgtattttctctttttatatatactagcaacatgtccgtacattgcaaccgataaacgactactttggctatgatcgcaagtaaaggatttcaaccttcacttcctagagtttctgaactactaaacagtttttttcttttttttttttgcaaaagttttataagaaagttgttgtagaaaaaactcatattaatctatttttctaaattgtttaactaatactccctccatcctactgtaggtgcagttgctagcttttatgtgtaacgtctgattgtctgtcttatttgaacttttttataattagtatttttattgctattagatgataaaacataaacttatttttttattttttatattttttt

SEQ ID NO: 32800 - DNA, 361 bp, Oryza sativa
tttctgaatggtttgagaaaatcacgcaaaaaaaacaccgtttataaaaaaaaacaagccgctcattaaaatacaaacattgtcattgacatgactattcatgaaaaacgtatattatcattagaattttttcacccgttgcaacgcacgggtatttttgctagactattaaaaaacagagagtgtatattttttaaaaaaatatagttctctgatagaaaaaaatatagttcactgatagaaaagataaacaaacatcaaaacatgcaattaatatggagaagatacacaaacaacaagtaaaaggaaggacacaaacaccgaaacagtactgtcatcaattacgttgtctagcttgcca

SEQ ID NO: 32801 - DNA, 786 bp, Oryza sativa
cgactatgttgcaactttcatcccattccccaatgcctgccatatttcgcttctcatggcccccaaaagtgggagaaacaatttattagtatactagaaaaatacccgtgcgtttgcagtaggtgaatgctattttaatcttattatgttatatggtttagctgggtaaaattcactatcggcctgtttggttggaggaagtttttagaagggattgggaatttaaagggatgaggctattaagtgttttgtttggttgggagacatgggaattttggtgggatggggatggggaattgaggaagaaactccctccttttcaatacctgagtaggggcgggtaattgggagggaatttctcctttactttgtctaagcaaatctcagccatccatttttattaatgacctaatctccaactaaactccctatcaatttccatcacctctaccaaacaaaatattgggattaaaaatcaaattcccatattaatcccatcatcaattcccttgtgtaaactaccaatccccttccattgagttaccaaacaagccatatgggaattcgcttactttttttaagaaaatcatgagctacaattaggagtccgactttcacctcaaattagcatacggagttttttaaaaagagaaaactcatatgactcattttatatttctaaaagcaagcgagattaaaatcctattcaaacacagatttgtatttccaaaagcaaacgatcttaaaaactaactcaaacacggatggtataccaaaatatcttta

SEQ ID NO: 32802 - DNA, 233 bp, Oryza sativa
tgggattttatctgaatctatcattgaacttaaaacttgggtcaatgggtaaatttgtcttaaaattttaaaaactctggtgccttgtacaatttttgattgcagagcctgtaaaaatgtaggctacacgcagacagccttgtttcctctgggaattcacctgtttgtttgcttgtgtccttactatgtgctccaaaaactatgattcggctaaaagaaattctttttctgca

SEQ ID NO: 32803 - DNA, 1501 bp, Oryza sativa
catgatttatattcataaggtttgacttaaacattatcctaaacgacttctcttacaaaaatattgcaatttctatcctaaacaatgaatctggatacaatggatataggttattcattatcctctatgctaggttataacatttcgggatggagatagcatcgtagaaagacgagtcgaatatttctcagtgtgaattttctacgaaaatcatgagaacgatgtttaaaagatgacattaaaattatgcgagattaactattctggccgtgttcatccggttaggatgtagagtctgaatttttagtccatttaaaaaaattaagaaagaattattggcatcgtgataatgataaggtcatgggcaccatctgaatttaaatctcgacatcaatattgcgcgtgagtagatatataggagtacgtgaggctaggatttttattggtctgtctttatttaagtgtgttaatatctgagagatgcatttaaggcgacgatctaagaagtgtttgggctgagctattcaacggtattcaacggtatgtgatacaagataaaccattaacccatgattaattaaatattaactattataaatttaaaatatatatgtatttaacttttaaaagtaatcaatatataaagtttatgcaaaaatacatatatgtagtcatttctataaattttgatatagaaatttgattttggtataggagtaccaaataacagtttggcaagcatacaagtgagaatgtaacacctcaacagcccaaacaaacagcacccttagaccatctccaaccctccatgtcatctagtttccatgatattaaatacattgccacataagtaaaaatcctatgtggcaagggagttaatgaggagagaggaaaaaaaatgaagaaaccatttctcatggaagaaaccatctctacacaagaaccaagaataaaaacaagatgatatgtggataaaaggagagagaagagagataattggataagaatttaatttgaagacaccatctattgaatacatagtttctacacatagtgtctatatgacatggcaagtatgaaaactactttatagtttctgggttgggaatggccttaggtatgtcgtgtacatgtagcgatttgcgcgccttacgtgggatggaaaataaatcctgatgttagactgtcagcaaacatgataatttcggactagctatttatcgacaacttttccctagtcggtacattccattagggactaactatacatattgataaattttctcttaaaattttattagatgtaaatatattacaatcatactatggccatgtttagttcctccaaaaatttttgacgtatacggacacacatttgaaatactaaacgtagactaataaaaaaaaattacagattccgcctgtaaactgcgagacgaatttattaagcctaattaatccgtcattagtaaatgtttactgtatcaccacattgtcaaat

SEQ ID NO: 32804 - DNA, 1501 bp, Oryza sativa
cgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgcacgttaattacgctcgccgaccgaagcggcgctaccgtatctccgggcgagaccaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgccgacgtggcctggcaccttcggggacgtcgggcccgagggtgaggtgtccgccctcctcctgatttcccccgaggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcagcgcagtacagcgcgttcctttatccggtctgtgaccagtcacagaccggtcagatcacgggttaggtggcgactggcggtctgatgtacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttaagatataaaaggaggaccttgcccatttagaggaggattttttcccttttggaaggctgaggggaaagggagttaatcctttgtaacttgtccatacacaaatccacaaaaacacaggagtagggtattacgcttcgcggcggcccgaacctgtatacatcgccgtgtctcgtgtgtcttgcgggcgggtgatctttccatatacagagagagagagagagcttgagatctcaccctaagcccccggccgaaccggcaaaggggggcctgcgcggtctcccggtgaggagccacgagctccgtcagt

SEQ ID NO: 32805 - DNA, 289 bp, Oryza sativa
ggcgggcaaccgtcagaaaaaccacgttggtaccgtcagaataattatctttgaagacaaaaaaaatataaaactataatacaatccacatgtcaaatggattgctaaacattacttttatcaccacattatgcaactgaacttgtatttttaccaatgtatatatgatctagcaacacatacaacacatcaattctttcatcaaattacttcgcaagtctgggattataatccctccgaacaccccgtgcacaacaaacgtacgctgactaatccctcctaacaccca

SEQ ID NO: 32806 - DNA, 1501 bp, Oryza sativa
aaactggatatctgatgctgatgagataaaagccacaagtggatatgtgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgagagaagagacccttgaaaagggctcattttcatgatgtgcttctcttctttcctgcatggtaggatggcttatgtcttaatgtgatccgagtggcttttccaagcagagatgttgacctgcagaacatcttaaaaggaacacacctatatgagttcgactgctagtcacagtctatgagatttgggtgatctctagatactcatgaaaggcctggagtatgacttataagctccaacccgagggaatactaatggttgcctagtttcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatgactagttgatgacaattagttgctccattcctcttcctattccatgactcttactcttcatcttccattcctcttataaaatgggaatggatttgatctcccgcgagaaaaagaagacacactttcatccattttaaaaagctgttgttgctacggtaatcccatcccga

SEQ ID NO: 32807 - DNA, 246 bp, Oryza sativa
gaacctgtatacatcgccgtgtctcgtgtgtcttgcgggcgggtgatctttccatatacagagagagagagagagcttgagatctcaccctaagcccccggctgaaccggcaaaggggggcctgcgcggtctcccggtgaggagccacgagctccgtcatctggcgcgccaggtagggggctcagtgtgtgttttctgagctctcagactcttccgtgtgcgccaagtttttcttgttcagcctaa

SEQ ID NO: 32808 - DNA, 1501 bp, Oryza sativa
aaagaaatataagaaaaaaatttcagtatattaatggttagaatcttttatcattttaagttggtaagagaatagtctcagattggactaaagaggtcctatatcatgctctacttttaacatgccctttggttctaccttgaatcaatcttgggtcatatttaatcgtccataattgggaaacttggcagaacatggtttaataaaataaatgggaaaatttgaaccattccaaaatttgtgatatgccaccctgacccatatatcattgactcatgtgggtcatacatgtcattgagatacgggtggcatatctcaaattttgaaaaattagagtggtatggttccaacgaacccttaataaattcggtaggatgtccaattcggtaaatagaaagaaaaaaaaatctggcacttgagactcttgacgcgcgctaatttgttcggaaaataccacagctttccacagaacgttgaattgaaaggaccgaaatacccttcaattggggaagtttgttctccttcctcggacgctttctcctccaggaggagagggagggacgagcagcggcgagaagagatgcgcggccgatcgagggcaagaagagagagagagagagatgggattagggcatgggctggtatgtatgttgttgtcaagaaattgagtccacattggagtgtagtatggatcttggacaatcccttgatttgtgttcttcagatgaatttgtgctagtttgttttcttggtttggtgattttggttctgaatctggcattctgactctagggagtacaaagaaaaagaatccaaatgcaaccatctccatgtaatcaaatctagtgtgttttgcatcttctgatttgactactcccggcaatgcctaatcccctcctgttctttctgctagatgattgaccatcgacgacctgtgttagacgagtgacgagccagcgttgaatggagaaggggatggcaggctcaagctcaagctcgcggcgccggtggtatccagcaaagtagactatttttttgggtggtattttccgaattttgcatcctgcatcccacatgtgctatgttaaccgatttttccattcttttttatttatgtgatttaatttcgttggtctgttttaggtgctgagacaaggaaggtgttggttgtatatgacattgttggtgatgtgcttaaaaacttgacagtagtattgcttgcttacatgcattctcaaggtatagttgaattttattggttcagaacataggttcacagtttccatcccactagctaagaaaatgataaatctggagagctgtaaaaatgtttgacctccacattgaaaagtagtgggaatctggtcctctaggcaatcaaccttcaagaaatgaagtatacttcatttggtggtgctggtttcaactctcgaccagtttcaaatgccattggttgcaactattgagaatttgattcctctggcagaactaggaaagaagt

SEQ ID NO: 32809 - DNA, 1501 bp, Oryza sativa
aataccctactcctgtgtttttgtggatttgtgtatggacaagttacaaaggattaactccctttcccctcagccttccaaaagggaaaaaatcctcctctaaatgggcaaggtcctccttttatatcttaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtacatcagaccgccagtcgccacctaacccgtgatctgaccggtctgtgactggtcacagaccggataaaggaacgcgctgtactgcgctgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgacccccccctcgggggaaatcaggaggagggcggacacctcaccctcgggcccgacgtccccgaaggtgccaggccacgtcggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattggtctcgcccggagatacggtagcgccgcttcggtcggcgagcgtaattaacgtgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttcttaatcatctcttcctccaccgcca

SEQ ID NO: 32810 - DNA, 1501 bp, Oryza sativa
caccacttgctggctgggcgctcccggatgggagtaccagcctctttctttttgtcgctcgcaggcctcccctttcgggtggcccgcggagcgccctcgacggcgaggacgtgaccctcgtcgccggaatgggctgaccttttcttcctcctcctgtcacgccgccctgtctgagcggcggatccgggagcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagcgactcatcatcgcctcgctgtactgcatgcaagtccgcttcttcgcctgggcgcggatatgtgccttgaaagttcatggtgaactgttggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggtgccgacgagggagtggtagccgaatggcgtgcagcagccgccgctcgccgcgccctccgtcttgacgacgcggaaccggtagtggcggcgccggaggtcctggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttctcctgcaccacccgcgactggcgatgctgcggatttttcgactctctcgagcgcctccccccgcttgggactttggcgtggaggaggtgggggagtgcgagctcgacggcgtgggtttggctccccgtcgtcgccgctcacactcggagagagatcgtgtgcctttgcttgctcggccattaggctgaacaagaaaaacttggcgcacacggaagagtctgagagctcagaaaacacacactgagccccctacctgg

SEQ ID NO: 32811 - DNA, 383 bp, Oryza sativa
ctaaagtttgataaaaaaaactaaattaatgtacatatttaacaacttaaaaaaagatatgatttaaaatgacatccagctaaacatctgaagctaaatgcatcgttcggtgtgaacctgtatatgttttggccacgatctagaacatggtacctaccccttctattagcaatttagctgctcttcttgtttttttttccttaagttcgtggggagcttggaactttcggagtggtaggtgtatctgaaagtctgagatgtgccacgcctcttttcttctgtcctgtcttcatctcctacctaacccctgcctgcatcaaccctcatatgttgtccttggcgaataaaaacatttccctactcacgctctttcgatcttcagc

SEQ ID NO: 32812 - DNA, 1213 bp, Oryza sativa
gagaacgaacacgtcaacgtacgttgccgcgagaacgtgaacaagaacgagaacgatcgaacgaacgagagcgagaacgagaacaatcgaacgaagacaagcgagaacgagggaacgaacgtgaatgagaacaagcgaacgaacgtgaacgagcgaacgttaacgtgaaatgcaatatatatatatatatatatatatatatatatatatatatatatatatatatatatatatgttacttcgcatttatcctaatacatctttttgtatcttgcagaaaagacgtgttgtcggagtcgtccgtcaagcctgagtggaagagctagccctagaaggaattggaggaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatttacgcacgaaacacttagcatatacatgactattttagtcttagcatgtaatattatttgagttttaatataagataattttatttgtaattagacttagtatataattatttactagctagggttgtataatatacgtcacctagacttagcttatatcacgatttgtaattagacttaccacgtaaggttgtgtagggttctaatgtacgacatttacacttagcatacatgacttagattgttaaaacataaatgtctcgtgacttagcagatgtttcttgtatcaacaga

SEQ ID NO: 32813 - DNA, 272 bp, Oryza sativa
tcattgacaggtgggtccagacaccacatgtcaattgtcattcttacatatgatgttaaattttaactcatttatctctacgatggtatttttccaaattctcttattaaaaagaactcaatccgcaattctacatccagtccttttctccaccgaaactggtgtggaaactggatgagaaaaaacagtatcttcctttgttcccttccatctaataatatttcccatccaacatattctgagtgcagttatgcaatgttgtctgttgcagt

SEQ ID NO: 32814 - DNA, 248 bp, Oryza sativa
tgagtgcaaatttacaccaccggcacactgaaaaattagcgctccatcattccgtgtcgctcgcgtacaagtattcgtatactagcaaatgatcgctcccaagtcccaaaaacatgcagatcgatgcgtcgggaaacacaagctgccagacgcagtagaagtagaagcagtagtggtaggagactggagacggggaggcaaaaaagccccagttccatcccctccatccatctgatcaacctgtcagc

SEQ ID NO: 32815 - DNA, 911 bp, Oryza sativa
ggatctttactcctggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatatatacttagcatatatatgaatgatattattatattggtaaaaactctaattaagatatatatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcatgcgtaattaacatatgccata

SEQ ID NO: 32816 - DNA, 1501 bp, Oryza sativa
gctggtttgtcactccatctatgagagactctatccacctatacttcaaataaaattttatcttaaactactcatccgatctacgatccgattacaccgttgtgttcataacaattaaatatttataacaagatctcacatgattatattttgatgaaaaattataaattatttttataatatatctaaattacttttagatttcactaaattacttcttcgacatataaaagtaaattcaataaagcttaaaagtattttacatatattatagaagtaacttataacaaaaagaaagtaactttaatgcctgccttttttcattggacgtgactgctggtttgtactccaatagtataatagtatgtatctttttttaatctctttaataacttatatcttttaaatcacatattgtttttaagatctatttgcatcattttactccactcaaaatatgtgacaaaacaatattcatattgaaaatattctcattttattaatttaaaagtaatttattacatgttataaagaaactattacatcttatacatggttaattcttattatttattctatcaatgttatttacaatccatcaacggttttatcttcttttctcattctacataaaaaaaaacaaaaatgaaaggaaaaaaacaatcagtgattaaacagatttatagagagttacttctgaaccatgcaaaagttacttctaattaacattgaagttacttttaaaaattgttaaacttacgcgtgttgatctgtgctgattaattttaatatctagataaagttatatttttatccctgcaacgaatttacttctaatgtcattacaaagttacttccgttttgttttaagatacttttataatatatgtaaattacttttagactttattgaatttacttttatatgtctaagaagtaacttagtcaaatctaaaagtaacttatatactatatgataaaagtaacttacgtatataataaaagtaatttacaaatataaatattttttcatcgtaatataatcatgtaagatcttgctgtgaagatttaattataacgaacacaatggtgtaatcggattgtagattagataaataatttgagagaaaactttataagaagaaagaaaaagacatgaatgtctaagaggaaaatcagcatgcacgtcaccacgtgtagcagtacccaaaccgagaggctaattaccatgaactgttcctaacggagtgcgggatacttaacgcgtacgtcgcgatggagggttccgcggctactgacgtgtttacggtggcacgcgacgcgataggcgatagccgataagtaattaataggcaagtagtattaattggctaggtagagtaggcgaggtcgaggaaaatcctcagtagtatagtatatagtactgacgagatcggcccggggaggcacgtgctcgcggcgatcgatcacagatttcattcttgtatacagtacgcgttca

SEQ ID NO: 32817 - DNA, 394 bp, Oryza sativa
taataaatactgcatctcttaatttgagtcaatgatcatgcagtttttcgtcaacttcgaacgaaggttcacaaataagattcaataattgtgagatctttatctagtgttggtgcatattagtttgtgtttgctagtatttgggtgtgcttttatggactttctggtgtgtgctcgttatcgggtaaatttatgtaataattggctgtaactcgttgagtaaaggctgaagttttattccattatctcaaagaaaaaggaaaaacctttcttaattgcaattcattccctttgcagaagctaaaaagaaggaattttcatagaattttttttccgattcctttggtttttccgtggtgcaatgcgcactgatcggttaatctgttaccttcaa

SEQ ID NO: 32818 - DNA, 1501 bp, Oryza sativa
ccgaattcaaatcaattttcgcacgtaactatagagtccgagagagttgcggatccaagcgaaggtcaagacccgaaagactttgagcaaggcaagtcatcactattctttgaacatgttgatcccaattgcgaaattattttgtttacaaataaaattgcatgcaatgataaacatcctacttgtgattatgccatgccttgattattgtttacccttaaaatccttgtaaccatgtttacgtatgagtccctagtcaattatgacaattgcttagaaatgctattttagaatcatgcatactcatatttatcaaatgttatatgcttgggcaattacctttgggaaggtaattgagatgtggcatgtggagacatgagcgccacatttccatgatgttgatgacatgatttgtgaaaggagaaataaaaactaaacaactgttttcgactggggcggctggaggttttgggtggtgtccgaaaaaggctagtgccgtccctggtcagttaaggaccgagccatgaagttaagcatgaaacgacccccgtacaaccgcacttctcgtatgggtatagacctagcggagtagatagctgagcggaggcaatatccatgcgtagtggtcttcttttaggtgtgtgatgcggcaagcagtctgctggcggatgcccgattcggatggccaggtggatggtggatgcccgttccagatggtcagaggctggcttggcaatactacatgaggatacccataagagaacaatcatgatggactgggttcaacgacaagaagcaacgtagcagtgtgtgtttttcccttcccgggagcgccagaactcctctcactgctagaaacgtatgacgcctagagtgcatgaggactaaagttcatggagtgggtactgccaatgcgaggttatcaaaaggctttgccgtgacgcgtctcatgtgttgggacgaggctcatgtgttggacagtcgcggagtgcgggtaaagtgtacatccactgcagtgtgagtaaaccaaatctattcgaatagccgtgctcgcggttattgagcaccgggacatgtattacacttggctagactctaaattcttaatttgtgtgggatgggatattgcatgatgatttctatgctgatggagccacttcctgagaggcgggaatgtggacgtcctcagaaaaccatgacgactcaatggcgggaagctatccttaggatcacaatggatggtggacagaaccgtcattgtttaatatgaacactggtactaaaatttgatcaatctgtgctaggtcttaggcttgtgaaaagaattacaaaacttgctttgcgcaaaagaaccatagccatcctttgaatacccctgtcatgtgtattattgctgtggtggcttgctgagtacggttggtactcacccttgcaatatacaaacttaatcagaggtcggagatgaagcttcggaggatccctacgcttactaccaggaggg

SEQ ID NO: 32819 - DNA, 1501 bp, Oryza sativa
acgttgcctccatgtcgtcgtcgtcggcggcggcggggagggcgtcggtgtagatgtagcggagcagcgcgtcgaacacgtcggggcgcatgtcgtcgatggcgatcggtccgccgccgcggccgctctccctcatctcgccgtacaccgccgccctgaacaccggcgagcgcatggcgaggatgacccggtgcgcggcgaagagctcgccgtcgacggagaacgtcacgtccgcgccctccttggtgtcgtagacgttgccgagctgggccagcatgtccgagggcggcagcacgtcgtcgtcgccgacgccggcgtccggaggcagcggctcgtccgggacgacggtgacgtcgacccggaacacgacggcgtggtcgcggacgaacagtgtcgcctcctcggcgagcatggccttgggccagaccatgatgaccatggggtggtgggggtggtcgaagaggaagggcggcatccgcacgatgacgttgtgggaggcggcgtcgacggggccgaactcgaaggacgccctggccttggcgccggcggtgaggagctcgacgccgaagccgaagaagccggcgaaggtggtggggtggaaccagaggcaccactggtagccgccggcggcgaagggcagggaacggatcgggggcctcgcgcgcggggcgaagccgaaggggtcgccgtagccgaaggcggcgtagaggctgtcgtcggagaccacgatagtccccgtccccgtgaaatagtccatggctcgctcagtcgtcgtcgtcgtcgtcgtcagcggcggcggtggcggtggcggcggcgagcagatccgatcgccgtaatagtagtcgcgcgccgccgtaagcgtcgagatttcgggagtcaaatatatatataagagctcgtgtaatccgtgtttgttacgagagcagcaacgtgagactgacatgtgggaccggatgtgagactgacagatggatttttctttttttttcggtatagtactattcgatggctaactttcacaattatagaaaagtcaatatacaatgcatgttcatgtgcatgtgcactacacacctgtagttatatttgatatttgtaaatggtgtaaattttagtaaagcacaatattacaaggaccaaactatggagagcgctacgcgtcaattcagacgtatatatgaaccgtctgatctgcgcgcacgctgttagccgtcgattaaaagtgtgcacaggacaccctgccttgcggttgcaacgtcccgaacaaaataaacccgttgaccgctagctcgaagtgatcttctcggtggcgcgattggcgctgcgcggcacgactctgccaccagcggttctctctgtcgccggcggaagcacctataaatcaggcgctcgatttttctcctaaatatgtttcattaaaaaaaatagtgaaacacaatcaaatcacgcaataaaacattttactacacggtacaaaatgaaacatgaaacacatccaact

SEQ ID NO: 32820 - DNA, 1501 bp, Oryza sativa
gaaaagaaaaatgaggtgaacagcttggtctgaacttctctagtctgaagaaaaggatgggcaactattttgtcaagagctactcgctagctaccgctgtctctgcttactgactctccgcgatgtgtcgagttttttctgaaagtatccgcgtcactgttcagactattgggctatgcctatgcggaatacaatatagattcagtaggaggatcaattgatcgagtgtgtcaggtttataaaatcaaaacaagtgtgtcaggtgtattgtatattcagggatcatgggggattgcaagtactgatacggtggagggatactaaattagtggtactaacagcagccatgtttgtacttcgagttgagtctttgactgcaattattgaaacatgaaacttggccatggctactgatacagttagttgtgcactttctgaacttaacaatgccaacatggccgtctgattctgcttaggtttgtcccatgttgtcatcggcaactcccttgattcatgaacagaagagatgtcgtggtaaccggtttgatatttctttagtttccagagctgttttcagtgttctatcctgattccatcagttacttctgaaacacactccaaatgtagatcaggcttattcaatatgtcccttttaagttattaaataccgtatgcgttcacctcaatcaattggttgattttagcacaccacagtactattcaacaacattacttttttgcctgttgctgcatcattatatgcaagataaattgatcagtgaatgctgaaatggccaagtttttcaaactgcaactggtaaatataaattgaatcagcagttcagcaccacatcaagtggaatgcattgggatccagatacacccaggatcaacctccaaacaaagtcttcaaaatggtttcagtcattgaatcttttgcagtcaattttttaaacacatttttcctgaagaagggatatttagattttagaagaggcaattcactgattcaccctagggtttacaaaaccgcgtggttaccacgcggttatcacggttaccatgcgcggtaacctttttagtttttgtaaccacggtatgtctcgcggttaccgcgggagtgcgataagcgcgccaaaaacggtaaggggagccctgattcaccttcattaacatgattatggttcatgccaaatgcttagttcaacatgtactttacctacttgcatgttgcagaaaatgtttttgcaggacatgagcaccgtgacagttgggtccttgttttttaatgtttttgcaggacatgagcaccgtgacagttgggtgcttgttaggatgttcgagtacttaacaattaaaaacgcatcacgcttattttccctcttaacagctgagctacttcgaagaacacgggcatctgccctttaaaacgctctaaaaatcacagtaattaagcatccacaagtacgtgacgacgcgggcaaaatctttgacgcgaaca

SEQ ID NO: 32821 - DNA, 1501 bp, Oryza sativa
cacgtgaccatataaacacatacaccatagttagcgtctatcactaaattacaagtacatgtgctaagtttagaaaattaaattaaactcgagtggatagacttcttttttttttttaaaaaaaagaactaacccattaagctgcacccgcttcgtgaaacaaccaaaattatggcatgctttaaaccaaaatgagtttcaagatcgcatttctatatatccattgtctttaaaaaaaagacaaaattatgacaagcttcaaaccaaaattgcccatggagcctagctggggtgattggggtccatgttcattggttgctcaacgtggacatcgaggccaccgcgaagaggtcatatcactgatcatgcaccacccggcgtggctagttagcagcctccatctccatttggccaacaaagtggcagcaatttccgcatgcaagaacgacaactcgagaggagacggcaaaacaatgttagtgaccgttttattggcgttttgttccatcattttctttagcgctgttctagagcttaatttgtgccgtgcatgctagcttaattgattatgataacctagctacgggtgtaaaactgggatctctttataacgattaacgaaggaatgttatgggatattttaatgtttttcaattaagtgtccataaaaatcctgtaaaagttttttcattactccattcgtccaaaagttttaaagcttatttattttctgttttttttctccaaatgagatatgcgtctccatatgcatcaaagacttaaatgaaggacttgtactttttacaatgctaaattaaattgttaactaaaattcaagcaaacattgtaatactagttgcatgaatcatgaatgcatattattttttctttgttatatgtgaaataagttagtttctacttggtctttgtgataaaagaaatatgctataaacttttggttggggggagtatgaataagccctcttataattcgactaattaatcagagggcttttgctgcattacacttagttatggataacttcaatcagcatttaaacatgtgtagaattatatggcatccatctcagcgtaacatcttataactgactaattacaatctaccttctttatttccattttttttcatgaaatgtatagcatttagatataaattaatttcatagagccattgaaggtttgaatattcttttaaaaaatgccatggaaatattttggttgctctaggaacgaattgtgctctagaagagagcgaagacaacgatgcctaaaacagtgtcaattgaaatttgtttatcgtagctgttagtttgtactacgttactctatccaccagtactgttcacatcagagttcaaatcgtagtgtccaaaaatatggttgccactacatttggttcccctatgcgagatggatctgtatcaaacatccaaatttcccacgaatattttgcgagtttcaaaatttgaattcctttttc

SEQ ID NO: 32822 - DNA, 1501 bp, Oryza sativa
gatcctgtgctcgggatagtggttttcacgcgctattgtgtagtagcaatatgcgccatctactcgttatcaccattttacctagtatattgcttcttggtaggcgcattggtagtgatattgactgtagtttaggagatgcgatgtgtttctcttccagaactgacattgtttgtatgagtcacagtagaatcgtattatacttgctactatcctatttctgctctgttgccatctacctgctggttatgtgttggctgcatgtaagctactgatcaagctcgtaatgggtttattctgcgaattccaggcgagatagaagcatgatggcaaagaccctgcaagggactcaacagcaatatgcagcaagtggatttcctacccagcaataccccacaagtggctggacacaatctgcagctgaaattcttcagttggataatatggatcaagatacatccgtagttcgcaatattattcaccgtaaaatgtaagttcttaaaccaccaatattgggattagctttgactcgcagattactagttgctttatactagcatgccgtaccaacaaagtatacactgtacatatgttttctgcaactttagttgaacatttcaaaaactgcaatgctactggcacgattttatctaaaatctgtgactgctagtgaccagtctgtctgataacatcacgtgcttttggtggcttgttgcaacttaagttgtagcaaaccgataacttattgcagttattatctcttgttcaactatatcctgattcttttttcttatccagtgtagagtacctaaatgagcggaaggaattctgcaactttgacctatcctttcttatggaaattggaaaatgtattgaccgacatctttttgagaaagctgattcaaaggtttgtgttgtctcttgctgcattagaactattataggatatatgatcacctatggtgctttaatttggtgtggtttctactctaatattggacaatattgaacttatctacatgctttattgaataaatacaaaattcagcatattcttgtaatccttaaacagaattgttactgctgaacagtttggtgtacttagaagttgattatttggattcatttatctaaatagttctcagtcacttgctaacatctgattctctctcagattaagtatatggatcttgaaactttaagaaccaggttgaatgctatcgtcaattctgcatcatttcggggtagtatgtttcattggagtgcttcagcagcttcatccaaactaaactcacaacagctgcctgtgatggaggtgcccatctaccatgatagagttactcctggacctaataatctgccctcctgtgcatataatgtatcctccactcagggtgagttgagatgatgagttacctattttaacctcacaatacaccttaatttttttaattctttattggcttgattttggcaggatataaccaatatgaaaactgta

SEQ ID NO: 32823 - DNA, 625 bp, Oryza sativa
cggcccgccctagtgcccttgccgtgcctgccgctggccaccggtatcgcctactcctaccatgcccaacgttggccaacagttcaccgttcgccaccaacttcaccaccgtaggccgcagcatcaaaatccaattgataagtcaagtcccgttggtcccctctttcaattttgctagaccatccataacccatgattattgattaagttagtgtttgttgcttgcattgaacggaggggagtaggatgacagcaagtggctagttataagatggtttcttcattatggtacgcatatttttaatttttctatgtattttcttgttatatattgccatcaattagagatatgatgcttatatgtattgggtacacaactatttagtacaatatcactttagaattatacataccggtattacacagagaaagtcaggaaccccctcatcttttctctagctccgtccctgtgtaaaagtattgttcatgtgttaatgtaatgtgctgtagcgatcgatcccgtgcgctcgctgtaaatcgggcggctgagattaccctaaagtcaccgcactgtgcttctctgacttcactgtgtaaagtaagatgatctcaatctctttacaga

SEQ ID NO: 32824 - DNA, 1501 bp, Oryza sativa
gtacagaacaattaggagactattagttactatctcagttacaattacagaacgtctgaaccacggttttgagcagccgcagaataattctagcaaacttttggcccaccgtttcatattataaaccgtttaactttttttcctaatcaaactttgttaagtttgataaagcttatagaaaaaattatcagcatctaaaatataaattagttttattaattctaacgttgaatcaattttgataatatgtttgttttgtgttgaaaatacacaagtgtgaggattattccaacaataagctggtaattagtaatccgtacagattgaaaggctacagcgctgcatgcatgcttgctcctttcatatgatcttgaatattcatactctgattcataaaactgcatgctagacagttatcgctgtctaataagtaataatgcaagtgcaaaagtattcaaagatccatctaaaaaaaaggacgaagtgcgagggacttttagtactatgattgtgtactgatgctagcaccaaggctggtttatttcatcatggaaacatcaactgcatgtagagcatatcctcatttagttggtgttagtggctaccatagttatgaagtctgaaaattagcgaatgtaatatgtactggtgcaaccgtataatagaattaatgtactgttgcaacttgcaactgctgggggtttgaagcttgatttcacgtgacaaatatagcatttacctgatttgggtttttgttaacatttttacagatgactagttcctcgcaaactatcaaatactataaattagcaccctttttttatcaactagcattgcttgtgttagcttgcaggatcaaataagatcgactgtttgaactttctgtatgacaaattgatgaaatattgtcataaaccacgtgtttatgacaaacagttcatcgattaatgtcttgttcacggcattcctcaactgtgtgtgctggctgatgcgtgctaaatctcatataagatggggatttgttcgaggttagagaacctgattagtgataaaccgataacttggggcagccgtccaagcctattgttacagagtactactgctgatggtgagcctgaaaaacacggtagtacagtaccaacgtctctatttggagcggaggcaaatgtagcagccgcacaagacgcttggcctcttccacggcttgcgcgctgccgcggcgcgatgtagcggccggaacgcgcgcacggccacttccgatgattcgttcgcgtgggagtagtactggtactagtgtgccgtgtgcccgtgcggctgtgaatcgcgatcggtgggaagtgcacgcgcggtggcttagcttcactccattttttgccatacacggaccgcaccacatcgtccgtcacaaacggcatctgccaactggcggcctggcgcaccgtgcaatctccggccgcgacaagtcgagcataggaaacaaggcaacaagcgtaacattctt

SEQ ID NO: 32825 - DNA, 450 bp, Oryza sativa
catacactttatgttactattattagttaacatagaataattgaacataaatatttctaatgcatataatctgatcatatacaaattcacaatttcaaagaccacaactcaaatttaaatttaaaacttttaaatatggaatgacaaaatacgagtagcaaatgtttaagacaccacatagttcatagttatttgaagtctatccaagcaacaacatggcgtcggtagaggatgtcataggggacaaataaaagagttgcggcggactaggacggaggagctcgaaggctaatgtggaacctggttgcaacacaacatctagggagcttgaagataaggacaacgaagattggggatgacaatgaaccatcgatctattcttctagcatgcatcgacgaaagaggggtgaaggggcaatagtgaggatgttggacggtggggcggcagca

SEQ ID NO: 32826 - DNA, 1501 bp, Oryza sativa
gggaaataagtgtttaatgcaggcttcaaagaaaggctgttgtttttgcaattgattttatttgaactcttttctaaaaacaactaagtgagtgcttctcaaacaacacggttgagacagtgcgtctcgtccggtcggagtttgtgcaatgtatcagtctttagaattgaatcaaggttggcacccggccaacagcttttcaaacggccacccgggccaacaactttcaaacggccacccgggcctagctgatcccatcagctgcagatttttcaaacatcgaacccctttccacaacagcaatttcacaagcagtagtcaaacaaaactgtgctaggaatcacctcacatccgcccatgaccgtgggcacggctgttcgaacagtttgttaacctctgaagaggaggtacactttacccacacgacattactaacccggatcacccagcccgtggggatcagccacgtcgggagacctccaagctttcatgacaaggcatttctaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttacgtttggatgaaattccaaggaaacggtccttaagtgcgagagcgggaaaccgtacacccggtaagttccccggtccgcggttttcgaaatttatttagttcgcaagcaccgacccaggtgtcgggttttccaagtcttttgtaaaacccaagttttacccaagttgttattcagattttaagtttgaaggcgtccgtcgatattcgcacagggtgcacgaatatcgagacgcaactagatggttacaaggggacatgactataacaattaacaaaggaaggatcaaatgcaataaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgaccctcgaaatcctcgcactgcgggtcttcgggctccgaaactacacgcaaaacgggacaactcaacaaccggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttatttaaacccttttggaaaaagaaaaggaagagggaggggaagtagacttccctcgggcggctagggcgcggcccgagagaaaaggggcggctcggccgagctaaa

SEQ ID NO: 32827 - DNA, 173 bp, Oryza sativa
cggtcgtgtttcttaacaactgaactatctagtttaattttcgtaaaaaaggaaaaccaagtgcattttcgtttgctaattaattactgcccaccttttctacccctgtttacagcatactattagctctcctgtgaaagagaagaattgagaggtttctttaacatcaagga

SEQ ID NO: 32828 - DNA, 1501 bp, Oryza sativa
gttggctcgactcccctcgtcccgcgcaacttcccggtgtgctcgctttcgcctagatcgccgtgtttcgcttcgccgcttgccaccgccgtccgccgtccgttccggccggcgtcttcttcaacctcccgccggcccgcgtggctgccacgtaggcgccacgtcggcgccacctcgaccgtgaccggatcagctgacccggccagccgctccctccgtttcccctccctcgcgcgcgcggtccaccgcgagctgtgaggctgcgcgtgggcccgccgcatccgcgtcctccgcgaaccgcgcgcgtgcaccgcgtccctcccccaaaccctggcgcgcgccgcgtgcgcgttccgcacggtgaaccgtgtcaccgacaagcgggtcccactcgggaccacgcgaggtgagcccagtccaccggctccctctctcctcccctcccgcgcgcgcgctctgggccgccttcttgggccgaccggcccatttagctcggccgagccgccccttttctctcgggccgcgccctagccgcccgagggaagtctacttcccctccctcttccttttctttttccaaaagggtttaaataaatcctttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccggttgttgagttgtcccgttttgcgtgtagtttcggagcccgaagacccgcagtgcgaggatttcgagggtcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttattgcatttgatccttcctttgttaattgttatagtcatgtccccttgtaaccatctagttgcgtctcgatattcgtgcaccctgtgcgaatatcgacggacgccttcaaacttaaaatctgaataacaacttgggtaaaacttgggttttacaaaagacttggaaaacccgacacctgggtcggtgcttgcgaactaaataaatttcgaaaaccgcggaccggggaacttaccgggtgtacggtttcccgctctcgcacttaaggaccgtttccttggaatttcatccaaacgtaagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttagaaatgccttgtcatgaa

SEQ ID NO: 32829 - DNA, 270 bp, Oryza sativa
gcttggagtcctactaaacgggcctaagaatccggataagaatattgatcattcgagagctagaaatttttggagaaactgtggccgctaaaatctcgtccagatagtgcctatagtaacctgccaaataaagtattgtagagaatctcatccggctgtcaaggccatctggccatgcataccaaatcttttctcaacagcaaaccaatatacggagtatagtaagtactagggtcttataagagtcgatactcgctcttgctgccgcca

SEQ ID NO: 32830 - DNA, 1163 bp, Oryza sativa
ctttggtgagggtggtatgacaacctatccttgtttggttggtggaatacgatctaaggtgtcatggatatgttgttttctaataacaatacaatattattgattttaaatgtctataaaacttttcaagaataccagatttagtatctctaaccattaggatgtaacaagattcaagtcttcatggtctacggtcatgatctaaccttgttaatctcacattcgataaatttaagttctaggatagcaagtaaggcagttgggaaaataaggataaagttggcaatatttgttctgcaggtgctaattagtcatatgcaatctaatccaaggtgttctaggaatatttgtcgagtcatattggatgcatcgggatggtctcattatgtgcatccataaacttgggtcgttgtagaaaacgggatgctagatggcatgtatagcaataacttttctttttctcaaaaaggcaaggatgtatgctatgatatcatgatgaatgaaatgatgcgatgcatgtatgaaatgatgcgatgcatgtataaaatgatacaatgcttatgaagatattttgtattgcatacatgccatagaacaattctccttatctagtggatcatcttagagaagttttcaaaacttaaaagtcaagttcccaaaccatgtttgtgagttgttgcgatgtacaaatattgcatccgaccgtaaaggggcacaaaatttgcaccctgagccatctcaacttaaattacatagtttgcttacgacttgttcctagtatgatatttccatttaggcttgtgggggcttgcaatggttacatgttttgtctctgggtttgtaaggtcatggcactctatcccccttaaaataaaataaaattctgcaatggggtttatcaagaaattttaatggatgagctaaataggtctatgtgccatatgatgtactatccagtcccgatacgcaaactgaagcaaaagactatggtagatgggtgataagttagaaaaaaatttatattcatgatcctaacaaagttttctccaatctgagaaggaatggtgattttttgggcaaatagattattttggagaaattggtcaaaacaagtgatgcagtgctggcatttactggtctactatctttacctaatttttagg

SEQ ID NO: 32831 - DNA, 304 bp, Oryza sativa
tctgaacgaggaagctcttcctgaaaggctttttcctccacgcttagattttcattcagattctgttgctaccagggtttacatttccgacaggatttcgcgaaattttgatgtttcgatgaggctcgaaagtataaaccgtttaagatttcgagaagtttcatccaaattcaaatttgaattcataaaaaaaaataaaatcaaataaaatcttataaatactatgatattcatataacttattgagatataaattttcgaaaaacattatgtattatgtgtatttactgaaacttacatcaga

SEQ ID NO: 32832 - DNA, 154 bp, Oryza sativa
aatttgcgcagagcgcacgagctgtcacgtcgcgtcatccgtaaccgacgctgggtcaatgggagagcccgtcccgctgttccggcgagaccacggtccggcttttaaccgctcaagtcaatcccgcattcaataaagtacagcgtcaggtata

SEQ ID NO: 32833 - DNA, 169 bp, Oryza sativa
gaaatactacccaatcaagaaatggaaccctagaacatgtgagtatgggtacagccgtacaggaccactattacccataagtaaaactggtaaccaactggttactacccttgttatcaagcccgtacatctagtcacgactagtcatcagctagtcggccagggagca

SEQ ID NO: 32834 - DNA, 1501 bp, Oryza sativa
ttaacagaaggagatgtggttgcacaccgggaggggaggagacgtcgcgccatgcttacgacttgagataaaggtaatggcaaaacagaatcatgctcaaagatataattaatgtgccctaatacattgcattcgatatatgaaactgaacatttgtacatgcaagcttaataaatattgaatgggcacaggaagaaagtaccatcgacatgcgctatcaaactaatttgtcgcaatgcacgggtattttttctagttaatataaacaagagataattgattaaacaattacgattaagcctgttgtcaattagtcgtgcccactactaccatgacagttaagaagcctgttgactgttgtcaatcaggatggcatgcatctcagtcagtcctcctcgaacaggatgccactcatgttcagcttggcaaatagttcattggagagagcctgggctgcttccagatcggcgaagtaggtgccatcgaccatgtagcagccgttctcgtcgacctcgtcacggaccttggcctggaacacggcgaactcatcgtccttcttgtcgaggaaggcggacagctcctcgcgctgcgcacggaccttggcctcgaacgcggcgaagccatcgtcgtcgtcctggttgcgatgctccggcgagaggaggaactccgagtggtcgtcggagctcggccatggtcccatcctcgtccatgagaggatgtagtcgagcaagacctgcggcatcggcaccttcttgctcactacaggaggcttcttctcgacgttgtctccacctcctccggccccggcgaaagctttagccgcgggcatcagggtcgtcgtcgcaccctccttggtctccatgtgctcgatgcgctgctgctccgcctgaccggccgccgcgattcgccttgccgcccttgcttggagacgtcgaggcgtacggatgcttggggaattgtgggaagaagaggaagcagcggcgggctccgatttatagaggatgcaaaccctatcctagtagtcggagtcggaatccgactcaggctcgggtctcgttctatgtgggccaggcccagcctgcgctccaaacgatgaggaataagttcacttaaggtccctcatcttaatgcaaacttcaaattacgttattcccgtaatactagatataacacgtttctcaacttacaaaaccggtgtactcgagatcccaagtaggaatgacaatgggacggttcgggctggaacgacccagcccccgctgtggagattatgggtaccccatacccacacggcatggttatccgactagttataggggataacttatatctatgtaatatgtaacagatcatgacttgggtgttacgtttccttgtatattacggaacggcctaaagtcctgatttagaaaaccgataccgtattggttaaggtttctatcttgtaatcctgccccccatcctatataaggtgggcaggaggccctctagggggcatata

SEQ ID NO: 32835 - DNA, 203 bp, Oryza sativa
tgcttcaagtaagccgatgccacacgccgccgggtagtccaccttcatccattgtcgtccagtcagaactagccgaccagacgcgagctgaaaggatatgcttcgtcgaattcctaagcctctgctgcccatagggccgctgccaacattgtaatcctcctccgcctctcggacttctagcccgccgccacctctatcgggac

SEQ ID NO: 32836 - DNA, 1501 bp, Oryza sativa
ggatggcataatagggttgcatttgcaaaagcagcatttagcaaacctttgagaatttgataaaacagttaagtaattaaacaatattaatccaacgctatacaacatgccctgttgtataggcccaaccattctgaacaaccaccccgctgcacagttctatctccaaaccaggaatgtaccattccaaaccaggagctaaacaaattattaccagtttaagcatctcttacaatgatgagaggtgtgagactaatcacgaaagacattgttagacccgcccataaccgcgggcacggctattcgaatagttttactttggccagaggtgtacactgtacccacaagacacaaccccacatcatgtcaccatgtgcctcaataccaccacggtacctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcattaaataatagtgagtcattagttatcccgaatgtgtactaatgtttctaagcagggctaagcaattatatctaatatctagttgaaccaatataaataaagctcaactagtcaaattataataacccatggtatcaaggaataaggtaatcaagaacaaaagggctataacaaacaataggttaattccacccaatgacatcgaaaataaatgcaatagttgaaaagaaacaatagctttaaataggatcaacatgctcaaagggttgtttgggatctgtgtgacttgccttgctggccttggaattcttcaaactcttcttctgcgaaaacggactctccggaaacgacagaatctaagcagaaaagagcaaaatcaccaaaacagcacataaacaagcatgaacagtacatgtggatatttttaatgtgtagatctcaattttagaaaaaattagagacttgaaccgactaaatcggagctaagatgaattagttatgaatttttaaagattaaaccggattaaaacacttaaatcggtttaaattgaattacgacgcaataatgaattatttttgaaaaggaaaaggggatttattgcgtcagcggctagggtttgggtggaccgggcgcacgggcggcggttcacgcgaacggacggccgagatcgatccatccaaaacggacggccgagatcgatcgggtccacggcggctcacggcggacgaccccga

SEQ ID NO: 32837 - DNA, 1501 bp, Oryza sativa
cgttcgcgtgaaccgccgcccgtgcgcccggtccacccaaaccctagccgctgacgcaataaatccccttttccttttcaaaaataattcattattgcgtcgtaattcaatttaaaccgatttaagtgttttaatccggtttaatctttaaaaattcataactaattcatcttagctccgatttagtcggttcaagtctctaattttttctaaaattgagatctacacattaaaaatatccacatgtactgttcatgcttgtttatgtgctgttttggtgattttgctcttttctgcttagattctgtcgtttccggagagtccgttttcgcagaagaagagtttgaagaattccaaggccagcaaggcaagtcacacagatcccaaacaaccctttgagcatgttgatcctatttaaagctattgtttcttttcaactattgcatttattttcgatgtcattgggtggaattaacctattgtttgttatagcccttttgttcttgattaccttattccttgataccatgggttattataatttgactagttgagctttatttatattggttcaactagatattagatataattgcttagccctgcttagaaacattagtacacattcgggataactaatgactcactattatttaatgatggcttattgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtgtacacctctggccaaagtaaaactattcgaatagccgtgcccgcggttatgggcgggtctaacaatgtctttcgtgattagtctcacacctctcatcattgtaagagatgcttaaactggtaataatttgtttagctcctggtttggaatggtacattcctggtttggagatagaactgtgcagcggggtggttgttcagaatggttgggcctatacaacagggcatgttgtatagcgttggattaatattgtttaattacttaactgttttatcaaattctcaaaggtttgctaaatgctgcttttgcaaatgcaaccctattatgccatcctttgttatcctgtgcacttgcatatttgctgcgtggcttgctgagtatgtcatatactcaccttgcaatcattcatca

SEQ ID NO: 32838 - DNA, 1501 bp, Oryza sativa
cacagcgggggctgggtcgttccagcccgaaccgtcccattgtcattcctacttgggatctcgagtacaccggttttgtaagttgagaaacgtgttatatctagtattacgggaataacgtaatttgaagtttgcattaagatgagggaccttaagtgaacttattcctcatcgtttggagcgcaggctgggcctggcccacatagaacgagacccgagcctgagtcggattccgactccgactactaggatagggtttgcatcctctataaatcggagcccgccgctgcttcctcttcttcccacaattccccaagcatccgtacgcctcgacgtctccaagcaagggcggcaaggcgaatcgcggcggccggtcaggcggagcagcagcgcatcgagcacatggagaccaaggagggtgcgacgacgaccctgatgcccgcggctaaagctttcgccggggccggaggaggtggagacaacgtcgagaagaagcctcctgtagtgagcaagaaggtgccgatgccgcaggtcttgctcgactacatcctctcatggacgaggatgggaccatggccgagctccgacgaccactcggagttcctcctctcgccggagcatcgcaaccaggacgacgacgatggcttcgccgcgttcgaggccaaggtccgtgcgcagcgcgaggagctgtccgccttcctcgacaagaaggacgatgagttcgccgtgttccaggccaaggtccgtgacgaggtcgacgagaacggctgctacatggtcgatggcacctacttcgccgatctggaagcagcccaggctctctccaatgaactatttgccaagctgaacatgagtggcatcctgttcgaggaggactgactgagatgcatgccatcctgattgacaacagtcaacaggcttcttaactgtcatggtagtagtgggcacgactaattgacaacaggcttaatcgtaattgtttaatcaattatctcttgtttatattaactagaaaaaatacccgtgcattgcgacaaattagtttgatagcgcatgtcgatggtactttcttcctgtgcccattcaatatttattaagcttgcatgtacaaatgttcagtttcatatatcgaatgcaatgtattagggcacattaattatatctttgagcatgattctgttttgccattacctttatctcaagtcgtaagcatggcgcgacgtctcctcccctcccggtgtgcaaccacatctccttctgttaatttttcatatatatatatatatatatatatatatatatatatatatatatatatatatatatatatatatatatatatatattttctactggtttgctgaaatgcaaattagtatttttgttttaggattgttatacttaccctcgcaatatggtagataattggataggcaatatggtagacaagcagttttgtgcaacttatccttattgattgtggttattgttccaaatctgc

SEQ ID NO: 32839 - DNA, 170 bp, Oryza sativa
tgcaataaatcatggttggtcatccatggcaaagagccaaacatgaacaactcttctgcttatacagtggatttgatttgatttgattcactcagatgttgccatttcgtcctgttcattttccttttatatatcacatgtgttctcttctttgggcccatcatatcagg

SEQ ID NO: 32840 - DNA, 1501 bp, Oryza sativa
ccggctcactctaaggctgtgttcggtagcctgtgttgggaacacatatcctatgcatagaaaacggagcattgtattagcgtgtgattaattaatattagtttattttttaaaaaatagataaatatgattttttttaagaaacttttatctagaaactttttgcaaaaaacgtatcgtttaggagtttgaaaaaacgtgcgcacagaacacgagggagttgtgttgggaacatagggtaccaaactaattaagcctaagccggcaccggcaagcactgcacccatgactgacgcgagtgacgcaatgatatacaacgctggaacccttgaccttgcacctgaaggccctctcggtgctagccaaccaagtcatactagctagtttcttgacagagttatatacaagtcacatatgagttatactatagtattacagtgtaactgtactatagttacactacagttacattcgaaagatttcaaagggattttttttgtcgaaagttatatagttatttctttttttttctgttgtgccaaaaacaaggttgttaactcgcgatgttgaattggaatcggtattacaaaatcgtatacatgaaaatcgtaggttccatctatagagaatcgtagaatcgagtatcttaattaggacaacaacaagtatttgggagcaccatattttacagtggaaaattgggagacgactctgcgtcggacgtccgatatttcatcaaatatcggacgcccaactgtttacacgtcattacaccacctacgtatgcagcatgcaaaaaagaatcggtcagttaaatgttccagttaactaacgagtgaaacatcaagttatatagggtgaaaccaaaaatcagtaactgaaacatttaaaaaaattatgaaacatgatgaagatacacgttgaaacatatcgctatcacaaatgaaacaaccaatgttaatggattgaaacatatgtttttctttcatcaaaatataatcatgtgatatcttgttataaaatttaattacaaagaatacaacggtgtgatcggatcgtagattgaataattagtttaagagaaaaatcgttttgaaactagctaacagttattttgtgaattttgtgaaacacgctaaagacacatattgaaacatgtccctatcacgtatgaaacaaaaagtgttaatggattgaaacatatgattatattttatcgaaatataatcatgcgacatcttgttgtaaagatttaattataatgaatacaacggtatgatcggattgtacattagataaataatttaagagaaaattcgttttaaatatcgttaaaggtgcatgttatatggttggagatgtgtatgtgtgtcagaggatgttgtccgatttttctccttgcttcggacgttcgacgagaagcattatccagaaaattgagtatgttcccatacctcatgtacggagctttctaaatatacctctttggtacttcctaaaa

SEQ ID NO: 32841 - DNA, 1501 bp, Oryza sativa
gaacctacgattttcatgtatacgattttgtaataccgattccaattcaacatcgcgagttaacaaccttgtttttggcacaacagaaaaaaaaagaaataactatataactttcgacaaaaaaaatccctttgaaatctttcgaatgtaactgtagtgtaactatagtacagttacactgtaatactatagtataactcatatgtgacttgtatataactctgtcaagaaactagctagtatgacttggttggctagcaccgagagggccttcaggtgcaaggtcaagggttccagcgttgtatatcattgcgtcactcgcgtcagtcatgggtgcagtgcttgccggtgccggcttaggcttaattagtttggtaccctatgttcccaacacaactccctcgtgttctgtgcgcacgttttttcaaactcctaaacgatacgttttttgcaaaaagtttctagataaaagtttcttaaaaaaaatcatatttatctattttttaaaaaataaactaatattaattaatcacacgctaatacaatgctccgttttctatgcataggatatgtgttcccaacacaggctaccgaacacagccttagagtgagccggcgcatgagcagagcaggcaaccaggatagctgcccattgcaagtttgatttttgaacaccaaagaagctaaggaatacatggccggtcctaaacttgtgtggtggtgtcacttaggtctgtgaatttgaaaattgcacatttagatccgtgaacttggtttaatgtaccaccctggtccaaacgttctttgactgcgttcgactgctaacatggcatgccacatagacaatacttttgctttcaacaccctccatatcataacacatcgcatatatctccttgtagctatacagtgacactagaatccccaaaaaaaatcctcaagtcgttcttccctctcattcttctccttgcatgtatagaaaatacggcccctgttagcaattgccattgctctgcgctccaaaatgactttatccttgcacaacgggcacttgatcaacaacaccttttcccaacgacttcaaaacgaggacgagcttggagaatctatggggatgcctagcatgcaagacgcattacgctgcctcccgccgctaatccggtcgcactatgccaccgctaaccccgttgcattccgttgtatcctgctgctaatctcaccgccgaggacgccacagccgctacctcttagcctccttccgctaatctcaccgtcgaaaccctagccgattttagtgatattgaaatgcactggttagggcaagttatgtgcgaaggtatatatggagggggctgatcacaaaagtgttgcctagtggtatgccactttggcggtcaaacgtggtcaaagaatggttggaccgagctagggtggtacattaaaccaagttcacggatctaaagatgcaatttttaagttcatggacctaagtgacaccacc

SEQ ID NO: 32842 - DNA, 719 bp, Oryza sativa
ttttcccgtatgtgtcaccttgattttgcgctcagtagtaaggccgcaatagtagattagtagttcatatgatgtgcttgaagtcatggttcaatctacagctgttactccctctgggctgataatacttgtcgttttggataagggtgaggtcaaactttagaatctttgattatgaattatttttaaaatatttgtctttcaaatatggtgactacatgtataaattagtcttaaaaagtactttaataatatcatatatttgttaacacttttatacatattataatagaaaataatggtcaaaattgttttttggagaccgtgcccttgtccaaaacgacaagtattatcaacccggagggagtagttctcaacttttttcaaagattatgttgatttagatcttactcgttttattaaatgtgacctagctacccaaatgatcgcaagagcttttttacaatataagatttagttaatttttacttctttacgcttacaaaatcatgaaacttttatttacttgacatatttgagtagattttacaaatggtggagtaaaacaatctaaaaaaagagtagcattcctatgccaaacaacattaccattagcggctaaattgttgtactataacctcttggactacgatttcagatgcaccattctttcctttttgtatacaatttttatctgacaaatatactgtttacttcta

SEQ ID NO: 32843 - DNA, 1501 bp, Oryza sativa
caggagtactcagcaagccatgggaaacaagtgtttaatgcaggcttcaaagaaaggctgttgtttttacgattgattttatttaaactcttttctgaaacaactaagggagtgcttctcaaacgacacggatgagacagtgcgtctcgtccggtcggagtatgtgcaatgattcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaaactacgataggaatcacctcacatccgcccatgaccgtgggcacggctgttcgaaaagttttaataacctctgcagagggggtacacttttcccacacgacattactaacccggatcatccagcccgtgcagaacggccacgactagagaccttaaggctttcatgacaaggcatttcgaaagccgacacaggttcaccatatgccaacgagagggatcccagaccaacaccagattatgtcccagaccatactgtgccaggaagcccaggggtcctccccgacaccaccccggcgaatccacatgtctcttggcatcatggctcccccgataagctagttactcagccaggggtgtcccattccacccatgtggtcgtacttgtcttatgttcgaatgaaattccaaggaaacggtccttaagtgcaagagcgggaaaccgtacacccggtacgttcctcggtccgcgattttggaaattcatttagttcgcaagcaccgacccaggtgtcgggttttccaagtcttttgtaaaacccaagttttacccaagaagtttctcagattttaagtttgaaggcgaccgtcgatacccgtgcagagtgcacgattaccgaggcgcaactaggtggatacaagggaacatggtgtaacaattacaatggaagggtcaaatgcaacaaaataggtaggtccgccaatctgccttgcagaggggacaagcagattaagtgcgatcctatcaatgcataatatttttcaagcaatataattaagttcaaatataggctcaagatgttcaaaggtggcttgcctcgctcgagatcttgagcttgatcctcgaaatcctcgtactacgggtcttcgggctccgaaactacacgcgaaacgggacaactcagcaaacggcgaaaataaagccttattattgacctctaagcgtgccattagatagatctcgagatttgaggaattttggaagttgaacggagtcaaacggacttacggttggggagatattgaatttctaagattattggatttttggtctaaaggaaaaggatttatttaaatcctttttgaaaaagaaaagaaaagaaaagaaggagggagggaaattagacttccctcgggcggctagggcacggcccgagagaatggggcggctcggccgaccttaa

SEQ ID NO: 32844 - DNA, 528 bp, Oryza sativa
cagtgctgataattggcccaatgtgaaagacagatgattcgtaggcagaataagtttatttttcctccctcatgtcttgctctagtcgaatcgcatccctcaagcataaaactaggtataatggtctccctcaatttcaaaaaccggtacaaatcgacttctttctgtgggtttgggaaacgatttatgcttatgtgataggttgacttggtcccctgttctaacaaggtaacccattcattaaagaggttaaaaatagaagtgggatccatatctaagtgataagagtaaaattttttaaaaaatacagtgggacctacttttcagcctactcctctctcgagccccaaacagcggcacctccatgtgttgctctggcgtcgcctctactggaggggtccgtcactgcgccagaggacgcggtcgacgggtagaagtgggcagtgatgggcctgacacatagaaggaacacctccatcgagagcgtgatctcgttgacctctggtgacgcatctggttcctcccaga

SEQ ID NO: 32845 - DNA, 1501 bp, Oryza sativa
cccttgtatccacctagttgcgcctcggtaatcgtgcactctgcacgggtatcgacggtcgccttcaaacttaaaatctgagaaacttcttgggtaaaacttgggttttacaaaagacttggaaaacccgacacctgggtcggtgcttgcgaactaaatgaatttccaaaatcgcggaccgaggaacgtaccgggtgtacggtttcccgctcttgcacttaaggaccgtttccttggaatttcattcgaacataagacaagtacgaccacatgggtggaatgggacacccctggctgagtaactagcttatcgggggagccatgatgccaagagacatgtggattcgccggggtggtgtcggggaggacccctgggcttcctggcacagtatggtctgggacataatctggtgttggtctgggatccctctcgttggcatatggtgaacctgtgtcggctttcgaaatgccttgtcatgaaagccttaaggtctctagtcgtggccgttctgcacgggctggatgatccgggttagtaatgtcgtgtgggaaaagtgtaccccctctgcagaggttattaaaacttttcgaacagccgtgcccacggtcatgggcggatgtgaggtgattcctatcgtagtttttgtttgactactgccttgtgaaatttgctgttgtggaatgggtttgatgtttggaaaatctgcggctgatgggatcagccaggcccgggtggccgtttgaaagctgttggccgggtgccaatcttgatcaattcaaaagactgaatcattgcacatactccgaccggacgagacgcactgtctcatccgtgtcgtttgagaagcactcccttagttgtttcagaaaagagtttaaataaaatcaatcgtaaaaacaacagcctttctttgaagcctgcattaaacacttgtttcccatggcttgctgagtactcctgtactcacccttgctctatataaataattccccccagttgctgaagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgctgcccagcatgactgtactcctactctataataaagagacctctgttgttgtgatattccgtcttcctgtgataccagcactgtttcctgggactggtatcggttaacaggttaatttggagcatcacgggctagttccgctcgggactagttcggggcgtgacactaatgctacactgtatcatatgctttccacacacaaatatttactcgcaagtcgtgcgtatttggaatttagatttttcaaaagaaagttcaaaccatttgcatacttgagatacaaaactcaaaacgaaaattgagatcgagttgtagagtttgacatatata

SEQ ID NO: 32846 - DNA, 1501 bp, Oryza sativa
gctagccggagagctagcaaatgcaacaccccgatactgcgaccgtgtgcgacgacgactgacggcgaggacgctatagtggactctaacacataagccacgcacccgcacggcggcgctcgatctggctgtctggctagttcttgaggaggtagtcgtcgaggtcgtggaaggtcttggcggcggtctccttgatgacgtccgggtcgggcacctcctcgctggccttgtcgaagtccatggtccagctcaccaccgcgccgtcggcggcgggggcggcggcgccgcccttgggggtcacctgcagcgtcaccctgaagttcttgtagaagctgaccagctcgccgtccaccacgctgtacgacaccaccttcttctcgtcgtccgccacctccaccttctccttcgcgaacgtcaccatcggcaccccttcaataaagttcatacatcgatcggaggcatcattcgtaaaaatgagagttggccggagagacgtcactctaaacattttttttaaaaaacaatatgaacgtgttgagaattaaacacgagattttttaagtgcatattaccttcggtgtacttgaggaggcggacggtgccggcggacttgccgtcgccctcgacggtctcgatgctcttgtactgctcggggaagatcttggggaacagctccgtcgagtcgcgcagcgccgtccacagcttgtccgccggcgacttcacctccaccaccagctcaaccttggacgccatgatctctctctctcccttaatctctagctcacactacctaccagctgatgaatgcgaatgttaattgcttcttgagttctttgttgtgtggccatggcgttagagccttattatatagccacggtcagctgctttgattgtggggagctactaccgctgctggccattgatgcactccggcgagatccagctacctatcgcagcacacaatttatggcgtcggtgcagattgatgtggtacaagaataggtaacgatagaccgggaacgtgttggccggtgcagagagccagagacttattactgttaacgggtactcctgtcccaaaataaaacaacgttggttggaatgagggagtacgttaatggtagtgtgagagtgagagtgatactgattgtgctggtgcgatactgggattcttgatctgaaaatgcgggtaataatgcctgttcggtttgccgttggcaacagtgatgcgggtaacagtgatcggaagtactccttctagtaactgtctgaactaaccagctgaactcaattccatgatttgcatttctccatctctcttccgtataccaagtgaattggcataagctttctagcttgcttggctgagggtagtttagttcctaaaacttttttctaaaaaaacatcgtattaaatctctggacacatgtatggagcattaaatataaattaaaaaagctaattgtacacttaaaagagaaatcgcgagacgaatctttt

SEQ ID NO: 32847 - DNA, 455 bp, Oryza sativa
tataaatcatttgtaaatggtttaattaatttggaatagtattttctttaataggtttaattggaattcatctaaaattatctaaaatcatgatctacatgtttgtttacttttatgtactgtttatttggtttttattagtcttttttcccattttgcgtgttagcttgttgtttccgtcgttgcgaaaggttcgcgagtgcgtcggaagtggttctgaagactaattgaagaccgattattgcaaggcaagtcacacagatcctaaacacagttcctttgagcatgttgatcctatatttaaattctctatttatttcaactgtgtatttatttcaactgtgaacatattcctttgtaatggccaattcgcattgattactctattccttgttaccttgggtaataaattgattagcttgaaccttatatattggtttggttcagctaaaagc

SEQ ID NO: 32848 - DNA, 1501 bp, Oryza sativa
gctcgaagaggtagcggcggatgacgaacgcgaggagctgctcgtaccgctgcgcgggtgcccacctgacgttctcggcgaaggacgacgcgaggaggcggacgagcgcgtcggactcgtcgtcgtcgcccgccggggtgagcgcccgcacggtgaggcggccgtgcgggaaggagtgcgcgtagcggaaggcggcgagctcgtcgcgctgcgacagcgcgcgcggcgagaggaagacgcctccccctccccccgctggccccgtgacgatgccgccgtcgccctcgccatcggacgacgaccgagaggccgcgaggcgtgcccggtggcgaggccgcgagcggtagggggggcaggagaagaggaggcgcgggtgggtcggggcggctggggagacggccgggaggaggaggaggaaggccgcggacgcggcggccatggccggcgcggcggagcggaagcggaggtgggtgtagagattagaagcgatttctttttctttccttttttttttgaaacgggtccacgtggataaacgccaactgtgcgtcgcttagataccaaccctgaaatctgaatcttctgaaccttctctgtgctccacacaacgttctgaacggaacctctctatctgatcacccgttgccatctccgtcgcttcaaccacctgcaagctgcaaccgagataccaactctgaatattctgaaccttcctgccatgcgtagcacaccattttacatcattgattcaggtcctgtttagttcgtgaaaaagaaaatttcgaagtgccacaccggatgtttgatcaaatgttgtaagagatttttggacacgaatgaaaaaattaatttcataactcgcctggaattatgctcaaaagattcgtctcgcgatttctcttttaagtgtacaattagcttttttaatttatatttaatgctccatacatgtgtccagagatttaatacgatgtttttttagaaaaaagttttaggaactaaactaccctcagccaagcaagctagaaagcttatgccaattcacttggtatacggaagagagatggagaaatgcaaatcatggaattgagttcagctggttagttcagacagttactagaaggagtacttccgatcactgttacccgcatcactgttgccaacggcaaaccgaacaggcattattacccgcattttcagatcaagaatcccagtatcgcaccagcacaatcagtatcactctcactctcacactaccattaacgtactccctcattccaaccaacgttgttttattttgggacaggagtacccgttaacagtaataagtctctggctctctgcaccggccaacacgttcccggtctatcgttacctattcttgtaccacatcaatctgcaccgacgccataaattgtgtgctgcgataggtagctggatctcgccggagtgcatcaatggccagcagcggtagtagctccccacaatcaaagcagctgac

SEQ ID NO: 32849 - DNA, 250 bp, Oryza sativa
attcctgcagcccatcgatcaggttaattaagaaataagcacggaataagacaagcatataaacatcaactgtatagtggtggcagaagtattttaacacacaacgcacgcgcaccaatctcatttctagtttactccaaattaaagaccagtcagaattttcgcctttgcaaaactcctctcatttcatttcctcccaagagtcaagctagcccttcttgcttgctccgttcaacgcctcttccccagc

SEQ ID NO: 32850 - DNA, 863 bp, Oryza sativa
tgttggcatgttagctactggagtagtgaacgctgaacagggtaagatagacagtattgtcgaaaagttagaatttttactaatggagccttaaacagtactgtatttgaaattctgttatatggatctcttttaatcaagttagaggtctctgcaagaaaattcagttcgtcgcaatggtggacgctattgtttttccatttcttttccttgggtggtgctcctttgacctgcaactcttaatgcaagggactggaagctcaagatgataaacttataataaggaaggagaagataacaaacaaaaaatgttgttacagctctagtaccaaaacagagcactccagtcaatgtagcacgaactaacgtgcgttcccattttaatagctactttgtccatcctaaaatacttgttaggtagatataatttagtacataaacttataaaatacttatttcagtgaacaaatttgtctagttcgtgcgagctagaaccaaaatggctttgcaaggttgattttaccaagctgatgttgattggaatgtgatatgtatacgtggaatgagtatgcataagacaatctatatttataaatttatcctctactttatccttcatatatatctaaccacttatcattgcttgggtttatatatgtttttttaactaaatcactatatcacattctatctttttattgaacatatgtatatttaaatagcaacatttctttgatatatgtttacgcagtatcctaattagcacataaatcacatgaataatactttatgcataacttacctttttaaatttttttataattttttcaaaatgttagacactgaaacccacgaattgattt

SEQ ID NO: 32851 - DNA, 466 bp, Oryza sativa
atttttcaatccaactttttgatagagaaacagagcgacctgctgacccctaaaggcctaaatcctatatccagttacttaatgtcacttattcactccgaagttgatggaagtgatgagaacgctgtgaggcacagcttttatttagtttcatttttcaaatctatctaatagttgagtgtgtagcacaaaaaaaacgataatttatgttctgtttttcatcaatctcaatttatcagtgctcaagtcaggaagccccgaaaacattctagaatatactttttttttgacgagatagaatatactttctgaagatgccgaggcttctctaaacacaactacagcaaattcaaggataaaatcatctaggtatgattcataacattaaaactttacaaagtttggctctaatgaatgtgcatgttatgtttccaaatctcactagtttcttttgttgttttacaga

SEQ ID NO: 32852 - DNA, 1501 bp, Oryza sativa
caaatttgggtgtaaacacatgtctgtggggtatctcatatttattaacctatagcaaaaaaggagttggcattaaatttttatgtaattttaatgatactaataaatcatgtaataaatggaagtagcatacaggtattgcaaggaattttctatcttgcgcttgtggcaggtaattatggtcggacgcatagtgtgaatgacctcctctcatttcttgccttctcctcctttgaaggcctcctcacaagatattcgacttccctcaacttcttttaagtcccctggagatgatggagagaagggattggggacttacatgtgggtcccactattttattatattttaacggattgtaataccatgtagacaccacgttagaaaaaggcagttaacgtgccacgtggatgccacaccagggaaaaccacgctcttaaagaagacgaggggtcattttgcactggaggggccagtagtatacccgattttacggttaattagtgatacgaatcaaatccaacttgtaatcaaattggacctttttccattgagaagcgattcgacttggctacttaagccggtcataatcggtttaacagatatgagcaatccttgggtttaatttgtttcagctagcccaacgtatttgattaatttggacggcggcaatagaaagcccaaaccgaaaccgccaaatatcctaagcgtaactagcccgtattccttcgtcgatctccccgttacgtccttgatcgcgatcgagttcgtctgccaccttcgccgatctccatatctcgccggcgcgcgccgaccggagtccggagaccatgcatgctgctgcttccgccgcatcctcgccggtgagaacaacagtttgttcctagaaaaaattcagaaaaaataattggggttcaaccactgatcaacctcatgcccaatgcccgacaaagaacataccctgttgatgtttgtactgaaatcactccggacactgcaaaaccatggagatcagacagctcagttagctgacgatcgagtgatagattatgaccatcgaattagagacctctgtctatcaaccaggattattactcgtcgtgtaattgcaggatggatgaatgtatggatgccatattgctgacgcttaattacttcctgtgacgtcttagaatccgatcggtgaagaagaggagtcgagagattcgagagatatgcagcgtatggcaagcttggaccgaataaggagagaggaactttaatctacatggtaatttaatttactactagtagtagtataataggaggatgggagccccaagacataaaattaacctagtttacgtcccgatcgatgctccctgacagcagagagttgcttaaattagatcgagctgtacaaaacgcaactttttcttccctgcagctgcatccgataactacaaacgagcctatagctcattgccgtcgccgtgtacgtcgcctcgtccggtgatcctcttt

SEQ ID NO: 32853 - DNA, 1501 bp, Oryza sativa
ccatacgctgcatatctctcgaatctctcgactcctcttcttcaccgatcggattctaagacgtcacaggaagtaattaagcgtcagcaatatggcatccatacattcatccatcctgcaattacacgacgagtaataatcctggttgatagacagaggtctctaattcgatggtcataatctatcactcgatcgtcagctaactgagctgtctgatctccatggttttgcagtgtccggagtgatttcagtacaaacatcaacagggtatgttctttgtcgggcattgggcatgaggttgatcagtggttgaaccccaattattttttctgaattttttctaggaacaaactgttgttctcaccggcgaggatgcggcggaagcagcagcatgcatggtctccggactccggtcggcgcgcgccggcgagatatggagatcggcgaaggtggcagacgaactcgatcgcgatcaaggacgtaacggggagatcgacgaaggaatacgggctagttacgcttaggatatttggcggtttcggtttgggctttctattgccgccgtccaaattaatcaaatacgttgggctagctgaaacaaattaaacccaaggattgctcatatctgttaaaccgattatgaccggcttaagtagccaagtcgaatcgcttctcaatggaaaaaggtccaatttgattacaagttggatttgattcgtatcactaattaaccgtaaaatcgggtatactactggcccctccagtgcaaaatgacccctcgtcttctttaagagcgtggttttccctggtgtggcatccacgtggcacgttaactgcctttttctaacgtggtgtctacatggtattacaatccgttaaaatataataaaatagtgggacccacatgtaagtccccaatcccttctctccatcatctccaggggacttaaaagaagttgagggaagtcgaatatcttgtgaggaggccttcaaaggaggagaaggcaagaaatgagaggaggtcattcacactatgcgtccgaccataattacctgccacaagcgcaagatagaaaattccttgcaatacctgtatgctacttccatttattacatgatttattagtatcattaaaattacataaaaatttaatgccaactccttttttgctataggttaataaatatgagataccccacagacatgtgtttacacccaaatttggcacctaggattaaaataggaaagattgccaaaatttggaagtctgccggtttcctccgagtgggccggtctgaccgtcgtgtgttgagcggtcaaaccgccggttgagggccggtcataccggcggtgtgtggccggtctgaccggcaggtccgagtccgactgtgtttcgtcgggtctcgaggtttccttgctcgagaaggcatgtttcaggtttcctttggtttctaccccgagctggacgtggaggagggcctgtagagggcaagaccaacc

SEQ ID NO: 32854 - DNA, 1501 bp, Oryza sativa
aagtaaggttaagtatagttttgacgtggccaagtgtgagaagatttttgattatcttttgcaagagaaacaaattagattacctaaaggccatgtcataccttctcaagaagagttgaaatgtcgagcatattgtaagtggcatgattctcattctcactctactaatgattgcaatgtgtttcgacgacaggttcaatcggccatagatgaaggacgattgaagttcaccgatggctccaagatgaagcttgatcatgatcctttttcggtgaatacaattaatttcaatgataagaaggtgttgattcagccggagcaagccaaatctgctaagggaaaggaagtgatcattggtgaaccaaggtccaagatgatagtgccaaagaagccggaggttggcgtttggaaggagaataggagtggagcttcaacttctaaggcccctaggaagaccaaggtgacttttgatatgcttttggagaaatatgagaagcaaggtggtgagaaaattcgcaacaaagggaagagaccaagatcacctcctagggagcgatttggtcattcaccaagatggtcgcattcaccttcgtatcattatccacaagacatgtcatggggttcttatccaatgccgccgccgggttatccttatccttgctttatgccatggggggcaacaccgccaatattcaatcatatgcctccaatgtgattcaaccaacggtggggaggaccacggaggccaattcatgagcgtttgtcttcaccaagcaatagctgatttatggtaagaatcgggctaatgaagaaaagagggaaggaaagcgcgtcaaggtggaggagaggacttcggaagtgattactattaaagtggggtctcatgatgtgccaatacctactggagatggaattggaatgtccccgaacagaaaatccgaagccggtaccagttcctcgcagtcggccggtctgactaggccttctggccggtctgaccgcggtcgtgcggccggtctgaccgggccattaggccggtctgaccgccgactcgatagcggtccgaccggcacctcaggctggtctaaccgtgcgcccagtgtcggtctgaccggcgcatctggccggtctgaccggtggtctacgaccggtctgaccgggctccagcgccggtttgacaggaggattgcaaagggcgatgtggagacttcatcatcttcaaacaaagttaatagagggcattatttacctcctggaatagagctgaatcctaggtggatgcctagggatttgacggctactcaaaagagaaggttgcaacgtctttggacccaagagttaagagagaaagaggccgaagagcaaagagataaaaggttcaatgagttgcgacccccactggtttgaaggcctaaatccatagagaaggcaaaactgattgatgtagaggaaaaggaagaacaatcggttgataaaagtgaaccatctccaaaagaagaca

SEQ ID NO: 32855 - DNA, 847 bp, Oryza sativa
tgtgtactcagtttaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattacgcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaa

SEQ ID NO: 32856 - DNA, 1501 bp, Oryza sativa
accctgatatttggattggcaaataatatcccatctagcaagtctgcaccttttcttatgatcatccccttgccaatattatctccagattggataggtctttaactctacttttagatggttatagtctcacgtcaaaattccacctgagcttctcgaaatctgcgaaacaactaacatacctcattcggtccaaatatagtttagcccttgggtgttctaattgagtcatgtttagttagcctttgttatggacgacctcagactgctagacaaccatcatcgtatttagggattaggttttgcttagattgttctgtcactatgcagttttgccgcaaggtcggtttgtgcaaccccaatttcaagtgctaatcgttcatctgcaattcagatttcacttttccttgttcttgtgaatttctttgaatgtttataggacataaccttcctagtgaggtcaattatgagagagtggtcaataacgatgagaagtgcggggtgtagcgattacaagtgatgatcgtctgatcggaagcctcaaaatgtgaatatcttcatgtcaacaaatcgaaccaattgaaagatcagatacctattcacattagaaatgattgactttgaaatacaaaatttcataataatccaacctcaataggactcaacatagaatatgcagcctatgttggggctcatgaatcaacctagggtaaagctatagagccccttgatttctaggaagaacatagaaatttatcaaatttgaatcctataggaaatttttcctatttgatgcttggagccacataagttttggaaaaaagctagagtgaggttcatcctcatggaaactttaatttgagtctttaattatctctcctctaattgtttttgctttttcctatggtctattgtaacggtcattcatgtttttcctgtttttgcaatcctatgtttttacacttgtcatcctatcaaaatcatgtctttttctattttcactttctcaatcttgtgtttcaaacagatccttaatgtctaacatagaatgccttctcgaataatgaacattgttgatatcaaacatggcactaaaacaagaaaggttcattctcggaaaattgtcaatggttatacttcgatagaaccatatttaagctaatgatttgaaattggttacatatggttcagagcttgcttggattctcctagttgactacttaaaaaaactgtggtgaagtcttgatatttataagttccaaaattgagcaaacgtaaaatcaattgataggattaattttcacttgtattgagcttgtcgctcttagcatggaattgaaagatctcatagacggtataaaattgtttgcaatctttgatttcacttttttaagatcacttactaaaaaaatggacatgtattttcttttacaaaattggcactgcaatttttacaatcatgatcaaattttatttggaaaaagtcaaaatgacttataat

SEQ ID NO: 32857 - DNA, 1033 bp, Oryza sativa
cccaccacccattttatcatttaaatttagtttttaattttatttttagcagcaattacattttagtccctatgttttatgtaatttagtcgaagcagtttatcagttgtacaaacaattatgtaatggtcctatagaccactgatgttacgtgtttattaacataggtgtttatttaaataccctgtttcactaaatttatttgttgtcttaataacatgccttttgcatattatttcaagacacgctctactttctcgctttattaatttacaaaattctataaattttgtattttgatttagcaaattctcttaattatgtacaacataattaatggaggatttaatgcatgttccacttcacactttgacttggaaattaatcacatgtcgatggagtcctatactttggtcatatcgaccataacttaggcagcgagtatctcgccaatcatcaagtggtctacattctgagatgattacccgatggagtcctacaaattgaccgcactggtcataacctaggcagcgagcatttcgcccatctcacagaggtctacatctcacgatgattacccacatgtgttatttttcgagaatatgttttgaaaaatgagattatttaaaatttggttgaacacaaggtagtggagtcccaaacattggctgcggtatattcataagaatgtatttgcctggagaccgtgttttaggtagcaagtataacttgcccactattaagagatctactccactgtttaattacttggagattatccacattgtgccacctaatttcgaattctaactcaaaattgccaggtctattacctgcatttttcgaaacattacaaaatatgaagttttacattacgcattgagattacaaccttaatatcatgtttttattaatttacctctgtaaattgataatgttaaccatgattgtagggacatggcaacaaaagagttcgacgaactcgcccttgatgggactaactatcccatctgggcttccgatatcaaaatca

SEQ ID NO: 32858 - DNA, 1501 bp, Oryza sativa
tattcgatgtgagcaaaataatgggtgccgaatccctggaaacagtcttgacgacagggacgtacccggaataaaagagaaaaatatgagcaaaaaggctcaagaaaagaaaaagttcaaaaaattctctggttattttgtgctaaaggttatttgagaaagagtgataaatgcaataggtatatgtgtttagtgtttcttcttcaacctatgtgcttgttaagatgttgcattataaatcgtatgaaatcatgaattttgattgttgattcaagcttcattgtaaaatctttggttcatggttatactttaatgcatgcttgttctgttatagatgggttcattttctttttattgcaacacatgacttgatatgctatatgtatgctaagctcttgaacattaatgaacataattcctatgcttgatgaaatcattgtcaaaagggggagacataatgtgaaaatttttggatttttggagaagcaaagtgaatttttgagaagagcatgtttttggttcaattgggaatttctttcttttaaaaagggagagaagttttcttttggatttttgagcacgatgtgtacatttgtacgaagtgtgctttttaccaccaaataccaaaacatttttatggatttgccaatgtgttcatcaagggggagattgtaaaatcaatggtgttttttattattattctgtgatgaacaattgggcattggaaattattggttttgttatttggaatttatttattcacgaagtggttttggagatgattggatttcacaggtgaatatacagatactgctgtgattttatgtagaccggtcagaccgggctctggtagccggtcagaccggcgtgtaatgcgccgtcagaccggcgcagcctgcggtctgaccggccgacactgtgtcggtttcggtttcgggttgtttatttggatatccgagtttattccatgattatgacttctagatggatactatacgcatgtaatactattgtttactgctaatgagtcaagttggagatagcttggtctcggaatatggtttctttgtttgtttcatgtgtaggtgactcgatgtctcgggagagtatttgcggtgatggaccgggagtcggcttggggataagacgacgtccgtggtggtcagagatcatgcgggatacttaggctagagttgatgcacgtggttgatggagattccatatggcatacgatggaggaattgtgtgcgtatgggatgcggagtcgaatttggaaagagtccaaatttggtacgattggttatgtaaagtttctttcttgtactagtgggtttcctaaggtgtttaggactcctaatatgagtttggttcatggctttaggctgcctacctcatgtataaatagagggggagcgtgaggcttcccggtatcgctttagagagcaattgagttaagttttgagttagggtttcgagtttagtcgaaatttttgtaaggagt

SEQ ID NO: 32859 - DNA, 1501 bp, Oryza sativa
taatgtggcttttaaagataagtatccatcattatatgctattgttagaaggaagaattcttctgattgtttttcatggaactttaatcagaatggacggttctctgtaaggtcaatgtatctagttttgattaacaatggctatattgaaagggataagataatttggaagcttaagatgctgcttaagattaagatttttatgtggtacttgcttaaaggggtggtgttaactaaggataatttagcaagatggatttggaatggtagcttaagatgttgtttctgtatgaaaaatgagtcaacacaacatcttttatggattatcattatgcaaagtttttatggagagctgcacagttctctttttgtttatacctccctattagtatatctcatatttttgatgggtgactgttgggggtggacaagaaaaggagtaaacttatattggtgggagcttctgcaatatgttgggctctgtggttgagtaggaatgatatggtttgacaaatcaccatctatttcttatatgtaggtaattttcagggcaacatattagctccggttttgggcacaactacaaaggtgtgatgaatacaaaggtgtgatgaagacggtgagtttttaaaagttgtatgtcgtaagcttgagatgacggttatgcagctttttgccaattatggatggagattcacaaatatacttcaataatgtgttctcctgatcttgtattggttaaatttacctttgtgtggtcatttcattctatcatttttgaactacactcgttttagagtgctagattgtaataatgggttgtagctctttttgagcaaaggccaggatgtttattccattatctaaaaaaagacctatccaataattatttatgggcctaacaaatgcttctggattagcagctaggtccattttaatttgatgctgccaggagggtcgaattcgagtccgaaacatgtaaaatactatctcttgccttctagcaccttagtaatgtagtgacatggaaaaatactttggggggggaggggggggagaacttcagatgttcctaatcaacttcattgatcattcattgtctccatgtgtatgctcacctttgcttgataaatgctaacacttctgaaagggaagatacataaaattcatggtgcatcattctatgtccaaacatatagaaacaaaacccaatataaaacacatgcacattttatattatcgtgttgatgtggaacatgggaatggtcatatctaagccggtgatgttctcatcaattcaattctaggaactgtgcctatgccctaggacaaattttactggctatatttgtgcttgagtccatcttcctcctttctgctgcccattattttccaatggtcggaatgagaagtactataatcttcactagaaccattcttcaacacgacgacatacacgagactggtatggccatgttcaatttagattattgagcacatt

SEQ ID NO: 32860 - DNA, 278 bp, Oryza sativa
gttaggaaaaaacaggaatattatttgtggaaaatgattcaggctctgaataccatggtgtgtgggtaaaagagctacctggaattctactacaatcaattgacaaagccccctcagtaacaaaggtctgctataggttatttatccagtatagagttggaatactcagattgggcattaatgaaaccttttcaataaatagtgtactttatgatcatatgaattatcataggttgttttggagctacttctaagaattggacagtacttccccacaa

SEQ ID NO: 32861 - DNA, 1501 bp, Oryza sativa
ttgtgtacatgcaggatttgtctaaaaccattgagcttggctttcaatctgataggacaagactatttcaatactttataaagccttgcataatcatattttgccagaacgagaaggttctttgctgcgcattggagatgcttaaatctttcgcaacaggagatgaccacgtgctttcatctgcatccaagttaaactacccaggagagctttcacatcgaatttgtgttgtcacaactatactcatattcttatgcaatgatggaaaactccataaaaacctttctttgggcaaatgtgttattaaaggtatcctgcaacatacaaggcatctcatggtaagtggtgataacataaatgcctttgtttggtagccatattaactgatgagatttcagtttcctacattttagtcatttttcatattaatcttaaattcagggaggtcagaatatcaagggcaaaattgaacatttgtgcatgtgaatcgtatgtagactagtttgttgaatttgttcctactatgagagaatatttgtcctgtgctgtacctagatcactatcactagcttgctctattatgcctaaatgtcgttgttgtgaaactggccttcctaatgagtttgctctattcaatacttgctgcaggattctaatgttcttgatgtaacatatgaggacaagcagaagttaagatttgcatttgagcaactaaagacgaaagcattgcagttgaactgctgggacagaagtgagctggaagggttttcaagcaccacgtaaatagtaccaaatactaatggtatgtgggctccttcgtcattgtttgctaattatgttgatttattgtttttttttaaaaaaacgaatgaacttacttccatcccatatgataggtactgccgtaatgtgaaaccttactctgcacgggatgaaaattttgacgaactgaaggtgaagatggagagtggacatggtgactggtgaggggcagaaggatatgtgccatccgacctgcgtcagactccagtatacacctctgctgttcagctgttaccaacactttacgaaggtctgtactttacccaaagattaatttcacacttcgattctatcttaatcctatgtttcccaaacggtctacgatttgccataaacacacgagtttctcaggagcactaggtagatttgtcatgtttgacaacaacgtgcctgacagtaatatcttgctattgcaggtggccggaaaatgcattgttcacatgttgggaacgaggtggtccactggtccatgtatcattgtggtacagcgcttggttttgatgcaacagaattgcagtttagactgctcaatagaccataggttatttcaccgaaaggtttacatttcaacctacatgtccatgtaagaatcccgatgtaaatgtagaaattttgttttggaagttcatttcgggcctctcatgtcattgtttccacttcctgcatatatacttgtttc

SEQ ID NO: 32862 - DNA, 220 bp, Oryza sativa
gctcgtgcgtcccacagacttggtggcgctcccgttggatgtggaggcacccatctggtcctccctgcttggggatgacgctcgtgtattggctactatgatgagatcaatggagctaatggagctgcaatgtgtgttggcctagtaggtgcctccctctgtccttgtttcttgttgggtttgttttgagtaatcagagtgcccttctccttccctcagg

SEQ ID NO: 32863 - DNA, 178 bp, Oryza sativa
ctgttaaaattatcactagcaaatagctggaaaatttaaaagcccttgcctctaagaacttcttgcaatattttgtgcccagcttctcatgcggttttccataagccatagttctctcctgacccatgcatgctacatatcatacacatctcatgtcatgctgacattttctttcaga

SEQ ID NO: 32864 - DNA, 343 bp, Oryza sativa
tatttaaactgcaacatccttatgtggccttttgtttctgttgggcaggaagaaagaagttaagctgcaatcaaaatggtgtttgaattgccaacgtacatgggaacatgtcggttatagtctgtaggagcaaatatgcgtctctactgtacatgtgaaggatactgcactcttctgagttttggggctgcaaatttaggtgcttggaggagaaaactgccaccaaatcagaagaaatcaagcttctgaatgtgaaacacggaggtccaaggatttcacttgacaacaatcttgcgctctgtagtctttgctagaagcactacatctggttttgttccataga

SEQ ID NO: 32865 - DNA, 533 bp, Oryza sativa
atagcaaacagcctgtgacaccaatttgattggctttattctaggcctggtagtagtcagtttgatttgcttggtatttaaagagcagaaccaatgtttggaaataccattcaaattgctctgttttgaggatgactttcaaactaatgatttgatgtattgtattagttgaaatatacaggatgaaatgtatctatgtgcttaagctataaaacagacaccaatggaaactaaggggagaataagggtcatgtaacagtggaggtggtgaaaaggcggcgactggtgcagcggtgaagacagtgaaaaataatgataaagttatgtaaacttaaattatcatatgaatttaaagttcccaatatattatggtgggtgatttgttatcatatacaacatataaatcaagctaaataatataaatatagatggcggttgtggttgcacaaaagtgtgactataattgtcggtgatataggcccgggggtacacacagtaaagggaagtatccttcccgtttagtcacgtagcca

SEQ ID NO: 32866 - DNA, 1501 bp, Oryza sativa
aaatatgcgtctctactgtacatgtgaaggatactgcactcttctgagttttggggctgcaaatttaggtgcttggaggagaaaactgccaccaaatcagaagaaatcaagcttctgaatgtgaaacacggaggtccaaggatttcacttgacaacaatcttgcgctctgtagtctttgctagaagcactacatctggttttgttccatagacaaattgttaatagaacaattagaattagattacaggataaggtcgctccagtgttctgctgtatacataccatcagccattcagctcattcgtgcaaaccagaagttatgctgctgctgggtccgcgacaatatgtaagtttgcaaatcacaattagagacgagcactccttaccatttcaaattgtgcatcgctttgctttacctaagcactagtctcttcacgttgttcatcatttttcttcaactgaactttctcctactgctacaattctataaatctgcaggtatcaaagtatgaatagattatacacctttcaactttcaaatttgaacttctctgtagtactcattgtcctgtgttatctatgtgccattttcttctgcatttgcttggtaaactctgatgtgtctgcatgacttcagcattactgctaaacctgatcacaaacaggggattactggtggattgccaagtgggttccatgacagttagtcggagaacgacccggcggcttgacccagaaaaaaggccatctgctgtcagagacacacatcccgtcctgaagacgacatgaccttaataattgggaagccatgcaatggctgcagaatcaggacatatacccttgagacaaagatgaagcttctcccagcaagaaaaaatgttgtgtaaagggcagagctttggcatgtagacctcgacctgtcatacaccggaatgaagggtgtggtttggctttttgtgttctttcttctgggctgcttaaccaaccatgcttatctctgcaggatcaggtcacagggatcaaaggggggaataaaatggaaactgatgggaataaaatggaaactgatttgtagctttcaatgtttcgttctcagctttgctattagctttctcctgatgatttagaggccatggtggtctcagttcatgcatctatgacctgaatgaatgaagcttgtcctgcacttcagatcgatcggagtttctgtgtgcatatctaaactgctgagttttgggcttttggcctgacactgttctgcctaaatttttcagaaatgccttcctagctactagctaggtcatgagctatagccatcagactgttcgagtagtttagttagcaaaaaacaagactacagaatgcctactgacaagttgccacaaaatataatcatctggtatatataatcagcttcatgttaatatttgagaacgcatgcttaattatttagacgatgatgacaacggcgtgtaaactagacagctaccagtttcagaa

SEQ ID NO: 32867 - DNA, 316 bp, Oryza sativa
gttcacgaaaaggaaactttttggtgtcacattggacgtttgaccgaatgttagaagaggtttttagacacgaataaaaaagctaatttcataactcgcatggaaaccgcgagacgaatcttttgagcctaattaatctgtcattagtacatgtgagttactgtagcacttatggctaatcatggactaattaggctcaaaagattcatctcacgatttcccctataactgtgcaattagtttttttaaaaatcaatatattaatgctccatgcatgtatccaaatattcgatgtgatgtttttgggaactaaaca

SEQ ID NO: 32868 - DNA, 1332 bp, Oryza sativa
agcttgcgttgaatcgaacttgtacgcagcactgatgtaatgcatactcaggatgatgagattaaaccatgctattgctaaggaggatgtttttgtatgtgtagctaaagaggatttcgtttaagtttgacactgtgttgtgtgtgcgtttagaggcatcaatagcacaagaaatctgatcacaaggaaaagagatggattgatttgattcaaagaaaagtgaaatacatttttgaaaaaaaaaatatattcggttgccttcgctatactacaagaaggaaaaaagaaaagtaaaatacctgaacatattagctagtagcccacaagtatcacaatgcacacaccaaaaatgatcaaggatataatcactaaccaaaaaaaaaaagagaactgaaatacacctgtctctatctctatgttcagagcaggtaaagacggggcagcaagaggtgtgttcatcggtaatttttccttcaaaaattggttgtgtgatgttgacaattccctcggattctggtggaatgattttagcatgccaaacataattaggttgctagaggatagcaatagggaatgataacctgagataaaaaattaccttgtagtcatacaatgaggcactccaaaccactatctcaggagggtttcccgataggtatgatgcattagagagagatgattcaacactggccagaacattgcgcactctgtactcaacttcctcttctgtgaaaatgaggcccgcttgtacctgttatgctccatcaatgcatgcaatcaggagatctggatatgttagatggctagcagtgaaggtttgcataaactcttaagctcaattctcaacataaaccttgcatagtgacctcatttacaagcttgagaacaacatcttcagcatttcccaagcctatgagaagatcagactcctgagacttcaaaaccatcttaagatcttccaaagcaaaaagtagcagttccagcatcgtgtctgagtaacctgcaaaggataaaaaggctaatgttaaagccaactgccagtgtgattacttgcgattcttgcactacataatacagattacagtataatttcgcacgatgttacttgtatatgaatgttaacaccagattctaatacccatttccacagcataacttgataaaacacacctcgatctcatcccttccaattaaaaccttcatgatctgacacataccacataagtaaaggtgcaggtctcctcaagaagttgggactgaaaggcagttgttctttccatttactagcgtctattttaaggcaaaccatatgtttcacttttctgaatcagc

SEQ ID NO: 32869 - DNA, 700 bp, Oryza sativa
tgaatttgtctgtcaaggaaaaagaattgcaggctatactgcatatatcaacggttaagtctatgataaatatactttgtgatctgaggatacagctcttattatctcatccacaagtggcttgtcaacccgttcagttctctgcacaggaatttttcggtattgcttagtaaccatgtattatttaaatatttgaggaagcaataaccacatcatacacgtactgtaggatagtattccttaagaatgcctcctgctcttgacctcaagaagagcagaaggaggcgtgcctgcaaactggaaagccatgaagtccgtccttcctgtttgtatttttcattcagtagcattgagttaatttgtagcggaagtaatatagttccagtgctaaaaattcgatcctaaatagtacgatttatttttgctgctgtcagattatcattcccaaacactggttgatataagcacaaaagatatgtatctgaaacattaaattgttagccttatctatgctactattcagagttttaaatgctttaataattccaacaaactagaaataacatgcacattgcatttgaatgatacaacagtttctacaagagaggagcttgcgctaggttagccaaaaagaactgctgagattttagtgtgcatattttcaatcgtcctaagtctaaagtaacacgaaaatgtatga

SEQ ID NO: 32870 - DNA, 650 bp, Oryza sativa
atcaaatcaataattgaatatatatattcataataaatttgtcttgggtttaaaatattactattttttctataaacttgtcaaacttaaagcagtttgacttttactagaggcaaaacgtcttatagcctgaaatagagggatttctttaattttatcgggaaaaaatccagaagaaacgtacatatatacagaggcatgagagaaagaatactaggtgaaaggaatgcacatagacaacatgattttttccatatcctacgactattcattaggaatataagtacatacgtgcacagtgaaagtacacgtaaacgtaaacgacaggaggcgagaagaaaaaacgtgcataccaacaaaattacttttttctccaaattctcaaattaaaaattgttaataaaatatttggttggtattttaggagcgggaaatatacatgatacatatatggatgtgatattttagcaaattatcttgctataatataaccccttaaatattaatatgtcaggcttaactgattggcatgtcatacaccctgcttacttgaccattgataataaatagcaggtgttgataatgaactaggtactagactattatgttgtcaaagagtaaataataatgatgaaagtggtacatttctt

SEQ ID NO: 32871 - DNA, 1501 bp, Oryza sativa
gaattcttctgattgtttttcatggaactttaatcagaatggacggttctctgtaaggtcaatgtatctagttttgattaacaatggctatattgaaagggataagataatttggaagcttaagatgctgcttaagattaagatttttatgtggtacttgcttaaaggggtggtgttaactaaggataatttagcaagatggatttggaatggtagcttaagatgttgtttctgtatgaaaaatgagtcaacacaacatcttttatggattatcattatgcaaagtttttatggagagctgcacagttctctttttgtttatacctccctattagtatatctcatatttttgatgggtgactgttgggggtggacaagaaaaggagtaaacttatattggtgggagcttctgcaatatgttgggctctgtggttgagtaggaatgatatggtttgacaaatcaccatctatttcttatatgtaggtaattttcagggcaacatattagctccggttttgggcacaactacaaaggtgtgatgaatacaaaggtgtgatgaagacggtgagtttttaaaagttgtatgtcgtaagcttgagatgacggttatgcagctttttgccaattatggatggagattcacaaatatacttcaataatgtgttctcctgatcttgtattggttaaatttacctttgtgtggtcatttcattctatcatttttgaactacactcgttttagagtgctagattgtaataatgggttgtagctctttttgagcaaaggccaggatgtttattccattatctaaaaaaagacctatccaataattatttatgggcctaacaaatgcttctggattagcagctaggtccattttaatttgatgctgccaggagggtcgaattcgagtccgaaacatgtaaaatactatctcttgccttctagcaccttagtaatgtagtgacatggaaaaatactttggggggggaggggggggagaacttcagatgttcctaatcaacttcattgatcattcattgtctccatgtgtatgctcacctttgcttgataaatgctaacacttctgaaagggaagatacataaaattcatggtgcatcattctatgtccaaacatatagaaacaaaacccaatataaaacacatgcacattttatattatcgtgttgatgtggaacatgggaatggtcatatctaagccggtgatgttctcatcaattcaattctaggaactgtgcctatgccctaggacaaattttactggctatatttgtgcttgagtccatcttcctcctttctgctgcccattattttccaatggtcggaatgagaagtactataatcttcactagaaccattcttcaacacgacgacatacacgagactggtatggccatgttcaatttagattattgagcacattattgtcaaggattatctaataggctatatgtatcaattaaatatttcaataaat

SEQ ID NO: 32872 - DNA, 1501 bp, Oryza sativa
ttgggtccaccaatttaagtgaaaatcgacggttggattagatagagccatgtggcggcctaatagcgtttataggagtctcacgtggtggcttgagagcgtttgtaggaagtttaatggacttttagtatataatataatataatataatataatataatataatataatataatataatataatataatatatataatataatataatataatataatataatataatataatataagattcctcagggagaactgggtggaaaaatggataacaagatataagttttgcctacgagaagcaaaagaaatactactatcaagatttcacgtcaaataaaaaggtactgtcaaaattaattactccctccgtcccacaatataagggattttgaatttttgtttgcaacgtttgaccactcgtcttattcaaaattttttgaaattattatttattttatttgtgacttactttattatctacaatactttaagcacaacttttcgttttttatatttgcaaaaaaaatttggataagacgagtggttaaatgttgcaagtaaaaaatcaaaatcacttatattgtgggacggagggagtagcaatcagaccacagaccatatgaatgcacagggtaagcatgcatatagctagctagatcgggatctcttcacgccaacacaatttagcccaacaagtgcgtcggcatcaataaaaaaaacaactgggaacaaatccgagctcaaaagattaagatgaactcacaggaggattgcagctgaagaactacggccgaccacgcccaaacaacgcaacgaagccgatgggccgatggaaccgaaagtctcgtggatggatggatgcaatacagtcgtccaacctgcaaagtctagtagtctacccttccacgaattttctactctgaccggatccgttgctgtcaattttcgtatacacctaaaaggatacaattcgagttagttaccatgttagttgcacttaatttcagtccaagcatatagagacgtttggaagctttttcatccaaaattaaacaacttgcgatagattttttagatatgcccttaaaaattcattgattttgaatagaaattttctgactatatttaattcgtttggaatctcctctcaaaaaatgtctatgcacaaaatttatgcattaaaactttgcaaagtttatttattaaaagtttgtatacaaaggaaagttccaatagagatcgtctccatcgataaaggttttctaaaaaaaaataattccgtattttgatactccatggctagggctttgattgcagtggaagccctcgtcgattctcgatggcagaaaaaatgaaaagtttgtagcacaacccgtgtcgttcttgggtcaaagccaacatgacagtccaaaatatctaagcctggtataaagtgtaaaggatggatactcttctttttcgagggtaagagctctgccgatttcattaaggaaatagt

SEQ ID NO: 32873 - DNA, 1501 bp, Oryza sativa
acttccgatgcacttacgatccttcgaaacgacggaaacgccaagctaacacgtaaaacgagaaaaaagactaataaaaaccaaataaacaatacatataaagtaaacaaacatgtaggtcataattttagatgaattatgagacttgaacggcctcattctgacttcatatgaattaattatgaattttacaagattaattccaattaatgcctattaaagaaaagactattccaaattgattaaacaatttacaaaagatttataactgagataaaagattaaagcaacctccggaaatagattagactatatttggtagatgacatatattaaaaagaaataatatgccactgaaaagagaggaaatgatttatattgattttggatggctaagattaatcttgcaagcgaacctcacgagataccgactcaacgagtcaattctacgtgacacgggatcacccaaatgatcaaccgaaaccggcgaacgaaactggcggctctgaacggctctaaactaaaggacgactccagacggacgaacgaacgagcgaacaactcaacaacggctgcgactaaaccggtgggctagacacgattcatggtaaagccccggtatggcaaacgataggccggtaggaatttagggatgcaccttaggctttgcaactcggctaccgggcaacggcatcgaacaaaccacaacaacgacaacgcgggatagcggcggctagatttaagtgacgcacggccgtgacacactatagcagcaacggcacggcacgacacaatcacagcacggcgaccagtggctcagtggttgcagtagcgggacggcaacaacttggcacacacgagcaacggccaaacaacagctagcggtcaagcggtaacgcacagcaggagcaacacgactgtggcagggagggcacaacggcgactaggcgactagcgcagcggcgacggcaagcaacaacggcacaaccggtagcgacggtgcacaggctagggcagcagcgcggcgaacaacaacgcaacgggcacggctgcggttgcgacgaagcggcttggcaagcgcggccgatgggttgaaatctaaaccaatgagacaatgatagacgtctcaccgatccaaaacgatcggagagggagggatgatgacaacgttccgatagcaacacatggagacgacaacgctagacaaaccacggattagattatattggattaagaccctagggaaaaacctacactggcgaacggcatgggagcggcggttgccggcgaacaacggtacaataatgcaaacggagggcactgggaggaagaggggatcaaagtgacccttaccaccacttacgcgacgacgaatggcaacgaaagatggccggcgacgagcttcgaagggtggcgaggtactgtcctcgaaggcgacgactttccggcgatgtgcggcgacaacggaggggtggacggccatcacctcgcagctgcgaac

SEQ ID NO: 32874 - DNA, 1501 bp, Oryza sativa
tgtgcgtgcaggtacttaggaccggggattaccgaagtaacttagaagcataagaacatgatgtatctaccagagagaaccagaacaagacgaaggaacatagagcttatgtgcgggagaattctttcggacaagagacagtgtttttctacctccttagggaatgagaacagacaccggtagtggaagaggtatatgttgtttactcctcttgatggaagagagagcttatgtgctagagagttctttcggacgagagacatagtgtttttctaccttgtgggaaaggagaacagccggtagtagaaggcggcaaggggtacgtgttgtttactccttttgatggcctccgcatgatatagtggtaacatccgtatgtgagaaaacgaacagcccgccgctccgtctccgtcacatgccctgcgtgggagtctgacaatccatccatcacctcacccagttaataggtgcactcaaattatagactatttaagttgaggttttttttcattgattttcaatgcgatataatctggacatgggatttattagaattaatctggacatggtcattttaattctaacaaacccgacattgtctgcctgggacagagtatagccttaggatgaaataaaagtgtattgaacatatgtaaataaaactcttcatgaggtttttagtaataattgtatcctttcggattatatggaaaatgacagcgcaatggatctgatctggtcatacgatacatcttgagcaagtgtagagggttggtcaactgtgtatataaataataattcgttgcatctatccacgagcctttcgttgccggcgactccatcgcttcgttgcgttgtttgggcgtggccggagttgttcaactgctgctgtcaactgtaaccctcctgtgagttcttcgataccttttgagctcggatttgttcgcgacggttttttgattgagtacggattcaggcttgcttaactaaattgtgtcggcgtaaagagatcccgatctagctatatgaccaaattagctagtatatacttcgctttgcactcatattgtctctggtcttgattgctaaataattttggcagtacctttttatttgcggtgaaattctgatagtagtatttcttttgcttctcgtaggcaaaacttatatcctgttatccatttttcacccagttctccctgaggaattaatcaggaccaaacatggcggaggcgagcagtagcacccaccggcgtcgatcgcaagctcagatcagcaagatagcccttcggtcagacgtgtggaatcacttcacccgtttcaccgacggagatgggcgagccaaagcacggtgtaagcactgcccccaggtgctcggcgcagaaaccaagagcggcacgagtaccctttgggcgcactggaatcgccacgagcaacgcgaagaaataccaggcgaagaatcaccacaacagacaccaccaccgctgccgcctgctggccc

SEQ ID NO: 32875 - DNA, 1090 bp, Oryza sativa
atgcttggtggatggagcgttgacggacggagcgaacgctccgtccgtcttttttttaaaatttggtcattattttctctggcggctggtatagtgtaacggccagcaaaaaaaaatattttcgctggcggccgtcttaaaccagccaccagcgaaaatggatttttgctgaccgctggcttaacatgaccgccagcgaaaatgttttttcgctagcggtcgataaccgctagcgaaaatcttgattgtcactggcctctgctttgtggcgggtccaaattccgccagcgaaaacccaaaatagccgccactaaagatggatttcgtcatagtgcaccttatagataaagagaggcgaacgtgtataaaaaattcctcatctcgcgtataccctggtactaacgatccctatacaatgcaaataccgtagtcgtgatctacaacatgacatatacgaactcgacactataggttcttaaagttttttacttataatttatactttaaaacacatatcctatgaaagtgacataaataaacatttctaacatgataaataataaatcaagtagttgtaaattacaatatactccctccatattttaatgtatgacgctgtcggtgacatgggatcgggagtatcatgactagaggtttgaggcagacacaatcgcccacgtggcctggcaccctcgggggacgtcgggcccaagatgtgttcgccctcctcttagtccccccgagggggtcgagccgcacccgcctcggccccgagggccgaggcgccccgacccctcgtgggttttcgctccgcgtgtatgggttaggtgggcacagtggggctcacctaaccacatttattgcggtttggctgagcgtgtcacgccgcatgtaacgcggtgcagtgcactcatttatccggtctgtgaccagtcacagaccggtcagatcgcgggttaggtggcgacaggcgatctgacgcacgcctcgccccatcccgtcaggacaagggcttctaggcactcgtccccagctggatcagcgtgttacctcccagagatgacacgttagtcctggtcagatatatgcc

SEQ ID NO: 32876 - DNA, 1501 bp, Oryza sativa
tgacacgtggaagccggccgaaccgccaccgcgtgacgcctccagaagaaaaagttgttcacattggagagagagagagaggagcaacgctaatctgacgacggcgtcttcacagaaggaataaaatcggaaggaaaaagaaaagaagggggatggaggacacgttgtcgcctgggctaagcttccgggtgtccacgtaggcccgctgcatcctcgtggattagttggatgccgcgcctcgaaggttcttgctcgcgaagaaaatcaatttgactcagactactctctccaattaatcatttccttatttcactttctgtgctactagtttaaagtttgccaatttagggcctttttagttccaaacaaaacttttcacgctaccacatacataaaatatttaatgtaaaaaaaatcaattacatagttcatcaggaaattactagacgaatatttactaatgtggtgatacagtaaatatttactattaatggattaattatgcttaataaatttgtcttgcagttttctggcggaatctataatttattttcattattaaactatatttaatactttaaatatgtatccgtatatccaatgtaatttgggataaaattttactaaacgggcccttcgttcgggccttcgtgtttaatacagtagtctccggtttcatactaatgttttagataataattacttggcctccaaaatttatagtcccaacataagtacacactgggagtctctgactatgttttttcaattataatatagaataaataaatagttttttattattgcacgttacgaacatgtctaataaatattattctaggatcattaaactaaatacttttaaagttattatagttgaaattgtaaaattttaattttaaatttattaaaatggtaaaagaattaagtaattaccagattaaacttgatagccgcagcaattggctccgtcccctatagccaaatactgttaatatgtcatgaaaacaatattttattgataaaagtttgatatatgttttcttagcgatttacacatctttataaaaaataaattttgataaaaaatactttaaaatcagttgtacaactaaatttcaaaatttaaatttagacaacggattctgtacagaggtaaacaggaggcctctccacaaataagccaatcatccggaaaagtgatttcatccctcgattatatgtcctctcgttttgtatatgttaatagttatagataaaatattaaaaagccacaagataaattaatataaaatatatcattacacaaatatgctaacacaaattcaacttttacaagttgtaaaaaaaatataactacaaatatccgataattatttccaattttatttttttcaacttgtagaaattaattttgactatacgtttatgtagtgacatattttatattaatctatctttattaaaaattaatttttttataaatatttagataaaaatg

SEQ ID NO: 32877 - DNA, 453 bp, Oryza sativa
ccacctgtcggaagagagagggagggagaggccggctggggaggcaaagcagacttgagggagagagagagccgagcgggccgagggagaaggccggcccgagagggagagaggggggggaattgggccgaaaggggcccaaagagaggagggaggattttatttgttttctttttattttaattggttaaatgatcttcgtgactttaaaactatttctcgagctccgaaaattcacggaaaattccggagagtacattagggcacaaagaatattgcaaaatattcccggccaatgatttttaagggaaaattttaattctcccattatttcacttgattaaattgcttaactttttattcaatttctaggaaatgcattattaaatgatttttaatcccgaacgaaaatcggggcgttacaggctattaccttacatataaggggcccga

SEQ ID NO: 32878 - DNA, 384 bp, Oryza sativa
catcgacttgcttcttgacttccgccaactcgctggctcccattctgtaaggcctcttgtggatcggtgcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactgatccttggcttctgcagcactggagactggaaggttaccacctctccttttgcattggtcaacttgatggtgcggctggcgcaatcaatcactcctctatgccttgtcaaccaatccattccaagtatgacatctaggtcct

SEQ ID NO: 32879 - DNA, 482 bp, Oryza sativa
taaacttagtatgttgtaattttatagaaaatacagatatgtagcatcaacctatctaaaaacacattaagcaagctgacttataaatgacatgtgaaaattgaagacatgcatgtttctcttgagagacgaaaatccacctcctcgatataagaagtgctatccactactccctctcccccttatatataagtgattttggtaggatatgtcacatccctccaaaatcacttatattataggacagagggagtagaagctagctaaggaattcagccgtcagaaagcaaacgtcagcaaccgcactagtatacttataaccccagctagcaggattatagtataactatacataaattaactactattgggggagtggctccggattgacggagttcatctccgtcaagtagcttctatcccggagctacccccatcctgggaaaacgaccgaagacagcctggagctcccatggccatca

SEQ ID NO: 32880 - DNA, 1501 bp, Oryza sativa
actacgtgtggtgttccatgccgccaagtcgacgacgacaagataggttatcccaaatattttacttgcgtgatttcgatgaataagagcaacaccggcttcagctaacaagagtagggctatgtcacgcccagaaatttagcccaaatttccagactattttgtgtattaaatccctgtccaggaccagccagggtacacaaaacgacaagtaatatacagttccaaacataaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggaccgtttgtggctatttgcataaaggcggttgtaaaacattttatttagcaaacagtaaaactgttgagtaattaaagtaacattaaaatctccactgatcaacgctacaccacgttgaacaggcccaaccaacccacctgtactacagtgcattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgac

SEQ ID NO: 32881 - DNA, 938 bp, Oryza sativa
gtggatctttcattcccttgtttccccaaaaaaagcacatgaaggtagtattagctatccgcatgttgcagtaactaaattaggtaccggtatgaatccacaccatttttttatatcagaaaatacctgaacaattaagatttttccaccaaaagaatcaaataaaaagttgagaggaatggaaagattgaaactgaatatgctctcaataacggttgctgcgccaggatcatatgactgaatttgtctgtcaaggaaaaagaattgcaggctatactgcatatatcaacggttaagtctatgataaatatactttgtgatctgaggatacagctcttattatctcatccacaagtggcttgtcaacccgttcagttctctgcacaggaatttttcggtattgcttagtaaccatgtattatttaaatatttgaggaagcaataaccacatcatacacgtactgtaggatagtattccttaagaatgcctcctgctcttgacctcaagaagagcagaaggaggcgtgcctgcaaactggaaagccatgaagtccgtccttcctgtttgtatttttcattcagtagcattgagttaatttgtagcggaagtaatatagttccagtgctaaaaattcgatcctaaatagtacgatttatttttgctgctgtcagattatcattcccaaacactggttgatataagcacaaaagatatgtatctgaaacattaaattgttagccttatctatgctactattcagagttttaaatgctttaataattccaacaaactagaaataacatgcacattgcatttgaatgatacaacagtttctacaagagaggagcttgcgctaggttagccaaaaagaactgctgagattttagtgtgcatattttcaatcgtcctaagtctaaagtaacacgaaaatgtatga

SEQ ID NO: 32882 - DNA, 669 bp, Oryza sativa
cagttttgttataatttaccacgttattgttgcagcaaactgaaacgtgacgctaatgttgcagcaaactgatagttttgtcactaaaattgctgttttctgaaatctacactttaaaaaaagtatatcttttttcctctctatctacgatgagaaaatctagttataattctatttgtatatgtatgactaacatgtgggtcccactagtacgtcggcgctaccgtggcatgacacgttagcacttggagcgggtcaaaacccgtttggacctaaatgacacacaagacaagttcggagacctaaaaatatattttaagagtttagggacctcaataacacacccgcacaagttcaaacaccgtccacgtatttcactcaaattttgtttttttaaaaaatgcatcgtttagtagttcagaaaacgtacccgtggaaaacaaggaagtaggactcgagaaatgtgagaaacaaactaaaagccaagtctataatgcaccacctacaatctaacataattttgctacaatttggttaaaaaaatttagttttgcaaaatttactcaaaattggacgatattagtatgaaatacgtccaaccaaaatactggagagaactcattggacaatcaacggtagataagcgcacgaagctacctcacgttccca

SEQ ID NO: 32883 - DNA, 1501 bp, Oryza sativa
accccacggcctcgcatgaggcacagcaagcggtaagcctctcgaagctgcttcttacggcagagcgcattcagcacggtggtgtatgccagtgggtcagcagggatgcccctgtggagcatttcgtcgagcagggtggccgcagtgtggacctggcccctgcggcagagtgactgggtcaggatgcggtatgtctcggcgttgggagacacatggagggagcggaggcgatggaagagggagattgacacggcgaggtggccggagcgggtggcggcttcgatgagcaggttgtgcgaggcgaggacgagcggctcggggaggggaaggcgggtggagacgtcgcggaggaggtgtagcgcgcacgggaagtaggaagcggtggaggagagaacggagaggaggcggaggagaagctcggggtggagcggcaacgggctggggccggagacgaagagggagttgaaggtggagaggaagaggtgaggctgccggcggaggcggagcgcggagaggagcagcgggaggaggatccgcggggagggcggcgacgggaggcggcgcaggagcgcgagcgcgtgggggaggtgttcgcggcggcgggagaggcggagcgcgagcgcgtggagcgtcgacgggtggggcgcggtggtcggcgcggtgacggtgacgagctcgagcgcgaggagcgggtccggctgggaggtcacgagcttgtgcagccgcgccggcgagatcggcggcggcgccggtggcgacgggagcatcggcgcggccgtgatggcgtgggctcgaactgggagatgggaaccgaacgaggaagatggtggtgtactggtgtaggctccggcccaacaaaacatgggcttggcccaaagtggagcctaatagttagtaggctacttgttgtctcgggccattcatatgggctgtggaccatgatgtcttgaattcttcccggcctcacacttcaacccaacttcccaagtatggagagtaggaagagagaacatggagtgatgctgctggcttcaaatagtctcaaaacacacatttgaacagaatttatgtttgttcaggagatagcgtacaggtgagagttcgtaatatctttttcaagacatcatatggtatcttatatctgaattttatgattgatcacataagaaaatcagctagagcggcacatattttctatttttatatagttgtaattcagtcaatattaattattaaaaatgagatttcatatataagtggtgtgcaataagaatgaagtttaagtgcacacgtaaaacgataaaaccattaacgcatgattactcgagttttaattattaactagtaaaaatatcaagttttaattattacatacttaaaaattattttatattatataacttttgtatagaaagtttttcgtaccaagcacgttgtttagcagttaaaaaacatggtgacaaaatctaaggtataatctacatcttaatgagggaggaac

SEQ ID NO: 32884 - DNA, 1501 bp, Oryza sativa
tcgatcagtgaaaggtgctttagctagcatagcaagcgatagctaagcaggcacagtggttgcccgaccggttcggcgagatactactgtacaagtggatgatcgatcgagcagctcgcgggcgagacgaagctcgcgggcgagacgaacgacaagtgaagcggccgtggccactagctgtagcttttactagctcgttctcttcgtgatctctttgggtggatcgattgaaacgtggggacggaggaaggtccccatcgttttctctaatatagcattgctaaattttgtttttttagacttaattttagtttttttatcgagatttattttttaataatggtatacaagtcgctaggtacgtatatataaaaatctacctacaaaattattattattattactaatacgttgaatgacgtatgtgatgaggacggagaatgctgtgttgttggaggaagtgtggtgtggttgctccacgcgtgcaccgggcgttctcctttctccggtgatacgtatacacccaactaggaggcaaaaatatctttgctaggtctgcgtggctgcagttgacaagtcctagattttttcgaaatatcttctcgatcggtctacagttctgtgggtggggacagcttcctagatatccggcagagcactactactattatcctacctgatgcaaccatctggctgctggccacatatactcgggtgtacatgcgtgtggttatggatcgatataatcatttcaggatcactcatcagttaaggttagtggtgtgttgccgcgggctattagaatttagaacttagaacttataaacacttcaatgaatgactgtcacagttcgatgatgtgactatatatggccgtgttcctccctcattaagatgtagattataccttagattttgtcaccatgttttttaactgctaaacaacgtgcttggtacgaaaaactttctatacaaaagttatataatataaaataatttttaagtatgtaataattaaaacttgatatttttactagttaataattaaaactcgagtaatcatgcgttaatggttttatcgttttacgtgtgcacttaaacttcattcttattgcacaccacttatatatgaaatctcatttttaataattaatattgactgaattacaactatataaaaatagaaaatatgtgccgctctagctgattttcttatgtgatcaatcataaaattcagatataagataccatatgatgtcttgaaaaagatattacgaactctcacctgtacgctatctcctgaacaaacataaattctgttcaaatgtgtgttttgagactatttgaagccagcagcatcactccatgttctctcttcctactctccatacttgggaagttgggttgaagtgtgaggccgggaagaattcaagacatcatggtccacagcccatatgaatggcccgagacaacaagtagcctactaactattaggctccac

SEQ ID NO: 32885 - DNA, 155 bp, Oryza sativa
attttagtaagattggcttaataatgttgccaaaattatataaacattactaatatttagtaacaagctaaacgcagtcacataattattaattttaccaaataatgatatggttgaaaatgtcatcaatctaaaaggccctagctacgtaacta

SEQ ID NO: 32886 - DNA, 1501 bp, Oryza sativa
accttttctgttaattgtccaaaaataagaatgatgcaaaccgtcaggccaacgaactggtaaagatcaaagctaggtttaaggtatcattatcaatcaagcatgaggaatcgaatcatgaccagtgtgctcaccatctccatctcgtgatcagttgatccggcgatctcgccgccactacctcctcctggactcctcgccccaatttcgacggcggtgatccccgtagtgtcacgtgttgccgatagttaaattcagattctgcattttacatacttgccgcttcgtgtgcaaatacgatcaccgaacagtagaatactccctctttttcacgttatttgacgttttaactttagtcaaaatcaaactattttaagtttgactaagtttatatatcaaatatagtaatatttataatactaaattagtttcatcaaatcaataattaaatatctttttataataaatttgtcttggttgaaaatattactccctccatctacttttgatagtcatattttcaaatctgtaaaatttattttcgataggcatatttcaatctaacaaattatcattttaacgactttctcggatttaatgcatgactctattcttccacgtaagattggctacatgagaatcgagaaatgtaaatattaatgaatcgcatgtttacaaggaatgactagtagcatgtttaaatggatgataagtaaaattacttatccttgatctgtgtgccaagatgaaatatgactatcgaaagtaggtggagaaagtactacaccctctgtcccataatataagggattttaagtttttacttataatatttgaccacttgtcttattcaaaaaatttgtgcaaatataaaaaacgaaaagttgtgcttaaagtattttggataataaagtaagtcacaaagaaaataaataataattctaaatttttttgaataagacgaatggttaaacagtgcaagtaaaaacttaaaatccctatattataggacggagggagtacttaacttggttaaacttaaactttgaccaaagttataacgtcaacggagggagcagtacattgcttcgtgtcgtcagatatcatctaatcccatcccatccatcccgtgatagaatttcattgatccacagttccacacttacacatatggcaatgtcagttgccaacaatactcctgacaatttcgatggcaacacccaccctaaacacacaatcaacaggtttctccttataatatcgatggtcaaacaaaacagcacatcatcaattgaacgaaagaactactgtaagcctaaaacacacgttcgtgagaacatctagctttttttttaaaaaaaaaagacagggagaagggcaatcaatagctccagctctagctactatactttgatcgagcgaagcatgtttcgcagggagaaggggcacttctgatcaggctgggtgatatccgtcagctttacatcacatctacttggcc

SEQ ID NO: 32887 - DNA, 1501 bp, Oryza sativa
taaacctattgcctcccagaaaccttgagcgaatgggcaatttagtactgtttttgggttaccttttctgttaattgtccaaaaataagaatgatgcaaaccgtcaggccaacgaactggtaaagatcaaagctaggtttaaggtatcattatcaatcaagcatgaggaatcgaatcatgaccagtgtgctcaccatctccatctcgtgatcagttgatccggcgatctcgccgccactacctcctcctggactcctcgccccaatttcgacggcggtgatccccgtagtgtcacgtgttgccgatagttaaattcagattctgcattttacatacttgccgcttcgtgtgcaaatacgatcaccgaacagtagaatactccctctttttcacgttatttgacgttttaactttagtcaaaatcaaactattttaagtttgactaagtttatatatcaaatatagtaatatttataatactaaattagtttcatcaaatcaataattaaatatctttttataataaatttgtcttggttgaaaatattactccctccatctacttttgatagtcatattttcaaatctgtaaaatttattttcgataggcatatttcaatctaacaaattatcattttaacgactttctcggatttaatgcatgactctattcttccacgtaagattggctacatgagaatcgagaaatgtaaatattaatgaatcgcatgtttacaaggaatgactagtagcatgtttaaatggatgataagtaaaattacttatccttgatctgtgtgccaagatgaaatatgactatcgaaagtaggtggagaaagtactacaccctctgtcccataatataagggattttaagtttttacttataatatttgaccacttgtcttattcaaaaaatttgtgcaaatataaaaaacgaaaagttgtgcttaaagtattttggataataaagtaagtcacaaagaaaataaataataattctaaatttttttgaataagacgaatggttaaacagtgcaagtaaaaacttaaaatccctatattataggacggagggagtacttaacttggttaaacttaaactttgaccaaagttataacgtcaacggagggagcagtacattgcttcgtgtcgtcagatatcatctaatcccatcccatccatcccgtgatagaatttcattgatccacagttccacacttacacatatggcaatgtcagttgccaacaatactcctgacaatttcgatggcaacacccaccctaaacacacaatcaacaggtttctccttataatatcgatggtcaaacaaaacagcacatcatcaattgaacgaaagaactactgtaagcctaaaacacacgttcgtgagaacatctagctttttttttaaaaaaaaaagacagggagaagggcaatcaatagctccagctctagctactatactttgatcgagcgaagcatgtttcgcagggaga

SEQ ID NO: 32888 - DNA, 554 bp, Oryza sativa
gtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcagttttttttactcatgtaga

SEQ ID NO: 32889 - DNA, 1501 bp, Oryza sativa
taaacaggcccggagcttcatcatgtatcccttcgcacacttttcatggggtatttatttattatttaatttttcaaatctaatactaatatcaacttctatttttatatcggtagtaagatatgtttttctgcttaacataatgtttttttcctatagctagatttgttagtacgttcactcacttgtataatgatatcaactcaataagctaattatgaataaaaccactttggctttttcatagtgagccatcttgctaagtcattcgatttacgaatgcatttctaacttaatcccattaaatcgataatatgaatttgattatattacacgtatatcaaatataagagttatttatccatgcaatagtataagagggaaaaatctttattttgggacgaatacagtagttgaaaatctacaatcaaaccaatcatgaaaagcaaccgaaagaacctcatcaactaatcaaccacttgacactcacgattagcaactgaaaatatctcatatagtactaatcaattagttgtcagggctaatttagtttcttgtagtttgacatttgacaaccgcagtttgagaacacttggcagctaaccttgtgagatctagcacacatgcaggatggtcgaatttcaccctcattccccaccaaagctgcggttgtttctgtagagatccgagattggcccggatgttggcatgcagcagcaggatggagggagatgggaggagattcaagcccccctgccattttagcaaaatgcttggagtagcagtagcgtataaagaggggggccactgagccattcactgcgcgtgccgatcctgaccggttttctgaacactgtgctggaccccggatcactgtagcaccgatcgcccatgggatcgtttaatggggatcccgatcgagaacaggatcggcacgacgtacactgcgcacacactcatcgaaacgacaagcgttgatcgtttgatcgatggtggcattgaaggtttcgccggcctgagcatgcacgtagtacgttacgtccgtcgtcagagaggggaactccattatttatttcctactctatcgtctccgatctgaaccagaaccagaccaaacttcattctcgagtcagagaccggagtaggcgaaggccggtgcagtgcatgcagagcccccagactgctcagggcttttacacccatactactccatacacacacacaaaaaaaatgttaccacaatgaagttccggtttgttcggtgaattgtggcaaggcagcgtgttactagtaccgtgttaccgtaacgggaggcaagcactgtggagagcgtcatgtacgtagtgggagggacgtggtggtgcaaggcaacaagagtgtgtgggttttttttttttacagagagaagagagagttgttcttttccaggaccagcaagggcaaaggcaaaggcatgcagcggcagtgcattgaaggagggggaggagggggaagagatcga

SEQ ID NO: 32890 - DNA, 1501 bp, Oryza sativa
cggtagcataaattaaattttttctaccgcgtaaaccaggacccatacatgtattagatcatagatcattatcattcgacgcgctgcgcagcggaagaaagcgataagaaggcgaaggaaccctcaggatgtagcgcgcgtcgatgtagaggaagtagttgaccgcaccagctcgaccttctccttctcgtgcgttctcctcgccgtactcccacgctgatcaacaccgcaaagcagcggctcctctaccggtattcacatgtatagggacggaacgccacgcgcagatgtgctagcacatgcgcgcggctagggttttgctcgaggaggggagtggcggctagggtttctcacgtgatggaatacctccgccggtcacacccctcacaaatatatagaatccatgactcgggcctccaaggcccgtaggactcctattcggatccctatccgaattaagctcatattggatctccatctaatccccttattccggcccattaagcgtgcgaccctgtagatttatgtacactcggctgcaacccgaaaactccttttcggtctacgtgtcaacagcggcccctagcagaatgtattgatcgaccgggcatgcacaaagatcatctcggttaaacctctagtatatacttgtatgaacccctttgccttacgatatcgattaagctcaaggctagatatgtgccatcctcttcgcatggattgaaggctcgctttatcaccttatttgcatatgctttctcctataatattaggtatatgctatttccatataatatgaaccatgtatagcatatagtatatcttactcgtaacaccaacactatcatggagcaggtgatcgacaagaacatggaagaaattaaaatggaatcttggagcataggaggagcgaggagtaacggtgatcttgttttctcccctttttttagcaacatttttttatattttccttgttgagaggaatggtgatcctctgtttgctgtcaaattctcaattagaacagaaataaccgcttaggcaatattcttttctcgtcaatatacatattttatcttaatttccgttagcatgttttttcaaaccacgaaatataccatttatgaaaattttatatacaagtcattttaaaaatttagataaatttatttttaagtttatactccatccgtttgataatgtaaaactttctagcattgcccatattcacacacacacacatatatatagatatatgtatatacctagattcattaatatttatatgagtgtgggtagaaaatcttaccttataaaacgcggaggaagtaataattaaaaatcaattaaccatattttacgtatccgtacttaagctccattttcagcaaatcacagcccatccctaaaaaaaaaaaagcaaatcacagccacaaaggcccatccgcccatgtggctatgtccacgaggcccataacacgctcgctctccctctctctctcc

SEQ ID NO: 32891 - DNA, 693 bp, Oryza sativa
atccaaattactgcccaagtttcaatttactcgatcattttaaacataaatatcagaacatttggttgctttatggtatttttcaccgcgccatgtttgttctatggttctaaacatctttttgcaaactcaatgcttcagttttctttaacaaatttcaaaacatttatatttttcaaaagttcatctcaccaactctgcctgacatgcagcaacaaacacacaccagctcaaagagcaacagcgaggtgttcaaccaagaggacagtgttccagggtttagggtggaaccacgggaacgtccaactgcggtgcagctccctgggtacagttccacatggaacaacatggagggcgacaatgaccagccaacagtacctggccgcgcttgctgctcagtgcgcgtcgcgaatccttgtggcataaggaagaaggggtcatcacactcgctcataccacagtttggtgcgaccgatttgaggagcactgttgaagctactgatcataacgactcaccagacaggcatgatgagaacaagaacccagaagtcaaggacggcatggtaagcatagctttgctgctgctagagcaaatactgatgaaatcctgcaattctgcacgaggataaaaagattgtataccatgattttgttttatctcacatttcttgtgcatttgccgttgtgatcaga

SEQ ID NO: 32892 - DNA, 589 bp, Oryza sativa
cttcatctttagtctaaccttctgccagtgtgtctcaaagcactacttacctgtgacgttatagggcacaactttctgttgtcaacggctcaatgatgttgatcatagcaagtttagagaataaattctgtaagtttgtcgttcagtttccagaggtatgctggtttgatgtaactctcgcaatcagaattcatgatcgaatgataatatttctagcaccatttgcctgcttcatttatcaaatgtcggattcttctatgttttccctgttttctgggaacaatttgaaacaaagccattccagcattattatagatcacttggtgccaactgggttttgttctgtacctgctcaggcaaatggatggccatcggcaagggttcactcgcaagatgtaccatagccttctgaatcattccgttttccatcgacttgatgcagaaccacacaagcaccaccaaagcaactcttctttttctcctttggatccagctcagtttctcatgctccaggagagcagggctccaaattaaataaggaaaaaatcacaatccaactgttgaaaacctcacaaaaactcttaatttc

SEQ ID NO: 32893 - DNA, 1425 bp, Oryza sativa
ccataagcacataagatgccttcttgaatgagtggatcaaattgagaccaattttgacagatcactttccagatatctgcccttgacaagaaaacatcattgagtacgcttgataaacctctgatgacctgatcatactcttacaaaacaacacatttttccatgtggctgttcatttttcaggtaatttggaaacaattcacatgttcaccaaattttaggacaaaaaaatacaatcgtatcaaatagaaaactcaagtaagatttatggagaagtgaatcatagaaataattaaaatgaacataaggcaacaaggttggtgcacaattaatttctttcttcccatcaaactaacccaaaaaaactgtaaaaatgagaaaagtaactaaagaacactatttggttaaaagactcaccttggggaggaggcatgagtacgcaaatttcagcttggtgtgaaggcacattccaaaagcaagaacaaagaatctagtattaatctgtttttccctttcgagaaaacattatgggttccacccatttcaggtaggaacaagtgtgacaaatagtaagaaaaactgaacttggatttacaacagagagatttcacattgagagtttgattaagttacttctctccctctttctctctcgttcctaacaaaacacataaaaaatggaaaaattctcaaaagcaaaacagcataccattagaggtaactaataatagagtatgaaatgaatgcatgaagtgaatgaatggatgggagaacttgaagaggaatggctcgaataatttaccgacaactaaatatagttaacactttggttttcttaaaatagtacatgactatgcctttatactcttttgtagatagaataacttgtaaccttatgtttacatcaattaacgagtttgtaaattaaaatagatgaatgttgctacagatagagagatgcataaggaactctctacatttctagcataagaaagacgataacaaagatgaattgataacacaatgataatcatatcaacttcaataattactaaaataaagctcatagtttattattaattttgctaaagcaaattgatggtgagagaataatccaacagtatcatttactgttcaaaatttacatacaatagcaaagattaatacttagttatcagcctagtgactaatgacaggttagacgaaagcaaagtaacaaatttcttgttaaaaatatggatgacaactcgaatgcaactaacagtaaatgttagacccttcttacattaataattaattaagcaaatgggaattcttgaagtcagagtggcagatcgtaactaactttagcatgccattgatatttaatcttttcttgaaaaacgaataccaagcttaccttttcagacaatagaaaaggagtat

SEQ ID NO: 32894 - DNA, 1501 bp, Oryza sativa
aacttcctagatctcatcacagaaatgtgatggcttagacaggacggtatagaaaattaacaatatcgaccaacaattttcttgtaatatattttgagaaaaaaaatctaacgatatttatgctacgaaaaatctttcccaacacttatacatacatatttcatatggattgtccaaaagttcattaaaatcagaataattttgttgctagctagcatgccactttttcaccagagggattgatctgcaatctgcaccataaaaatacaggaggtagtacaagtgggctttctattttcttacaagattataggaaagcgggaagtcagacaagtagggagcacttccctttgagtggaaaaattgagccacatatatacaaatttgcagtcagaagacttagcaacaaagtactgcaagtaggcgtagttaaatcaaatgagtgctgtgctgtccacatccatagtctggacataactaatggcattgactggttcccaactatgaaatttcttcagagatactccatctagtccagtcaccctcaagacaattaacaaagctgcagactgaagatgccattgttacaggtactagaactgtgcctcctatttagatgcacaagatttgggatcctgatgcatatgagcctgtgatatagttacattgacatgtgcatggagaggatttttttcctttgtgtgcttctacagtagccatcttcatcttgaatctctctttgtgttgcttcttctcttgcaaatttttacgtgcatctccatatgctgtaatatactaatctctccatagagatctttctctatagcttctgttatggcactagtgtttgctggaaaggcagtggcaactgcagccatctccttctggatcaacaaggctttcacctacctgaaagagtacaaggttgaaggcatcgaagatattaagaacaggctactgcagtcgatgccgaagatccaggtcgttctcgatattgtcaatcccaggtatgtaaaggaacagagcagtgcactagatgcatggttatggcagctcaggcacgcagttgaggaggctgaggacgtgatcgatgtgctcgagtactacaaactcaaagaaatggcaaaggaccacaaggttagtgtctggggttcctctttctctaaggtgaagcacaaagttattaagtctgttaaacatgtcagtattttggacaagaatttgaaacaatttactcaccggggcactctcaagaggttgagggaagctgtggagggtttagacaaggttgcttcagatattatgagcattctcacagtcacagaacatctcaaagaggttgcttcgtgtagtcagcagcaggagtattcaacgaacgatgatcgtgcgacaggtttgacattaactccacctaaatttgttggacgagaaaaggagaaagaaaagatagttagatggctgacaaaggcatcaactgacgcttctggaaatttgatgagca

SEQ ID NO: 32895 - DNA, 627 bp, Oryza sativa
cgttggctcttggctaactatgtttacctgattattaaagttatattctgctttgtcctaatgtttgtagccaaaactagagctgatcaagtgaatcagtattcagactctttaccattcatttttcttaagttgagtttgcagctggagcaggaacatgacttatgtgaaccaacatccgatgtttttggccagagcttggtgcttatttcagcataccaaatgaaaataaatatccaatgaactgcaaatatgaacttattatatttagagtagttccattgtgcaatgcaaagatcactgtctatcaagcacatatgaaagctatatacagcgtaatatatttttactacccatggttcattatactaaaaaaaatgtcatgaaaatataatggcactcattgaccatgctattgtgttgtaactagaagataagttgcacttattaatgcctatcctttatgttcttaatatatcctgattgctaattttgttttgtccatgatttttttccatcttgtgttgtgattcggtatcagctcttgccttggatcatctcgtggacttggagtgaactctaattttctaagactaaggagacagaagaacagcaattacagcagca

SEQ ID NO: 32896 - DNA, 671 bp, Oryza sativa
agaaaatctagcataaggttctaccttatatttttttttcttccaatggcacaagttttatgtgttttcctgtgtgttatccaaacggtagttttggaatttttctatgtttttaatttctataggaatttaatgggcatgacaatattcatacgtttttcttttcatgtttctgtgttttcccaatcctacattttaaaggagcccttaaatatctctctcccagtatgtgcaaagcttgagaaatgatgtatatatccatactgtgaaagtttaataggggaaacttattccagtagttttcacaaaatctgaatattgatgatcttatttgcaactatatcgtatatatacgagcgtgttataatgaaacttattccagtagttttcttgcacgctactatctccttgtctaaaaaaaggacttccaaagaaaggagcctaagctttaaatgctttattccttttgttatgccaaccttggaagccaagggaggaccttggagcccttgttatgagtactaaattttacacgagaatcacatatttatgtgtgatggtttttcaaggggcctttagtaactgggaagaaaaaaaaagtgctttccctatatagttgagatacatttttctcaaatatctgacaagcatattgcttgattcattttaga

SEQ ID NO: 32897 - DNA, 1501 bp, Oryza sativa
ttttgcaaagattggtgtctttttaagagtagaggaaacttcctgtgtgtttaattgttcgtcaaaattgaccactcattaggatatgacgatgtctgatgaatatggatagcttatatttgaccgcccagtttgtatggctggatttaatgaccttatcataatcagatatggtaccatttttttcccccaaacaagtgataaattccttctgcacacgtttctggggatggtcctaggcatcatccttcagagttcagactatctggacaaagtgtgcgttccgacatatgcacatttttatcgaggaacatataactactgtagtactagtatttttcaaaaccacattacatcccaagaccaaacctttctcgcttgttgaatcaatcaccatttccttttcgtttactgcaccatgctaagcgtaattaggctattcccaactcaatgattaggatgatgtctatatcattaaataagttatcatataggataaaaaatgatgtgacaagtgaataaatgagtaaagagaaggaaactatgttttgcatgagatattgtttctacacaatatccaagacatcatgtgagataagaagcattaaattgaagtatggaatagtgatgtttgtattggaagagtagtgtctagggggtgtttagatgaggctaaaactttttagcccatatcacatcggatgtttggacgctaatttggagtattaaacatagactagtaaaaaaactaattttataaatgagagctaatccgcgagacgaattttttaagcctaattaatccataattatcaaaagtttactgtagcatcacattgtcaaaatcatggcataattagactcaaaagattcgtctcgcgaattagtccaaggttatataatgggttttgtaattagtgtatgtttaatactctaaattagtgtctaaacatccgatgtgacagggacttaaaataagtcactggaaaccaaacaggcccctagtactagtttcttgatgctgtggagtttatggaaactatgtctaatgggttgagaatggccttactagtactaattcactgtgctatggtacagtgatcagtcttgtcatcttgtggtaacttgcgcaaggcagatccgtagcagtacatgtgaacttacgatgcacgccctagaaagcgaatctgaacatgggcaagcacatgctgctcggctcgctgctcggaataacctatcacatatactttaatcaagaaaagtgatggatcgcatcatgggtgtgccgccctttcttttcctgggttgatgctcctcaactcgtgcatacgtaatctattgcttattggcttagttgcgagatatttttgttcgtgtggggtttccgtattattgcattataatattgctcaaattgcaccttctgatcccactacaatattgcaatcgattctcactttctcatcacctgcgattgtgattgttgttgtaagcagcaaga

SEQ ID NO: 32898 - DNA, 477 bp, Oryza sativa
tttttattgttattctatgatgaacgattggcattggagattattagttttgatatttggaatttattcacgaagtggttttggagatgattggatttcacaggtgatctacaggtactgctggatgtggtccggtcagaccggcatgtatcacgcggtcagaccggcgcagcccgcggtttgaccggccgactctgtgtcggtttcggtttcgggttgtttgtttagatatccgtgattgtttcatgattatggcttctagatggatactatgcgtatgtaatactgttgtttgctactaatgagtcaagttggggatagtttggtctcggaatatggtttcttttgtttgttctatgtgtaggtgactcaagatgccgggagagtatttgcggtgatggatcgggagtcggctcggggataagacgacatccgtagtggtcagagatcatgcgggatactaaggctagaattcaa

SEQ ID NO: 32899 - DNA, 380 bp, Oryza sativa
tgggtattttgctcagcgtgtatgggttaggtaagacggcggggctcacctaaccacatttattgcgtttcggctgagcgtgtcacgccgcatgtaacgcagtgcagtgcactcatttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgaacatgtagattgctaagctgacacgtggtggacaagaa

SEQ ID NO: 32900 - DNA, 1501 bp, Oryza sativa
ttcaagagtgcaactactctacaatgtgaccatgtgatctatgatgcttcggtatgtccagattcaagaatgttcaccttgattagttttcgtttatgaggctacttctgtcagaaatgttgaatattttggtatttaacgtagcaattttaaatattcttaatttttttttctagactaagagctttcctctttattaaccaagtgaattactatcgatatgctgtcattgcagcaagaatgctggcacctgaaacaggcacgtgctacagtgatagttttgtgcattaaatttgcacctacgttagctatctgttttatagacaacttaaattgaagaggatgtcagactcagctcttggatttcattcagggaatcatggttgttgctctctctgaatgttgactgccctcaatctccacagattgacaggttcctatcctgggagtcagtctcttctatcgttgtttcatcaatctattcagttccttcttgattccacaaggggcttttgacaaggaagggtatcctgagctgcttcactttcatgcattcaatttagtgaatccatttggtgcctatagccaggttagtgaatagctacccagatacacttctttgaaacatgaatccaatgagaagttgtatatctcagccatggaatggcctgtgataatttaaacaaaatatttctatgctttctttccctcctagaagaccagagggacacatcacacataagatggctgccacatatcaactgcccaggtatgcatgatatgtggtcttacctcagccccacagttatcgtaaaaaacaatttttacatgctgttttttcatattacaacccccattcttcttttgagcgaaatatctccattcggcttaacttgatgtttttaaaataactttttatggtcttcaagatgcaacttcagccattaccttccttttttcttaaatacgcaggagatctgcatatttttatattaagaagaaagaaaagccataaccttccttaccttggtgaaactggagagaactttccagactgggttactgcactcgtccacgatggggctcaacatcctgatatgccctctgataactggtgctatgcaggtagaaccgcatctcatcaggccagtccacaaaatcttattctgaatttccaattgaagtcctagaaaccatcgcaataattttcttgttttccaaacacacgtatccatatactttctatgcttttctttttatttcttgtttgttttcctaggttttgatttcccatatttcaaacagggcctattatgacatgttgggaaattagggagctattgctctatggccccagcttgagattttgattctcgttccccacatgctgcatgatgttcatttaatgctaaacaattcattgctcgttgggacatggaaatggggcttctcctttaccaattcaatgacattaagctaccacctaggtaacaagttctat

SEQ ID NO: 32901 - DNA, 1501 bp, Oryza sativa
ctcgtcatctcgcggcgccgcctctgtcgtcggcattgcagcggcgtggaacacgccgtcctcgtctccgtgcagccgctgccagctgccctcgtcgcctcctcgccggccccggtcatcatcgtcgtcgtcctctcgtcgttcccggtcgtcgtggcgttcgtccctccatcgagccgttctcgtccgtcctcggtgtttcgtcaaggtcgctgcaggccccgtcgtcgtcttcgtcctcggctctgcgtcgtcaagcctcgtgccagccgcgtctcgcctttgtccaaggatcgccgctgaagtcgtcccctcgccgttcgtctctgtcgttcccggccgtctccgccgcgcccgttcgtcgttgtcgttcccacgcctcgtcgcgtggtggtaaggatccctctccctcgctgccccgtcctcgtcctttcggtgtcgcccgtgtctgtcgtgcggttgtcgaccccggtacctgtgtaccggtgtcggtagtcgttcgcttgtgcgtgtggtgaccgtgttagtgtgcccgctcggtagccgcgtggtttccacgcgtgcagcccgtgtggtgtctagtggagtccgtttgtcggccactcgcctcggttgacacacgggatctgcttccgtcgacccgtggaccgtctctgtgtactcagtttaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattacgcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaa

SEQ ID NO: 32902 - DNA, 1501 bp, Oryza sativa
ttcttttatctgaaattacctcggcgcagacagataacatttcatcactgaaatcatagatcagatgataagcattccaatggaaagaatcacaacacaatgacccccacgagagagctcagaaatgcatcaggcacctactatataaatccaaaacaataataagaacaaaaaaagaaagaaaaaacccaagaacttgtctacccaacgcatcgtccttaatcgcctcgcgccacgaatcaactccacatcccgattagaccaaaacgcacatttcctccaaatctccctcccccaaccttatccatcaacaaaaccgagagagaaaaacacacacaatataacgcaacgatgcaaccaaccgccacctgatgataggaaacgaaacccgcgcgtattcaccgcgggaacaaattaaccgcccccggcatatatatgccaccaggaacaagcaaggaaaaaaaaaacccgcgctgcggtgcggcggctgcaatggcgacgagcagaggagggcgcgcgggtgggcgtcgcgtacctgtgcctctgctcgcggcagcggcaggaagcggcggcgttgatccctctcgtccggcggcctcgtctcctcctccggtcaggtggtgggagttaatctaccgccaactcctcctctccatggaagttgccgcctcgcctcgctcctcgtcactctcaccaccaccgaaccgaacagtgaaggcacttcactcactctgctccgggacgcgcgctcaaaactcctctctctctctctctctctctctgtccctgtgtcaaaggcaagcggcgcaaacggatccgcctccgttttacgtgtgcttgtcagtgggtgggggcctccggagggggtggtgtggtgtgttttacatgtggtgcgtacttgcgtacgacgggtggcaggggtgttttgacgcttggatggatgttgggtggtactctggccgtctgatgactgctgacggatcacgtggatccatgagaacgggtctgggagctttctatgtgggcgggattttgactgttgaacatgaacatgtaggatgtgtttggttgcccgcatcaacggtggctcgcaccggtacggtgcatgcagcgagctcactgtttggttgcctggacggaggagcgagccaggatgggcgggtgcaaaattgcctctccgagccaggccgaggaggaacgcaggcagggccggcttgcatcccctcaccaccttctcacatttgctcacacacgattcagtaggaagaaggaagatgaagaagtcgatgatgtatctagacactcgaggtcaaggggcgccgccgccacagcctccattgcctttctcttcccatcctcaccgtcggcggcaccgtcttcctcgccggttgcttcctcccttgatgagctcccacccacgcaccagattccaaaaacaacgagcttcggcttctagatccccgatgacggtgacgaactgcatggagcgagaagagcggtc

SEQ ID NO: 32903 - DNA, 1501 bp, Oryza sativa
aagctttcaactacacacacctcgtcgtggccccacccacccctcttgcatgaataaaaccagcctgtccaggccatagctgtgaagacaaacattgcgccatcacattctcaagaagaggagaaggagagatctggagaagaagaggtaggaggccattgccacctgaccttctcctcttcctccattcatcttctctttcttgggacatggcgaccatcctggagaacatccagaaggcgaggttcttgccgacaaggccgctcaaggacgagctgccgacgttccagggcggcggcggcggcggtggcggtgggggtggaaaggagagccacctgatggggctgaggaagaggctgtcctccttctccgacaagatccagcccatctcctccgcgtcggcggagtgggcgttccggcggtccaagtcggcgccgtcgctgggcgcgttcgccggcggcccgctgaagcggtggtgggactggggcgtcggctggctcatgtccaagaagcccgggttcgccaccgacctcgagatgaacgaggaggaggtggccgccctcggccgcggcagcaggggcagctggggccacatcctctacaagatgcgctccggcgtccggcggctcgtcacctcgcactcgctgcccaccacgcacagggcggcggcggcggcgtcggcgtcggcccagtgcaagccggcggccacgttcaactacacccagagcttccacagcgggcaaaccgccatggcgtactgagagcttctcacatgttcctccagtgagaaacatgaccttttcttggtcgccgtctccatgggatccaaatgaagaagaagctcagggagattgatataatatatggtgatgaagatgcaactacgattacatgtaaaattacacggtaaatttgatgaatgatgaaaaaaaaattgtagctcactacgtgatctgttttttgtgtagatctagtgtcctgtagaggccgaatgtatgttcgttctttcaattctttttggagttcgttgggcgatgtaaatgtctccggtcaaattccttatgcttttgcctcctgcagtaaataaaaagctaatgaaatatggtgcttgtttatttgttcttgggatgatcttgcagagtttcagctcagatctgagttctcattgtaatgagctaccatctttctctttaccatgatcattttagcatctttgagtagttacatgtgtttggtgtatgaagatcaagaatagctggtgaatctaacaattaatctcacaaaaaaagggagattacaggtgaggtgtcacgactgaacaggtaggcaggaggtcggaatctgtcaccatgtgtgttagtattacatcatgaaagtgtcctcttgtgaagcacaagaaaattagtggttcggtgagagtggcacagttttcatttaggcgatgctgtactttttgctcgtgcattcctccagccttcgatggagaaaggaacggactttg

SEQ ID NO: 32904 - DNA, 183 bp, Oryza sativa
tgaggagccaaaactgccacctagactaagaacttcgtgagcaacatcctccacagtgcatgtggtctacttttttcttcacagtgggtcccacccgttctctctcctcacttgttatctctcccctctctctctctctgcctttccccacatcccatgaaccgctccccctcctccttcagt

SEQ ID NO: 32905 - DNA, 1501 bp, Oryza sativa
cgtggcatttgggcactgcattttgagagagtggcaaatagtaaattctcccagctcacgtggcggcgtggcgtggcgcgtcgcgtctgcaggggaccgggagccgtcgcctcccgaccggcacgtggcgcctactctgctgcctcaggcaagacaacccagcgatttaactaccgcatcatatcatcagcaaagttaatcacagtacagtaattagtactacaaggtgtgctccctccctccacaaatataattagaagtatcgtttaggttttctttaagggccctttgaataaaggaattacgaaggaactattgaaatcctataggaaatcttcatatatagctcttttgattcaaagattgaagttttctaaatcctacagaatttctatagaatattttgttgcatataggttttggaggaaacttagtaagaggttgtccaacctcttagtaaaaatcctctgagtctatctctcttatccgattcctgtgttttttctgtggtctaatctaacgatcattcatgtgttttgcaatcctctgttttaaacttacattcttgtcataattctatgtttttactattcctccgtttttttatacctacgattcaaaagggccctaaattaagaaagaaagagaagatctcatacagtactccctccctcccttgatataaagggattttgatattttgtttgcactatttgaccattcgtaatctttaaaaaaaattagaattattatttattttatttgtgacttattttattatctaaaatactttaaacatagtttttttgtttttatatttgcataatttttaaataagatgagtggttaaacagtgtaagtaaaatattaaaatgggagagaggttgtactagttaccccataaaacatgtgctagtgctacgtagtactagtatcaactatcaagttcggattaaccgaaccaatacaaccactcaaaagtagtgtagtggagtacagtaactatagaggagtattacttactaaatgagtggtggttggtccgtgataatagtactaaatgtgtataattaatacatacaaataaaaatgcatatactgggtcagttctctttgacagttcactgctgtctctagctcgtaccggctcagttcattagggtgaaactgttttgccgctttgtccaaactggggtcacattaactaaccgactataactgatcactgtattaattataatcagtcacacacacacccctcacaccagccgtgtccacgcgcgcgcataaaagctccccctcctctctgctcgtcccggtcgctgccgctatcaacaccaacaaacaccgcgcctcgcctcgtctcctccgatagcgacgccgccgccgccgccgccaccgacgccgggagtgacagcgagtgagatcgtcatgatggatcacctgagcctggtgccctacgagggcggcagcgccggcgggggaggaggtggagggaagt

SEQ ID NO: 32906 - DNA, 938 bp, Oryza sativa
gcaccggtttaacagtttaggcagttaagatatctggttttgtagttcagggtcacggattagattcgtgtcacttaaaatatcttgttttgtagttcagggccacggattagattcgtgtcaattttaagggagtcaaattgaacctattccctcaagctatgcaggttcttcttccttctgcactcgcttccagccctaaccctagccacgcgcacttcaaaatttcctcatcaaggagatcttcttcttccgctcgtaatgctggatggatggatggacgtgctgatgtgatgatcccttcttattgttgcgccaacgccgcgaacgagccgccctatgatgggtgagggtgagttggttctttcccctctctgtgggtggggaattttctttctttgttcgatcgccaaaatgggccgcattgatgaatctgatatttcctcttccgttcttgattttttagcatagtgaatctgcccctacctgtatttggaggcggacaggaataacttgtagggcaatcgcgcggtgaatcggcagttgaaggtgccaaatgacaaaaccgcatttggttttactgttcatgcagggcttatttgtattgttcaggactcaggagattagtcagggttcagagtcattggatctaattcatgtgatttgtgcgttcctctgtcagtataatccacgctgatgacaatgggcataaattttccccaagagatgtcttcccatcaaattgagctatctaatacttattttttagattgttagtgcattgaaatttaaaagaaattaatttatcggttgattattttctttctccccaaccttttcatgatagcagttttcttaatcactatttgaaagtaccgattttcatttcttaacagatatgttgactgaacaatatgacaatactgatgatgttgaca

SEQ ID NO: 32907 - DNA, 1501 bp, Oryza sativa
ggcacggcaggacggtggcctgtgagtgacactgcgcgacaaaaaaggaggcacaccggccggtctggcacagaatcacacacaccgcatcgcgttgtcgccgcggaccggagaggcgggcattgtaaggccattcacactacgtcaccaaattttaccattctttccgtgccacatagatcaataacgatacaaaccacatcctccacagataacagatgggaccatatattaatagtataataggcaactatttataaattggctattagattggctatagatgaattagagctagtagtggactatactattaaacttgctcttacagcaccacagtacaagctacatgtagcggtgggtcccaccatctctctctcctttacttttactttttcaactccgagaaaatggacatttagccattttcaaaaagcggttttcgctggaatgccattctgaaaatgtgtttcgctaaaataccaatatgaaacacgcactcatcgccactttgctattttggctattttatgcattttcaaaatcattttcgctcctccaccggatgatgagacgaaattgtccttcaggtgtgtcgtgagcgtggcgagcaggggacacaacaccttggcatcacggtgacctaggcgacgtggattaagcggggcagagcccgagccgtcctggctcgcggatgatggccggcacgccggtcggcgatggccacaagcacccggctctggcggcgaggccctccagggcgggcgcttgtccccccggtctccggagaaacggcgtccggcatggcgaacgaaggcggcgtggcatccgggtggcggagaagggactaagggagtggaggaggatggcggcggcggccctcccctcggtggcgatggagaccggggaccatggagcggcgctagcacaggagggcgtcgaggggcagccgccgacggtagccatcgtcagcttctttgtcgggggttcggcgacatcatggccgtcgccgtcgtcagcttcttcgtcggcacgctgctgtgcaggcactagcgccccggtgataacccgctaacgaggatcacgcagatgctcgtcgtgtcgacgaggaagtggggtgtggaggtccccgccaacagatcgcggctgcacgagtccggcatcgagcggtggagacgccggaggacaaggcatcgttgtcgttggcatggaggccgtgcgtctcccttcgctgcggcgttgccgtcgtcgccaccgctgctttgctttcgcttgccacctcctctatttcggccacgcggaccacctcgccgcgctcgtcctctttctcccatgaactggatcgatcctctttcagctggtgagcaagggcaatttggtctcattaagccgcatttcatcgaaaatgcacaaaatagctaaaatggtaaagtgacggtgagtgcgcgctttatattgacattttaacgaaaaacgttttcagcatggcacttcagcgaaa

SEQ ID NO: 32908 - DNA, 268 bp, Oryza sativa
tgccatgatggattggtatttggtgttgccagacagagaggaatgaggaaaccagagactcaagatctatccgttttccccctgttcgatgcatgtacccatccactgaaaaagcttcatttgcgaggaaaatgatgtcatgttgaacttcactgatatcagagtgacaagagatgtcatgttgaacttcactgatatcagagtaccttgtcacgagggcatatcagagagaatatcagacaaaactgctgcttataagcaccaatta

SEQ ID NO: 32909 - DNA, 1501 bp, Oryza sativa
gtgcatcaccgccgtcgcggtgcgcgccgcctccctgggcccgccgccgaggaggtgcgcggcggcgtcggacgccacgtcgcgcgccctccgcgcgatgtcggagaggttgctggccgcctcgccggccttcgccttcacggcctcctcggcccgcgccgccttctgcgccgcgcgccccgcggcgtcctccgtgcactgctcggctctctcggcgacgtcggagaccctgtccttggcgtccatggcgcgctccctagcgctctcccgggcatgtctcgcggcgtgagagaccttgtccttggcattcctcacggtctctgctgctccgtgctggacgtgagacgccctctccttggctttgcccgccgcttcggagaccttgtccttggctcccacggcggtctccttcactttggacgcagcgtcgaacaccttgtcctcagctatctccttagcatgcgagagcgcctcctctgcacctctcgccgcctcctccgcgccgtgctcgcctgccgacgccttgtccttcgcgccctcctccgcctccctggccgcgccgcagagcctgtccttgcaccgcttcaccgcgccgaacaccttccccgtcgcgctctccttggcgtcggacatcttctccttgccgccctccgccgcgtcggccaccctgtcggccgcgtcggagactgcgcccctggccttgtccgtgagcctgccctcgccgccgtcgagggagtcagggggcaggacgtgcgtctccttcacggcgtcgccggggtacagcgggtgctcccgctcgtactcgacgatgaccacgcggcgtccctcccggacgacgtgctcgccggccgtggacggcggtggcgtcggcgccggcgaccacacgccggccgcggccagggtggagagcacgagcccgatggccaccacgttcatcatggcgagagcggcacgccgtggcattggacgaacactcgtaagcttccagttccagtgagtggagtggagggagctcagtgcgaagaagcataagctaccgcggtaaaagtgcattgctggttcgaccacgccgcctaatgacgggcttaaattcgcgcgctcgctgagccgccgatggttgtagaagcgcccggcggccgcggcggccgaggccgtggcgcgctgccgcggcgtacgcgtggacgcgccgcagtggatgcggtggcgagctcggcgtcgccgcgaggcgacacgcgtgggcgggacgtggccgcgcgtcgcgcggtttcggttctcgcgcgcgtgcgggcgcggccggtggaaaggtggggcggcccaaaaaatcgaattgggtgggcttcgtctcggcctgcaaaggatagcccacaaagcgggcccaaaccgagaagcccactttcactcgcgtcgtcgcgacgcaagcgagaaaccctactcggtcggggaagccaccagcccacgacgactcgcctggacgcgccgccgccgtcgccgccgccgccgc

SEQ ID NO: 32910 - DNA, 1501 bp, Oryza sativa
atatcgatttggttagggtagcttccctgaaaaaaagaagaagaagaagttagggtagctgcctcaatttccgattcaagccatagtatataatttatataaaatatttttacttctttctttcttgtatttaatttttttcctcctttttcgttttcctcataattccttttccttgttcacgcacgcaactgttgaggcagaaatgctactgggcgagattctcccccccctctctctacttggtttcttttttttacaccgcattactttcctattttagtaaatttatacacctcaagtttacacatctaaagtttagagactaaaagtttataagtcaaaagtttatatatctgattcaaatttgaatttgaattcaaatatttttcatatatagtatttctatacatctaaagtttatacacctaaagtttatagacctaaagtttatagacctaaagtttatatacccgattaaaatttaaatttgaattatatctaattaaaatttgaatttgaattcaaatgttttctatatatatagtatttctgtacatctaaagtttatacacctaaagtttatagacccaaagtttataagttaaaagtttatatacctgatttaaatttgaatttgaatttaatttttttatatatagtatttctatacataaatttttctaattttttgttttttaaaattttttatggtatactgtagactatattaggaagagaagaagggaaggaggaagggaggagaggaggagatgaattggcaacgcgtcacttgcatacatcaacatagtgaggggcaccgagtgggcaggtccaggtgagcgactgggctagctaggcccaactaagtgctcggagctttttttttttttttctctttacgcttgtgtaatgttggagaatttggttacgcttgtctagaggttttcgttttctttctcaaggaacgacccctcgaattcaccaattcattcgcaattgattaagccacgtggaccaatcaaattctggcacaacggccagcttgagattagtatactagaaaatgagcgctcccgttggcgcgcaggctaacttttagcctataatattatcgtttagattcgaacttttttctttaaattttttaactttttcatcatatcaaatgtttagacacatgcatgaaacattaaatgtggacggaaaaaatcaattacacagtttgtatgtaaatcgcgagacgtatcttttgagcttaattgcgttatgatttgacaatgtggtgttacagtaaacatttactaataacgaattaattaggtttaatagattcgtctcgtagtttataggcggaatctgtaatttgttttattattagtttatgtttaatacttcaaatgtatgtccatatactttaaaaattttgtcacacgaactaaacacagcctaagttacactcctttttgaatgtgtaaatattgttgagtaccacttttat

SEQ ID NO: 32911 - DNA, 1501 bp, Oryza sativa
agcataaaaacttgtaatctacctagtcagatttgtaatttaaatttggtggataatgcatgttggaaacaaattagggaggcagctaagtcaatatttaactaatggatatttctacttgattgcaatgtcattataactgcgaagaaatactcagtcgcgatagtgagcaggagtgcatggtacattcaatttcatccaatcgaaaattgcatcaattattcagtatttacagccgaacctaagtttatcaaatacaaggatacattatgttcaaattatgttatgtgtataatgcaagtactacttgtcagtcatttcatgcaggggataattacctcaacaaaaactttgtagtaactcctaattgttgggttagagaagtcgtctttatgagtaagatctaggctaacctccttccccatctcacagattgcaaagtgctttcaaaataaaattcagcagcagcaccacggtagtttacaaattcagcagcagcacctcggtagagtaaactgtcaattgccctattcccccacataatgcataacattaaatttatttctttttgaataaatttatttcccaccccaacggaagaagagaaagaaaaacaactgtctggtattgacaaccatgtttttgacctcttttgattcagcaatgcttacttgcagtgtactggtacagaacagacttacttgtgggtgggcagcggcagcgtcgccggctggggcgggtgggcagcggcaacgtcgccggcggcggcgttggcggcgaggtgaggaggcgatgcggggatctggcagtcggccgccgccggctggggcggatggggcgaggtcgcggggatttggtgcggagtcgacggcggcggcgttggtggcgaggtgaggaggcgacgcggggatctggagcggagtcgacggcggcggcgtttgcggcgaggtgaggaggcgacgcagccgcgagatgaggaggcgacgcagcgctggcgcgatacagggaggagggcgaaaaaggcggcgagaaggcggcgtgggagaaggaggagtgggcgtggggagtgatctcttggatcgagagaggagcgagcgtggggaggagatcgatcattggatatggcaaacggatggttgagattaggcgtgtctgtcacatgcgtctgctgtgtcaggaatcaagaccaccactacgaactttttaagtagtagagataacatgtccagtataaataaatctgttgagttgtaaaaggttgttgcacatatattttgtcctaattaaataaggcaactgatcatcgagataaaactaaactgttctgaatcatcgacttctttttttacactaccgtcgactttttttaaaaacggattgatgcatgtaagtgaatatcaaatcttagtggaagcggataggttcggacttcagggttctagtctaaatcaggaatttacctttttacaaaaacattactacctccatcctaaaatatata

SEQ ID NO: 32912 - DNA, 1501 bp, Oryza sativa
aggctccttgttggtgatttttcttgtgagttcaccctcgagcagaccggccgaagcggcgtttataaccgacgcctcggttatgtcttgaacttggcaccaggcttgcgagaagcgacgcatgtattcccttatcgactccccctgcctttggcgaatgccgagtaggtgttgttgcgtcttcggctcttcgtaggtgcctcgaaagttaaggacaaaaacatcgcgcaattgctcccatgagtaaatgctattggctggtaaattgaaataccaagaacgggcgatgccgtctagagcgagatgtattaccttcgctttggtattctcgtcaccatgagccgcttcgatcgctgactcgtagatggagaggaactccttcgggtcagtttcgcctgaatagcgcgggacgggtgggaacttgaactgtggtgggattggacgagtcttgattcccccacttagcagtagccccttttcgcctcccgtcctgtttaccgccccttgctgcgggtacggtgtggcgaagggcgaaatcgcagcttgtgcgtggggttgggccgtggcattcgactgcccggctccaactggagatacttgctgagccgccatggatgggtcgaaaattggctgcgaccacgtcatggccgcttggattgatacttggtttgttccaaagcctggagttggagcttgccgccgaacggttagcgcttgagcagcattgacgaagttgaactgcggtccttgattccatggcgaaactcccaggctcggctgaatcggtggcaaccaattaggcgccccttgacttgtattcccctccggatgggccgatgggtttgtacttgaaatgcagtggggttggttgagttgctgaaggaaagcttggagttgcgcctgcagagccgaaaccccttccgccactgtttgtggcgcttggccaagtggttgatggtgtacttgagcagcgactggctgttgtacgtgaggggctggatgcgctgctacggccaattgctgcttggcgaagtacatcggcgcttgtgcgacttgtggcggaaagggctgagtcgtcacttgcggatggacttgaggtgggacataccctgccgaatactgaaggattggagccgacgtaaccttggtccacctcgccgcctcgtatgcttgttgttgttcttgcatttggcgaagcatgtcttggagccgtgtcatgttctgtcgcatggcttccatgtcggcttcggcttgtgcttcggggtcagggctgacttgggcctgcacggcggcgagcgcggttggggtcgctgttggctgcaatggagcggcttggggcactaccagttggcttgttgaaaggatctccgccctggtctggagtgccctcgccgccgcagccgccttcgccatgtcggccgtgcacttgcacagaggcggcaggggccgaaggcagttgtgatggcgcagtcgtggaagcagatggtcctcctccatcttc

SEQ ID NO: 32913 - DNA, 1501 bp, Oryza sativa
ttttcttaaatacatttagtcaacccgaatgttaaaactcaaatttaatagtaagaaatataatattaaaaccaactatctactgctatagcatagaattccctagcatagaatagagggaagtctattcatacgtagtcacttaaaaacgcagtggttctttccgtaaaagatctaaccagtaaaacaaattatatataacaagggctgaaatgaaaaaattatgttggcccaatgaagagacggcgcaccgtaggcaactagagatacgtggttatacttaagcctggtttagttgaggaaaatttttagatttgattgttatattagatatattagacatatatttaaagtattaaacatagactaataacaaaacaaattacagattctacctgtaaactgcgagacgaatcaattaagcctaattaatccgtcattagcaaatatttactgtagcacaacattgtcaaatcatggcgtaagtaggctcaaaagattcgtctcgcaatttacatgcaaactgtacaattggttctttttttcgtctacatttaatgctccatgcatgtgtccaaacgtttgatgtgacggaatttttggaagtttaaagggaactaaacacagcctatgacttttatctttccactgcgaaaagacgcaaataccaccacacatgtacatgactgtgtgtactgctacaaggtatccttttaataaatccttaatcttacaaaagatttactagaaggaactcagagagtgcaaataaaagcattaatgaactgttggatatcatccacactttgtaaaatattttttttgcctttcatactttgccttaaaatatttggcagtgtgtggaattcaccataaaaatctttgccaagtgtttcatgcttaataactctcataaaaacccacttcatggttcatttccatttgctagtataaaattgtgaagaaaaatattaaataaaattatgataaaaaaaaacctgcttacctgctccacttacattcgactaacaacttattaaatgtgacaatttgtgacaaagaaatgtgtttatagcgagtggactcattgccaagctaggaagtcggtatgtcacaattatggcatgaactaataacctagcctctcggttggtaaaatttgccagccacataggtagaagttttacacaacaaagatgacataagacttcaaaccctaatgaatgaaatcatgcaccacacctctaccagataagtggttcccaccttcaggtctttctccttacattatcaaggcctttctggaaccaagtataaatatatgtgtagctactcgcaacctcgctcatgcatatcattgtgatcttttgtcaaatcatctaccatatgatctccagctcagctctataagctgattcgattgatctaggtgagttgatcgtgttgtttatactatttcaatatgctaagatattcatgttcaagatatatagttgatccc

SEQ ID NO: 32914 - DNA, 1501 bp, Oryza sativa
atgtggcattcaaccggatcatgcactgacggccgtgggctacggctcgtactacggccaggactacatcatcatgaagaactcgtggggcaagaactggggagagcaagggtatttcaggatcaggaggggcaccggcaagccggagggagtctgtgacatatacaagattgcttcttacccaaccaaaaacgtcactggctggggttcatagctagttttgtaggcgatcttgtaatccatttgtctctgacaagaaagaaccggcctaagcaacgctgtgcaattcctggatgcttcggagtggagctcttaagcagcacagcaatggtttattatataatgacagcttgggtttttaagcaaaatggtcccatggtctagtggtcaggacattggactctgaatccagtaacccgagttcaaatctcggtgggaccttgatatattcttttattttttttgcttctcagcagacatttctcgtctattctcttccgtatatttttcacattttattttccctcttttctcctcctcaggtcaataaaaaaattgtcagcctatattttacacattttattttccctcttttctcctcctcaggtcaatcaaaaaaaattgtcagccacttttcacatttctcgtctattcattttcccagacatgctttttaaaaatcacatccagttcttgtttataatttttatttaaaaaatcttatccacaccactacttttctccagcgtctgctacagtgacgcaatcatgcaatcatttgcaatgaaattttctgatatgaaagccatgatacgttccaatttacttcctcctttttttaaacatataatactgttaatattttaagatagtttaaacattcatcttatttaaaacttgatttattattaaatattttttaagcatgacaaaaatatcttaatatttacataaaaattttaaataagacgaatgtcataaaagttaataacgtcgtatgttaaaagacagtggcaatggccctgtttggatccaagggatattttttagccctccctaaaaaatagtccaaatagccaaaaagatccaaaagggtgagctatttggaaataacccactcaaaaaaaattattctacccaaggggtgctaattgagcctatttcgggtggggctcactgaaaaaacgtcttttctctctatctctctccataggaagatacataaaagcaacccttgaatccaaacaacttagggctatttttttagagggttattttcttatctaaaaaatagctcttaaaataattcttgcctagttctacaaacaggttggttgtttatatttttttttagaaaaaacattccgcgtgggccatggcccatgagcccatgagagataggcctttcgagttcccatccgacgatctccacccggacaggtagtaaagcgcggtcgccgtcgccggcgacccatacagccatactgttccactcgccctc

SEQ ID NO: 32915 - DNA, 1501 bp, Oryza sativa
tggccgtagcagcgcatccagcccctcacgtacaacagccagtcgctgctcaagtacaccatcaaccacttggccaagcgccacaaacagtggcggaaggggtttcggctctgcaggcgcaactccaagctttccttcagcaactcaaccaaccccactgcatttcaagtacaaacccatcggcccatccggaggggaatacaagtcaaggggcgcctaattggttgccaccgattcagccgagcctgggagtttcgccatggaatcaaggaccgcagttcaacttcgtcaatgctgctcaagcgctaaccgttcggcggcaagctccaactccaggctttggaacaaaccaagtatcaatccaagcggccatgacgtggtcgcagccaattttcgacccatccatggcggctcagcaagtatctccagttggagccgggcagtcgaatgccacggcccaaccccacgcacaagctgcgatttcgcccttcgccacaccgtacccgcagcaaggggcggtaaacaggacgggaggcgaaaaggggctactgctaagtgggggaatcaagactcgtccaatcccaccacagttcaagttcccacccgtcccgcgctattcaggcgaaactgacccgaaggagttcctctccatctacgagtcagcgatcgaagcggctcatggtgacgagaataccaaagcgaaggtaatacatctcgctctagacggcatcgcccgttcttggtatttcaatttaccagccaatagcatttactcatgggagcaattgcgcgatgtttttgtccttaactttcgaggcacctacgaagagccgaagacgcaacaacacctactcggcattcgccaaaggcagggggagtcgataagggaatacatgcgtcgcttctcgcaagcctggtgccaagttcaagacataaccgaggcgtcggttataaacgccgcttcggccggtctgctcgagggtgaactcacaagaaaaatcaccaacaaggagcctcagacgctcgagcacctacttcgcatcatcgacgggttcgcaaggggcgaggagaattccaagcgacggcaagctatacaagctgagtacgacaaagcctccatcgccgctgctcaagctcaagcacaagttcaagttgccgaaccacctccccccttcattcgccagtctcagccggcgatccaaggacaaccgccaaggcaaggccaagcccccttaacttggagaaagttcagaacagaccgtgcaggcaaagctgtgatggcgatcgaagaagtgcaagccctccgcaaggaattcgatgcccagcaagcgagcaaccatcaacagccagcccgcaagaaggtccgaaaagacctctactgcgcctttcacggacgctcttcgcacaccacggagcaatgctgaaacattaggcaacatggcaacgcacaagacccaaggccgcagcaaggaacgactgtcgaagcaccatgcgaagcagt

SEQ ID NO: 32916 - DNA, 1501 bp, Oryza sativa
cattcttgcttaaaaaatcacaaaagcaaacctgaattaaataaactgaatatattttaatgaaatgaatacttttttaataacatgggttctacatatcgccgtagcgttagcacgggcaaattactggtataagagaagtcgttaaccagcaaatataaaattaccaccgggcacaactacggttttgtagcaaacatggcaattagatccttcaaaacaaaggggtagcttttcgtcagatgctcaagaccttcagtctccacgatgttcctcaaatttgctggatcttcgagtagctgcaagcacttcttctcaagctcggggcattggtgttccccagcaaacgccaacatggctgccacggttctcacagttacatactcacatagcttatcttcacagaccaaccttagtctctccatcttatacctgttagccgccgcgaccaggtctgggagcatcgccactgcgtctccacctttcatctccggcaacgagtcggtgtatatgaagtggagcagagcctcgaagtcctgcgcctccatgtcgtcgacgcgtatgatgacaccggcaccgccagtcgcggcattccccttctccgttagggagaaaagctcttggtggaacactggggatcgggccgcgagcacattccgatgcgccaagaacgtcttgccgtcgacctcgaacgtcacgtcggcgcccactccggtggcgaggaggccgccgaggtgccgggccaggtccgacggtggcagggttacccgcctgccgccagtgtcctttgcctcgggattcttcatgaccgtgatgtcacacctgatcgtgaagcggttgtcccggaggtactccgatctctccagtacggccttctggatgaaacgcagagatccccgatagcggccgtagccatcgaaaatttgcaacccatggctgtagatgtaggatgtcactggctcccgttcttggtcgagtaagctcaacgtgagctctgctctcacgattgagcgaccgtaatagtagtcgtgggcctcgtggccgtccaagacgaggtagatggatatgcaatcggaaacgttcgagttgaagccgttggggtagtagcggatgtaccaatcgtggccgccaacgcggaaatgccgagactggacgcagttgccgatggagacggcgtccttgatgctggagtagccgttgatctcgagcaggtgctggccgctctccgtgccgcctacaatcgcagaggcggaacgcagcagtttgccgccggcgacggtgggcgcggtggccattggcatatatatggctttaatttgggacggacaaatagtatcgagctgcagaatttcagataacaggagttttgacatcagtggtcgttattcggttaaagctgaatggaatcatcaagtgaggctgtgtttagttcagcgcaaagtttgcattttggttgaaattggagatgatgtgactgaaaagttgtgtgtgtatgacagat

SEQ ID NO: 32917 - DNA, 1501 bp, Oryza sativa
tgaaatcctgattttctgttgcagctcaatattgatcaaattagggctacaatggataaaacattgaaatggcttgttccaatggccatcaataccacgtggtactgtgctttgttacgtagtaatgaatgtcttaagcttcattgaattttagcttttcgagcgttcaggattataactacttttatgctctgtttgcatgaattctttaattgaactccagtgcccgaggcttcttgcggtttagcgaatgggcgagatcagggtaagaactacattatcgaatgccctacgagttcgttgtgcaaactaagatttccttcacacatggcatttacatttttggtttcgtatgctgttttcattcaggactgagagggttggaaggaggccaggccaaccggacgtggtcgagacgctctaccatgcggacaaggcgaagaccgaggactacattctggacctggttgtctggcttcaccaccttgtcaaccagagtaaccggccggcaaatgcaaaagacaaagacaaagagcagtccacctcacctctaaccaaatctgatcttgacaaggcacaacaagaatagcactgcactgcactgcactgcaccgcactgcacagcagccgacaagagcaaaacaccagacgacgcctgtgacctgtccgattgtttgatgtgggcattgtttgtaggttgtaaatggaagctaggcttcttgctgttgtcctaaaacttgtggtggcgacgtgggcatgcgttgcgctctgtacatgtacatcagtcaagtaggtagtagaaatgaggagccttttttttttctctccgattatttggtcgttacagagagggttctataatttcattgttgcagccattcggttgtcacatgttgtacgaaggggaagatgcaataaaaggctggtgattcatagaaaaagagtcaaaaatactccctccatttctttttcatttttgtttgacgtccaacgttatgggtttagcatatcagtatatggtttgattccatctttttgttcgaactgagaagctgaaaaaaaaaagatttgattcactgatacgtgttgccatttcctccagtacctttgttcgaaccgggaatgtatacccaaaaaggggaaaaataaaaagggttggggggagattgccaaagcgcatgtgtcatgcgcccgcgcagtcaatcgcacctctgggtggattgattcgtcatgaccaagatttttttgttgctacacgtgcataccgcacgtgatcccaccacagcacgaggactcacctcgtgtgtatccgggtgtgccgccttcatcctggcactcctcccactcggtcaggccctcttatcacccggagcgcacgcgccaagctccccggtacgggactaaacattctcctccccgtcgttgctggctttgctttgctgcagggtggagtactgtgcgtgtcccgtggcattacgaatagagtggtctggcatttctc

SEQ ID NO: 32918 - DNA, 1501 bp, Oryza sativa; identical to SEQ ID NO: 32910

SEQ ID NO: 32919 - DNA, 526 bp, Oryza sativa
ttcatgcatatttctattgtccgctcaatagtcaatttcactgcattcttcatttcccgaaagtcaagatcagccatcttgattggcatttggttaggacgaaagcagtgtatatctgatatacttccataaacgaaatcaagctatataatattaattacttattacaattttaccgttaatcactaagaatcaccttagcttctggattcacaaactttttatgaagaggtgtactgactactgaagcacattaccagagagaaatgaatgtgctgatttgaaaattactgtttgtcaagaagaattgattgtcgtaaagtttactttgtattctgtttggaacttataaaatacatctctttgtgtaacttagctgtcttaaaaaatcattacattcagttaagtccattcactaattcaatgtttgaatcaggaacacatgtgggctagtatgaacagttcatcagtaaagaatatacaatcttttataggctaactctggcacttctctctatattgcagt

SEQ ID NO: 32920 - DNA, 1501 bp, Oryza sativa
accttttaattcagatatatgcgcacaataacgacaaagccagcttcgtccagtattaggatttacaaatcttagtactagtactccctccgtaaaaaaaaaaaagtactagtactccctccgtaaaaaaaagagacaaaccctgagtttccgtgtccaactttgattgtccgtcttatatgagatttttttataattcgtatataccattggacggcgatgatttgacttgagtttcgaacaagtccttaagtctgaacgggtttgaactgaatttgaagggatccaaagtttcatcccgaaattaaaataaaatcctagatagtatgatatatagacgatgtccgcgaaattgcgaaacgttcccgatcgaatgcatgtacgtacgctacgccgccggcggcttacgataaattgattaatcccccatcgttcgtacgttcattaattagttgagtaattaatacgtactactagttcagttaaaaaatactaaactactagtcctagtactagttaattccagttatagcctgcaccacgtacgacttaggctgtgttcgttccagtgacattgggtgagaaagctcctcgttttccgcgcgcacgcttcccaaactactaaacggtgcgttttttgcaaaaaatttctataggaaagttgctctaaaaaatcatattaatccatttttgcaatttaaaatagttaatactcaattaatcatatactaatggcccacctcgttttacgtatctttccaatctctccaatccccttctcctcaaacacacccttactatacatttcgatctactcgtggattctaaattctcgggatacatacgtttgttactccgagtatttattttcatgtcatctgaagaaaatttttaaaattcaacaatgtagattaatatgtaatagatcactctacaaatatgtaagttagattttaacttgtacaagttaaaaaaaaactataactaataagtatacaatgtatacttatagttaaatttttttatctcgttataatttgtaaaaattaaatttaaccttatatgtttgtggagtgatttataagatattaatctatattttttatttttttcaaattttgtcataactatttaaatgacatataaacaataagggatgtctcctagagagtttagaatactttccttacttatatatactatcaggttttaataaaaaatctcttgactttttatatacattaatcatttattttatttaagatattatataactattatttatttttttaattaatttatagaaaatgtttatagcatgacttattttgttatgtttgtaaaaacaattaaataatatgagtatttaaacgtatatttagaagttaacgacgttgtatattaaaaatcgataggaatatttagtactccctccgtacttgtaaaggaagtcgttttggacagtgacactgtctccaaaacacaactttgacttcttgtt

SEQ ID NO: 32921 - DNA, 1501 bp, Oryza sativa
aggagctatgtggacaaaatgaaacgtgaaggaccaaattgagcctttggtgaaacttgaaggactaaattagctattcaccctttgttgttcgtaacctttggtattcttctagcaaaagatacttgtttaccagaataatggcaaatcattacctatatatttcaggtctgctgcttgcagaattcaaggcctagagcgtcttcaagctccatccattgagaaggtatgagttacgacagtaatactgtacatggtatttgtcatcacttgcataaaaatgagatagttgcatagtcacttatcatttgaacttgtaagtttagctaattattcagtttcctttgcaaccatatatgtgctccatcataataaatcctgttgaaaagatgggttcccctaactccaatctggagctatcaggtaggataattgcattataaccttgtaaactgtccaccaaaggtgtatcatctaacattccatataataggtccagttaacccttgacgcgttatcagaaaactcaaatcctagttggtctcattcttttatctttacccctttgttaagaaagcattaacctaaaactcactgtttttaatacattcttgtttacttctgtgagctttttggtattctaagaacattcttatggcaggcctggcgttctctacgcaacactcaggttgcacggaagaattatttaagacctggtttatctggaaaagtgaaagattgtgatagcgaccatgctcatacttatgggacaagttcttcatataatgttaacaaaatggacagtgtgtccagaaataggaatcccacccaggaaagtatgcatcagacgactgaaagtggtactatggagaagaacagtagccatctgcctgcaggcaccaagtcctgtacaaggacttacctgaacaatcatgtggtgcaggcagataccattacaacaacaaatcaaagtcttgcaagaactggtcctgaattattcaagactgctccttttattgacaacatgtgtgatgatgctaaattagatgccatggatgaggatgagcttctagcggtatgtgctttcgcctcatgattttttatcttatcaactgcaggtctgcaattattataactactatgtcataattgtaatggatccacttctcttctttgaatttttaactcttggtttacgtttcagagtattgatgtggaccgaatagtcatggaacattatcaagcaacaaatacacccagagggtcatccaaatctccattagagaagtgcaacttcaatggatttgatgagaataatttaccacaagaactctctataatgtgtgaccacggtagcaaggtaagccaagcagcaattaaatcatcatcattgttctttagactagtagctatttcagcatgtaagctcactagttgctacttgctactatacttgtatagctagctttttgcccagaggcgaagtctcatttgcttgaaa

SEQ ID NO: 32922 - DNA, 1501 bp, Oryza sativa
tggccgtgggagcggcacgctgccggcaaagctgcaccacgcgccggcggaatttactgtgctgtcgaccgagaggcaggcggcgcgcggagccgaaactgctgagcttctcgtggttcgagaggatcggagagattcagaggagcagttattattacttcgccgcgggctagcttttcgggatcctgatcctgcagacccgcacgccgcccttgccccttgcctctcggatcttcccaaccccggccacgactgcgcgcgcgcctccggtttttccttctccgcgaggagtgaaactctctggcacggagaggcccgagccgagccggacgtgggagttgggacggtgggaggggagaatgcaccgtgtttcacgttgatttgacgtgtgaatttagagggggaacacgcacgtcgcagtagcactgccacttctatagtgcttcgcttgacacgcttaggctccgcttcgatatggatgtttggatgagcttctcaactgcacgaaatgaggcaagcgattcatagcactgtgctagaatcggtttagggtttaggctttatgtattctattactataaatctataggacactacgaatttggacatgacctatctctagattgatagtgctaagatacggatggagtattaattattctataagaatacaatatttttctatttatcgaacggctgtactatctcaaactaattattggagcacttgatcctatgaatgaacgaaaaacaatttagatgattaactgatccaataaaatagttatagggagtaaaattacttctttttattttatgaaattgcataagaccgttagtattatgatctagaggtaacccaagatattttattgagaactgcactcgtattgttggcaccccttccagggtttcctataggtctatattcccacatctgatagccgtgacatgaaatttctgaacttacaggagttttaagggtgtgtttagttcacaccaaaattggaagtttggttgaaattagaaagatatgatggaaaagttagaagtttgtgtgtgtagaaaagttttgatgtgatggaaaagttgaaagtttgaagaattattttggaactaaacacggcctaatatgactgccattggtgactcctccctgccacaatatgccgcgcctcctactcaactcgaggtagaaggcgcttgacatgtcatcaacggtctgtttagatcccacatcaaaattttacaccctgtcacatcgaacgattgaacacctgcatgaagtattaaatataggctaaaaaataactaattgcacagattgcgactaatttgtgagacgaatcttttaagtctaattgctccatgatttgacaatgtagtgctacaataaacatttgataatgatggattaattaggcttaataaattcgtctcgtggtttactgacaaattctgtaattagttttttattagtgtccgaacaccctatacaaca

SEQ ID NO: 32923 - DNA, 1501 bp, Oryza sativa
tcatatatggatatgattaattttgctaataacataaaaagaaaattaaaagtgtgatgtagcgagagaagaattaggcaccaagggtttggtttttttccaacatttagctctgtttaagctgaaactgagagttgattacagaataattataatgtattttgttatgtagtatttggattttgtacaatttgtttgtaccggtgaaagaaatcattatgttataaatacgagcacaatactaactaatatcaatataattcttactaagacaagggtgttataagggagtttaatgccatcttttttttccgattccatagtttggattttttttgcacctttccaagtttctaaatggtgtcttttttaaacaacattttaactttttagaagtcaattgatttgtttataccctcaaatagctatcgcataaaacagataattcatcaatttcacctgtcctaaaccctaagtagtacatttttttcatgcgagtcatgatgatcagtaaattggggatcaacggataatcaaagtcataagatgaatatgtaagagctactatgaataactgtaaatatgcggcaaaattatttgctattaattagacatctagtggcttgctagccacataattaatttctctttacatgtatataaccatggataaagctggaacaaatattaccatataccccatacatacatattacgcggttaatattctaattacatgtgttaagtcttttaaaattccttaaaatactctcaagctgccacatggtgctctaataaattagagcaaatattagaagttctaagaaaaaaaagcaaggtatctaaatattataacatgtacgtccaatatcataatttgttagattaaatcgatcttagaacaaactaaatactacgaggtcccacctctcctcccatggcacatgtatacacctacgtacgtgggtactacgcttcccctccctttttttttttcatttttccctttcttcttttttctccatgcatagtcttccctccctttcttactatatcatgcgccttcatgagatgatttaatcacaagaattttgagtatcttagtctcgtatttttcatttgtagccaaactacactatatgatatagatggactgtataataatcaattagcaatagtttctcctttcttatttactcgagagagaaaaacacatgattcaaaagtcgtaagtacttaatccatctcctactcaaacgtttgtgaatggttttttaaaataccttaagaaaaatataacccttaaattattataaaataacattatccgaactttaatttacccttaatctatgaaacaaaattttttaaaaaatagtaatcttacctttcaataatataagtgcccgtgcatgcgcgcgggccaccttcctagttagcataataactcatttactttcatgatccaatcatattcatatggtgttttatacccgcatga

SEQ ID NO: 32924 - DNA, 1501 bp, Oryza sativa
agtcgcaatctgtgcaattagttattttttagcctatatttaatacttcatgcaggtgttcaatcgttcgatgtgacagggtgtaaaattttgatgtgggatctaaacagaccgttgatgacatgtcaagcgccttctacctcgagttgagtaggaggcgcggcatattgtggcagggaggagtcaccaatggcagtcatattaggccgtgtttagttccaaaataattcttcaaactttcaacttttccatcacatcaaaacttttctacacacacaaacttctaacttttccatcatatctttctaatttcaaccaaacttccaattttggtgtgaactaaacacacccttaaaactcctgtaagttcagaaatttcatgtcacggctatcagatgtgggaatatagacctataggaaaccctggaaggggtgccaacaatacgagtgcagttctcaataaaatatcttgggttacctctagatcataatactaacggtcttatgcaatttcataaaataaaaagaagtaattttactccctataactattttattggatcagttaatcatctaaattgtttttcgttcattcataggatcaagtgctccaataattagtttgagatagtacagccgttcgataaatagaaaaatattgtattcttatagaataattaatactccatccgtatcttagcactatcaatctagagataggtcatgtccaaattcgtagtgtcctatagatttatagtaatagaatacataaagcctaaaccctaaaccgattctagcacagtgctatgaatcgcttgcctcatttcgtgcagttgagaagctcatccaaacatccatatcgaagcggagcctaagcgtgtcaagcgaagcactatagaagtggcagtgctactgcgacgtgcgtgttccccctctaaattcacacgtcaaatcaacgtgaaacacggtgcattctcccctcccaccgtcccaactcccacgtccggctcggctcgggcctctccgtgccagagagtttcactcctcgcggagaaggaaaaaccggaggcgcgcgcgcagtcgtggccggggttgggaagatccgagaggcaaggggcaagggcggcgtgcgggtctgcaggatcaggatcccgaaaagctagcccgcggcgaagtaataataactgctcctctgaatctctccgatcctctcgaaccacgagaagctcagcagtttcggctccgcgcgccgcctgcctctcggtcgacagcacagtaaattccgccggcgcgtggtgcagctttgccggcagcgtgccgctcccacggccatttacttcgcctcctctcctgaggcaggtcggtgtcggtatttatgtatacttgcacagttccacttcccggccagtctcctcactctcgactactcttctttggtttttgctgtgaaggcgcgcggctggagacgggaagaccggggaggacaggaggatggtgccgg

SEQ ID NO: 32925 - DNA, 1501 bp, Oryza sativa
aagtattatgcatggtagttcgttggaagtccaccgacttggtattatgtcttccgtcttctgcttgttttgatgttcaaagtgagaagtattatgcatgatatactccgtatgtagtttgttggaagtctgctaacttgtgatgttgagcaagattcatccatagggtttgatattttttgggacagaaggagtagttcgaagcaaggttgatttaggccctgtttagcttccaaaatttttttcccaaaaacatcacatcgaatctttggatacatgcatagagcattaaatatagataaaaacaaaaactaattgcacagttatgggagaaatcgcgagacaaagcttttgagcctaattaatccatgattagacataagtgctacagtaacccacatgtgttaatgatggtttaattaggctcaaaagatccgtctcgcggtttcctggcgagttatgaaattagtttttttattcgtgttcgaaaacccattccgatattcggtcaaacgttcgatgtgacacccaaaaattttcatttcgtgaactaaacagggccttaaacagattgaacccacaccaaaagtcctaaacagatgtccccaaaactgaactgcaatgatccttcgttcgtattgatagcagtggaatattgggtggttcaagtctggctatccatgtctccatcactccatcaagtcctttgaaatttgaatttctggatcttgtcttcttcaactttgtcccttaccactcactatggtcctcgatgggcatgtaatgatctttttaatgaaaatgacccgatcagcgagtaaataaattctgagtgaaaatgaagcgaagtaccttactccacattttatcgctggttttctcccatgtacatgtagtctattctaggccaagcggactatttgcacttcttgcatggttacgtcctcctgcggtcctgcctaatatacctccctacctgtcattttgaggtcgattattgcctaaatgaaccgtaccaatatttggtactgcttaattttagtatagtttagcgctatcaaattttggtagaatttgatgcatttggtttaatgccttattaagttttactagtgttttaagagtagaagtttccaaaattaccagactttagtaaacataatatttgcaagagtagagctgagtcggggtatttcaattaggcacaatatattttaaaaacttttatataggactcaaagaggattttggagccaaacctagggctcaagccctaccttccctagggtggcctgctcctccgtccaggaaagcatgtcgttttaaggttgattgaacaaattaacaagtaaaaatgactatattaccatcatttaatcattgcatttgtcacttcaaattatgctgcagataattaattaatcacttatagtagaccatctattgcattgcacacacatgggtaatactagtagtggtactgttgtatagggaaataata

SEQ ID NO: 32926 - DNA, 1501 bp, Oryza sativa
cgagttttttttcttaggaaactatcaaaactatatggagggagtattatatattcttggattagagtatgttttatatggtttcttgtggaaagttattacaaaataactaacaacgataatgtaactagggaggcggagtcttgtgcaaaaccatagagttcattatctatcgttatggacatgcatcaggagatagaaattaatcattttgtaaaggaagaagacaaacaagaaaaaaaaaggtttatccattataactggatgatcgatatcaaaagaaagtcatgacgtaacttacattcaccatattagaggatctgcatctcagcgagacatgtgttagctgagtagttgagccatgataaaattatataatgaatagcattgtaagccattgatccattgtagataccgacaacacaggaggccggtgcttattggggcaatggaagaccttacaagtgggacgaaggaagggcgcacaatagagactatgaggaggagactctgagaaggggattgcattaggaaataggataggggataaaagtacaaatgacatttagtattagtgtgttattttttctgaaaaaaattaatttgtcatatatatcgagttttgccaaacattcagtcaatccaaaagcatgtcttcccttccataattagttttttttataagagataccttgaatctaaacacctttcaattaaggggcaattacaaatttaccaatgttttgaatcgttattgcaagactgccactaaaaaattgcaaaaatgccactaaaatagttattcgagtagcatccttacaaaattgaaaaaaccgatggcaaatttgcaaatgccccttcaattaaagaatttcatgtactcccttgatttttaatagttgtcattctaacttctttgatcattaatttttaatttttatagatctgtagtttaataacatgtgaattatgttatgaaagtatttctcacgataaatcccaatacataaatgctagtatgatattaaaacattatgaatttttaaaaaactgatggttaaagatacattagcacaaagctaaaatgaaagtaatttgaaaggggctgtaaattgtacattaactttgcggcagccgtgcttgctagtacaaattataagtaacaaacttttgtgacgtatagtagcctattctctagaaataaaaaagaaagaaagaatagacgggagaggaaaaaactatggatggtttttggacttctccgctactctagaccgcaagggacgcgacttgttcaatggccattcttctctgaaacactagactagagaaccccgcatcccacttcttccaggctccagctcttcttcaccctaacccagatccgcggggacccagccgattcgcccagccacgccaccgagcgctcgtctcgtctcgtctctcgacccaatcccgtcccccggcgcgacgccccgccgcgcgatggccgacggcgcca

SEQ ID NO: 32927 - DNA, 190 bp, Oryza sativa
ttttaaaatagagaccactaaaattgaagtggtaccaagtaacaccaccaaaatttttcatctctattctataccaccaagtgggaacaaatctaccgaaaataccaccaccatcagttcatggggtagcagttttaagaaggaccagaatgtgtgccgtcgccgatgattctacatcacttccgctagt

SEQ ID NO: 32928 - DNA, 336 bp, Oryza sativa
ttcctgcagccctattctgactctactctttcttaagcaaactaatggattatatttgaggaattatgacaaccgtggatcatgaaggaagaaagaatggatgagtagcttccctattctcatgctagttgttgagcttgaatttcataagaagtcgtctactcttcttagtaaaatctgaaatctatatctatgattaacataagaagttcaaaccttttcttgcatgaccccttatcaacttcttaaatatctccagtttgtaggaattttgacttagcaagcatatctttcctgccaaataattgcactctatttattaatgttgcttccagg

SEQ ID NO: 32929 - DNA, 313 bp, Oryza sativa
ccaggcaattatgcgcagtacatcatgggtattgttgggttactaacttactgtcactgtgttgagaaaacaaaattcaagattccctaactactccaagagccaaaacatatgtactagctaatagcacagaggcagtagtttactccaatttcacactagttagcaacaaatccggaggtagaactatagccaagcaaagcagcgcagcgctagcgctccagtgcgtcttacttctaagaaaaaactcagtgaccgcgtcagttacagtgaaggaaaagccaaaaccactgtagtgaggatgaactcgaga

SEQ ID NO: 32930 - DNA, 1501 bp, Oryza sativa
ctgaaattgaaacactgaatttatatggtgagtctcatcaagtctccttgaactacagcgttgcccaattcatgagtagaacaattaattccactgagggcttgctgcaaaatctgattgttggatagtgtatttggtatgagatatgtctctctggtgcctttaggaaggcctatcaacacacacatcattcaacctatggttgggcatatggggatcatgaattgttcttgctgctcatgctgatttcccatccatcacccgatgcatggtgtgattgtttgttcagtggagctaatgttgatggtaattgcacttgcaagtcacatgagagacgtacccatcgccatgctcagtgctacactattccaatttcatttcaggttcagagtaacaacaatgatgtactagatgatacttcttggactcaattcggatcaaacaatggtgaggcatttagggtttcaacaagaaagttggtcaacttgtaaccttggcctcctccttcgcaatggaggagtgaggtattcagtttgtgtgcagcaggagggcaagggctcaatttttcttggaagtgtatatctgaagggaaactaatgttatggacaaatgtgaaagttattagaagagaatatacaaacaaggtgttatggctgtcagttgccaattcttgggatttaatatgggcagtgctacaacagttgctatgtacatctgagcttattcttcaatggaatcaacatgggcagacacatgagctattgttacaaagggagcagctaaaacttggtgcagtccatctcagtttggaagctagcactttcagtaagaattctcgtggaatagaactggttaaatgttcagagagatgcctcatttgtttagtttgtgaggacaacatagtcttgcacacatgggcctatcgagtggttaaattagttgctgcaagattggttggtgatcaaggtaaaaccatacaatttttagcaatctgggagtttgcaaacaaagaagtagctctcattcagacaaagaagcatatgcatgtttctcagtccactgatctcaatatttgcatgttacatctaggctctcatggagtatatgctgatagtagtggtgaagaaggcgtgaaggcttggtggttgaggcagcaaaagcatggtagagagtgtggttgtaatgctcaggttttatgtatgctggataagtggattcaacagtgggcagggtctacatcagatggttcgaaggtcatcaaacaattgttctgggattctgcccaacaagacatttccctgcaggtaccctaggatcttgggggcattaatctggcgagtcagttgcatcggcttggggacaagccgattcttaacgggggaagaatgtcatgtacatgggctgttgtgatgtccttccaggaggctagacaagtgggctggctttgggcccattcagctagggagaaggagactagaaaagaggcaaagcagccagcagc

SEQ ID NO: 32931 - DNA, 1501 bp, Oryza sativa
ccggggagctaagcccaagcgctacgggtgataagaggggtggaccgaatgggaggcgtgcccaatgcaggcacacccggatacacacgagacgactactcgtgctgtggtgggaccacgtgtggaatgcacgtgtagccgaaatcattcaggaattcaaaaatccaccggcgagtgacggtgcgagcgcatgacacatgcgcttaagcgatctccatactttttttaaatttttttttgggtccatcaatagatggtttccatgcttgtttcatcaatgtcgtttcaaggccatgcttgtttcatttcatcaatgtcgtgcacagttatcttggccatttctgttcgttcaattaattggattcggtttatttaaggacatgtccagcgcagcgaaatcgatctgattttgccacggctccagatccaggctagtggcccaaccgttgtggcctggtgggctcgtcgcacacacgggtgcagatggaccgacctgatatgatcgggcccaaagaagagaacacatgtgatatataaaaggaaaatgaacaggacgaaatggcaacatctgagtgaatcaaatcaaatcaaatccactgtataagcagaagagttgttcatgtttggctctttgccatggatgaccaaccatgatttattgcaccttttccccttcgtacaaaacgcgacaaccatacggcggctgcacgcgctccgggatgaccaaattatctgagaaaaaggggctctcctgatcgacttcttctacctatacttggctggtgtacagagcgcaatgcataccagccagtgagacagatcgcatcacaagattaggacaacagtaagaagcttgatgccttgattagcttccattttcaaacctacaaaaatgcccagatcaaacaatctgcaagtatacgaacctctcgggagagaaatgccagaccactctattcgtaatgccacgggacacgcacagtactccaccctgcagcaaagcaaagccagcaacgacggggaggagaatgtttagtcccgtaccggggagcttggcgcgtgcgctccgggtgataagagggcctgaccgagtgggaggagtgccaggatgaaggcggcacacccggatacacacgaggtgagtcctcgtgctgtggtgggatcacgtgcggtatgcacgtgtagcaacaaaaaaatcttggtcatgacgaatcaatccacccagaggtgcgattgactgcgcgggcgcatgacacatgcgctttggcaatctccccccaaccctttttatttttcccctttttgggtatacattcccggttcgaacaaaggtactggaggaaatggcaacacgtatcagtgaatcaaatcttttttttttcagcttctcagttcgaacaaaaagatggaatcaaaccatatactgatatgctaaacccataacgttggacgtcaaacaaaaatgaaaaagaaatggagggagtatttttgactctttttc

SEQ ID NO: 32932 - DNA, 1501 bp, Oryza sativa
tccaaaagaagcgttgatctcaaaatgcaagtactgcacgatgtctacaagcttctcaacaatctataaaaagaaatgaatcttatatgttataaacaaaaggaaaggtcaacagagaatataaagggaattccacagtaaattgttctcacatcttccaatgtcttggaccacaaagatcttttcttcaagcttttcacatagttcctttgactcttcaattctattctcacgacctcaatattttctcctggaagattatctggacacagtgccgaaattccaaaagattaaaagtggcattgctctgacaacttaactgaaatagatatggatattgaaaatacaaagaaataacatttttcccttagcttgagcaatccacataagtcatttgtttgggtcatgaatatcatttggttaggtaatgggcacagaactattgacacaaatatttgtcactctgtccaagaaatagctagaggattttgtaaaataggtatcatacctttctgatatgaatttccctttaccgtcagcttgcagcgataatcttgctcaaatctatccaacgcatgcagctcgtgatacaaatcctggaaaaaaacagccaaaatgagcaaaacctagattaatcaaatgatatattgaactacagcacaatgcttacagttgtacgatgaacaagatccatcaacttttgcatctctgcaactgctgtttcttttagctgcttctgtggtggattttccgattctagcctagattccgaagtaacaagtatgattaaggtctaatctttataacgattgccacatgcaaaaacatgaaaactcttacttgacaaaatagcggtccaggttatgccattggggatctttacaacggttgccaaatctgacaatctcttgtgaaaatattttcagctcttccctgcaaatattagccagagtgcacaaaacagttattgggttgtcagatggtaacaatgaaacattgagaacaaccatcaatcatctcttcaaccttttgtcattggctacaatccgcatcaacacactcatgtcactggaaattaaattctgcacgccttcagaaggaagcaccacttgtttgaagtatgtaacagtgtcttccgaaagagattgcataatagtagcacctttcaatatcgtgtttgcaacctcaaaagcaagaattgatatcggacatcctttggttttagccctggaaataaagccgccatctgtgctaaggcttgttgttaccaagcagcctatagtgtctaaaatatcaactgccttcccaaatccagccatgccggctgttccaagcactcttagtctgggaacctgcaaggaaatgtcggggatttaaggatatcgtaatttctactaagaaagttaaacatttcaggaattgtacatttcattttgtaatgctcttaaggtaaaacaagcaagatataaaagttagcatagtatttatgaacagagacaaa

SEQ ID NO: 32933 - DNA, 1501 bp, Oryza sativa
tatgggggttacccatttttacaaaggaaacacaatatgacaccaataggtgaaaacaactagatgaaagcagcaaacctctcaatctcatacaaaagggcgaaataggattaggcataagataaaacaggcaccaacacaaaaggacatttgaaatcacattgtgcgaacatagctctcatcaaagtaacctagtgtgcggagctaatgcacaaggaatcacaatgtgtgaacagtttcgtcattatggttgttttgacccattgaaaccgttatgtagtaaggggattcacatcctctactataatggcactaccattatagacactgacgtgtggacaataggagggtgggacccatataccagttgtgatattatggtacaggaccctcacccgtattaaagagatatgtcctcgacaatggttttagtcatgtggaccctcatatttaagaatatttgtattgtaattgcatttagtttttgtgtttcaaaaatgcaatatagctatgaaatatttgtggtggttatgttttatccatgttttcaactttagcagagattttactcctatttttctaactttatgatattgcccttatttttttcaaattaaacatattaattgttatataagggattcgatattaattgttaactgcggaactcctggtgcgcctgcacgaaggcgatggaagaagctttagatgaagccctccgggaggttctttgctttgcttgtggtgttgtatgggcaaatgttgtgccgcatcgaacttttttcttctgctcacatggaaagaacttgtgccttttgatggcgtttagcctcgctattcgctaggacacgaaaaggataatcagatgcggtgatgctcccttttcaggcctaccgggttgcgaaccataatggcaatagcttaatactccctcctcccctaaatgtttgacactgttgacttttttaaacatgcttgattgttcgtcttattcaaaaacttttgtgaaatgtaaatttgtgtgaaatgtgtaaaaatatatatatacataaaagtatatttaacaataaatcaaatgatagaaaaagaattaataattacttatttttttttttgaataagacgaacggtcaaacatttttagtaaagtcaacagcgtcaaacattttcggaaggagggagtatgtgcttcaattcctcactgaaaaattataattgaacatgactctccatatttgtgatgtcacatgggatttgcaatgtctgaagatttttatttttattttttaaaaagaaggtgcataaacaatctagccagtagacttgccatacttttacgctcatatttattccaatcagggcacggcagtacaaattcttgcttcgaacaatcaccttgagaagaaacccaagtcgaccaacacaaaaatgctggacaaaacgccactggtcaaaacagaagagtgtattattgagacataatcgaccctagaggatgcac

SEQ ID NO: 32934 - DNA, 1501 bp, Oryza sativa
gatgatttaattgctgcttggcttaccttgctaccgtggtcacacattatagagagttcttgtggtaaattattctcatcaaatccattgaagttgcacttctctaatggagatttggatgaccctctgggtgtatttgttgcttgataatgttccatgactattcggtccacatcaatactctgaaacgtaaaccaagagttaaaaattcaaagaagagaagtggatccattacaattatgacatagtagttataataattgcagacctgcagttgataagataaaaaatcatgaggcgaaagcacataccgctagaagctcatcctcatccatggcatctaatttagcatcatcacacatgttgtcaataaaaggagcagtcttgaataattcaggaccagttcttgcaagactttgatttgttgttgtaatggtatctgcctgcaccacatgattgttcaggtaagtccttgtacaggacttggtgcctgcaggcagatggctactgttcttctccatagtaccactttcagtcgtctgatgcatactttcctgggtgggattcctatttctggacacactgtccattttgttaacattatatgaagaacttgtcccataagtatgagcatggtcgctatcacaatctttcacttttccagataaaccaggtcttaaataattcttccgtgcaacctgagtgttgcgtagagaacgccaggcctgccataagaatgttcttagaataccaaaaagctcacagaagtaaacaagaatgtattaaaaacagtgagttttaggttaatgctttcttaacaaaggggtaaagataaaagaatgagaccaactaggatttgagttttctgataacgcgtcaagggttaactggacctattatatggaatgttagatgatacacctttggtggacagtttacaaggttataatgcaattatcctacctgatagctccagattggagttaggggaacccatcttttcaacaggatttattatgatggagcacatatatggttgcaaaggaaactgaataattagctaaacttacaagttcaaatgataagtgactatgcaactatctcatttttatgcaagtgatgacaaataccatgtacagtattactgtcgtaactcataccttctcaatggatggagcttgaagacgctctaggccttgaattctgcaagcagcagacctgaaatatataggtaatgatttgccattattctggtaaacaagtatcttttgctagaagaataccaaaggttacgaacaacaaagggtgaatagctaatttagtccttcaagtttcaccaaaggctcaatttggtccttcacgtttcattttgtccacatagctcctctaaatatttgttttggcttgacatcatccttgggcccacttaatatgccatatggctatttttagtcaatatttctattagaaaatgtcccttttacccttaatttatatacaa

SEQ ID NO: 32935 - DNA, 1501 bp, Oryza sativa
cacaaatgtacatgtcacaatattaacttcagagtcgagaagggacaatgaataaaaaacacacggcattaagtctgtaacacagacgctgacggagccattttctctgctggcctgcatgcatgctcaccctgcacctgcagcgtccacttggtctgtatattttcagaggactttgaatctccagacggaagtgtatttacaacttcgcgcacacttaacaaatcacaaatgtacatatcacgatattaccaatatcatatatgacatgtatgattaaacatatcacttcacagacataatacatagaatgtaaagttcaatctacacaatactccaaaatacacaaatttggctatgaacaataatgttgattgaatctatttatgttcttttttggctgtgtggattgaatctgtatgtttacggtgttcacattctaaaaaaaagagtaaaaaatcaattgtagtgaatgacatgtatagaattaaagcattggtacaggtaccaaggataaaaatatgattttgctagtagagaaaaaaaagaacataacggtccctaaatttaaatcggtataccgcgtaggtactagttaagtcgtttgtctggtattggcgtacatgttcttatttgcgtcatttcccctagatatacgtcacgttctctaagattctcattcacatggtttcctatatatttttgttttattccaaataacacgttactagtgtaaaagttctcgtttgtatggttttctttatatttgtgttttgttcccaagaacgcgtcaaaactcctctttttaattattcgtgtcacttagatcttgccatagcttctaccatgtctccttgcgggtgcacctgtccaaaatgtagaagaaaaacatagaaggatatctcattccagtcccttatacaacaaaatttatgaactatatgtaaataactaatcaactacataaaataaatcttatttgataagattcgcttagccattaaccgttcgatctcgtcccatgttgaatcctcaaccatgtagtgcttttccctttgtttcattccagtgaaccactttcaaccctataacaagaacaaaccgaaaagatagaagaaataagacaacctatttttccccataagatctattcaatgcccaaattaaacgcatgatttacattttttccaccaaatgctaccgagcaatgcaaccaggtattcgattcactcaaaatgcccatattttatatagttaattactcaactaccatgatttttattctatatcttaccacttttttgatccatggtccatactgttttacctctcaatacctctaagtagctcgcaggtatcataaaagctcttgttgtataaattttttattttgtataaccttttgataaaagctctcgttgtatcaatggtatcacggtttttattttgtacaaaccttttgattgatactcctccgagaagcaaacgagtacgcatgcac

SEQ ID NO: 32936 - DNA, 1501 bp, Oryza sativa
attttgggacggagggagtagaaaatagcaattgaatgatacaccatggtaacttgtcttttcagtagtgcacttaaactttaatattataacttcagtaggtggttgcagaactcatgacttctgttacaatgatggttaaaaaggccggaagcctcaattatatttcccaatgacatcttgatgctttatatgaaaactcctagatgcaaaataagagtagtttttttcccctgattccctggaaataacttgtgttttctgtcaatttacctccccaccatgaccttcagtactttatatagtttagtaccttaatttatatattttcattattacatacttgacaaataaaaaggagaaaatcaaagtgttgtatatttctgttaaatgtgggtttcttataacagaatatccttttcaggtattatggttttatccactttacatcttcagcttcgtgttgagtacactttggtacgtttagtctctgtccacactggatatcttacttcccttgttgaccatactagtggtttacttttcctttaaagagcaaacacatggtttgagttgataacagaattacctagcagcacttgatatagtatatatttttatagtaagtaaatagagaaagacagaatgatcataacaatggtactatgcatgtatgagcctatcataccacaattaaatcagtgaatttctgttgaactttagtgcttctaaatgtcagtattacaatatttggttcagaagttacccattttcaatttgtggtatgctctgggattatgagctcaaacataaaatatttcagtaagccttctcagggcattatcataaattgcaaaactttctgttggatatacgacgacacccactttctgtttcttttatcacctcattgatggtgttttgcatagtttcatttggtaaaacccacctgtcttgtaagatgttactgcagaattaagaatcactgagtaatcaaatcaaaagtgttactgtaatcttgtatagacatttgtattagcaacatagcttgaaaatatttagatgggtttgtaactcctatatttttgcaacatgcagatgtaattactctctttatgctttcatttctctaaatcttaagtgagttctctgtgttgcagtccttgggtttcaacactaaattgtgatgaataaaatctaaacttcgatttactcataggcacatatttacaatttctctatggaaagctcaattcttgattttttttttctgcattgttacattattacaggtatggactattgttttaccatcctcaagattcccgtatttcatatactaaacagtggtgggcccaattgtaccttttgtaacattggccatctcacgtcaggtataatgacattgctaagcatgctttggatgttgtgaaaagaaagagcctagatgcaactaaagcattggatgctcacaccatatctgaatcaacagagaaacctg

SEQ ID NO: 32937 - DNA, 1501 bp, Oryza sativa
aggtatgtgctctggaaacatatcataaataaatttttgtttagtaatttggcatctgctaactttgtgcttctgttgaacatttcattactgaaggaagtgaaaaatctgctactacaagagagggacaggctgtacgatcttctcaaagaaataccattcctaaagccatttcccagccactctaactttattctctgcgaggtcacatcaggcaaagatgcaaagaaaataaaggtttgcactgcttgttagtactccctccatttctttttgtttgaagttggttagtttgaaattgaactaaccaacatcatacgtttacagaggtagtatatgttactcccttcgtcccagaatagaaacatttttagcatagtgtcaagtcaaccattcttaattttgactattaatagcaaaaaaataaaaaaaagatcaataatgtaaaattgatgttgctagatttatcattgatcaaactatcataatatgtaactctttttatatttaaaacattttattttgatagatattattggttaaagtagcatctcgaagactgtgtcgagatccaaaaatgcttatattttgggatggagtacaagtttctgctgtattttgttgtggtacaatgtaataactgcttctgttgttatattcttaggtggtaaaatgtcaacctggaagtcaaaatatagttattgtgtctaagaccattactattcatactttgaaaggaaatgctgatgatttagtttcaacaatataatgcctgcagcatcattcacataattttgttcaaaaacaattttcaggaagaccttgcgaagatgggagtaatgatccgccactatgacaagaaggaactaaagggatatattcgtatttcagtgggcaagccagagcataccgatgcactaatgaaaggcctgaaagcacttcaactgtgatcatcccatctgtttgacggaagcactgaagcacttgcccgtggtagtgcactagatgcagtctctcaatggaggttgcatcaatctaacacaaataaggtgcatcctctagggtcgattatgtctcaataatacactcttctgttttgaccagtggcgttttgtccagcatttttgtgttggtcgacttgggtttcttctcaaggtgattgttcgaagcaagaatttgtactgccgtgccctgattggaataaatatgagcgtaaaagtatggcaagtctactggctagattgtttatgcaccttctttttaaaaaataaaaataaaaatcttcagacattgcaaatcccatgtgacatcacaaatatggagagtcatgttcaattataatttttcagtgaggaattgaagcacatactccctccttccgaaaatgtttgacgctgttgactttactaaaaatgtttgaccgttcgtcttattcaaaaaaaaaaataagtaattattaattctttttctatcatttgatttattgttaaatatactttta

SEQ ID NO: 32938 - DNA, 404 bp, Oryza sativa
cattaacatctatataaatgtgtgtctagattcattaacatctatatgaatgtgggcaatgctagaaagtcttacattatgaaacggaggaagtaactatgtttggaagtctgggtacaatccacaattgagcagacaagcactaggcctggcgcccctcttgtccctttgtcagtttcatatatattggtccttccctctgacaacccctttgcccaatcccagcacttcatttgagtctgcttgctctcttgccttttttcttggcctctacgatactatgagagagcaggactgtggagcacacaacacatggtgggtggtggggaagctgtgattgactgccagccttttgaggggcagctctacagtacatagcactctctggctccctctctggcagg

SEQ ID NO: 32939 - DNA, 1501 bp, Oryza sativa
atttaccatgcaggacctagagttattcaccaaggatatataaaaaaatgtaaatatttttttaattatctaaccaaactatatatatgaccaacagttcagctgagatctctagcgaatggaatagaaatgttccatgcatttttttttttcttctacatttggtcactggctcactgctaattatgcaagcattagtttaggttggctgatcagcacatgcagtcggcggtttgaaacaggctgcagctctgcataaaaggataattaatttgtgcaaaaaaattcctcccacgtgcaaatatgtatactacttatttcgttcgtattataaattgctttgacttttataaagttaaattcttttgattaagtttatataaaaatatactataaacatttatagcactaaattagttttattaaatctaatatttaatatattttgatagtctctttttctatattgaaaatattgtttttttatgaacttgtcaaagtttaagaattttgaaaaaaaaagatcaaaacaacttattgtatggattatataaaacgtggtactagtaccgcagtatgggatgttccaatgttttatagtttccccttaacgtgacaatgcacgaataagcttgttgacttgacagcatattaatcaaatggatgtccaaatctagtcaccaaacattcaaaataattacaaataagcagtatcatggcccgggttataagcacaatttacatacaccctaaattgcaaatcctaaaaatactagctctgtgcctagctatgtaaactggtacggttcaaaattaatttacggcaaattatttttaaagaaaaacaatcgtcaccagttaagttattttgaatacatgcgtgcgcacaaagaatggaaggcaagtagtagagatattttgatgaaattatattttgtatagtttgaccatgagaatgtgctgtacttcacgctcgtctatcggactatcggaggctcggagcgaccattttcaaggttcaaatcaaaatctccaacaactcacatgtttacaatgaaccttcgactgtgaccaaaactgtaatttaaaccaaaaatatgataaaccgcaagacaaagataactagataagcataaaaatgttttttttttgacaaactcatacaaacaaaaaaaaactaaccaaataaacagttgtaataaaacaatactaaacttcacaacaatcttgaataaccgacaagtagaaaagaaaagtagtagcaaaaaaacaaaaccagtgttttctactgtgtcactaattttgttttaaccggacgattacatacaaaccaaacctcgtttttgtcaagtactcatcgcaatcaattagtgagtgcgaggtttaagaaaaaaaaaggattagccagtacgatattaatgtctcgatcagacgatcagctcactaatcactcagccttatgtcacagagtataaaaatgcaaattataataagctgcttc

SEQ ID NO: 32940 - DNA, 180 bp, Oryza sativa
ccaccccaccccaccctcccccttcttccttattccccagcccgacccgatctccaaacccctaccaccattccccgcagcgcggagccgccgccactcccccccaccctcaccccgcagaccattcggaaaacctagatccgagccttcccccttcccctcccccggcggcggcggcca

SEQ ID NO: 32941 - DNA, 903 bp, Oryza sativa
taaagtcttatattgtgaaacggaggaagtattctactatatccgtttcacaatataagtcattctagcatttcccacattcatattgatgttaatgaatctagatattatctatctagattcattaacatcaatatgtatataggaaatgatagaataacttatattgtgaaacggaggaagtacatttctacggcctctgtatgtatgtgtgtgcgcgtgttagtacgtgtgtaacagttagtcatagaatatttctaagccacaccccgaaatctttacaaagtcactggatatttgtgtaaccagtaaacagcagctttcgcagcaaattaacctaccagattggttgatggacaagccagtacatccaccgcaaactggtaaaactggaagaaaaaatttccttcgtcactgctagccagggtttgaaaaccattttccgcccaacaaattttgtgtgtgtgaatttgtttaaagtcactcaaaatttatttacgtttttcgtcccgaaattttggtctcgcctatagaaatgtgcaaaacgaaattgtaaacactgcgctgctagctagagcctgtagttgatatgcatgagatctccgctaactaatcagcagatggctctgacctgagaaataaaatccctcaccatcctccattgcaacttgttctgcatgcaagtgaactccaagcaattatgtggtgtttggttggagggactaaagtggagctaaactttagtccctctcacaaaaacattagtccctaccatagggacttataattttgtgagagggactaaatttagtccctaagttcctaaacacccccttaatcattcgcaggccatgatttgatatcccggtttctctctcttcctctctgtctctctcttgcagt

SEQ ID NO: 32942 - DNA, 641 bp, Oryza sativa
ttttgactgttgttatttattcccctttggaacaacatttccacagtagagtttttggctgcaagttacaatgtttaggctatcgtgattatttagatacaagaagagagcagggttttagtatttaagttggaacttggagatcatgtgacaagaactgtggttcatgagatgaactcatctgttatggtcatagaacataaattaaaacctgatgtggcataaaaatcaatttacctgctatttagctatgctaacttgacaatatttgtcaagccctgtatcatcttccttttcctaagtcaatggttacgtggctacaatatagtactccgcaaggcagcagcatattgttgcagtgtaacaagtaatagaaagtagaagtgctaacattactcttgtgaactcgtgtcaaacattaccagtacatctggccattttcttattagtgaagagatatagtttttatgacagccaaaaatgcgtctaaaaagcaatatgttttgttatccttgtttctcatggtgcattatctttgtcctcgggggtcttacaaaatcatcactccaatgtctactctttttttccaccagtcatatgatcatgactcttatcttgtgctgtctgcatttctaccgagt

SEQ ID NO: 32943 - DNA, 293 bp, Oryza sativa
acggatcgaggaagatagaggagagtggatctggcgttggcaacctcccttcctaatgaatgccaaatccgaagaggtggcatgctccacacgatgttatcctagcggtgagctcggggacgggactgacaagagggtggcgacgagcactgcgttaagatgccatgatgctcggggcagcaacatgcctcctcccgcactgatctagggatctagggctgagcccgttgaagaggactgcctagcctccactgagctccccttgccatcttcctctcttcattgcccaaagc

SEQ ID NO: 32944 - DNA, 304 bp, Oryza sativa
gtcaggatcatttacagaacctaaggcttgggaccttggtgtccttcagagccgtcaagagcggactgcagagaggtgagggcaagacaaatctgtaaacctaggatgagaagagaatgtacatgtttggatgtgacaaccgaaaaattgatgaggttggggagaggcaccaattgaaatgtaaaagtaacatcagttctaaatgacagaatatattttggcactttaattagaaaatacttgttgggacaaattgagcaaccatattagctatcaacaaaaaagattttgcctcaacctgcaa

SEQ ID NO: 32945 - DNA, 536 bp, Oryza sativa
gtcttcttctccctaattaaagttttgtttattctgtatcaggcttgtgtagaggagaaagggaagctagcaaaatttgtgggtgaagaaactaacagattgaagtccagtcccttgttagtgtgattttttttttctttttttgcgattgcattcattagttccatcactgacaatctgcctgccatactacccaactgtagtaaaagatattgatagatgacatgatgtttcaaatagtggttagcaagtaaatcaatgttatattaaaaaaatatttaccttgctacccaactaagggcctgtttagatcccctggcaagttttttcatcctgtcacatcgaatgtttggacacatgcataaaatattaaatatagacaaaaaactaattacacagattatgtctaaattgcgagatgaatcttttaagcctaattgctccatgatttgacaatgtggtgctacagtaaacatttgctaatgatggattaattaggcttaataaatttgtctcgcagtttacagcggaatcta

SEQ ID NO: 32946 - DNA, 1501 bp, Oryza sativa
tgctatgttttgatccgtgatgagacctatcacaaatgatttatcatggatggcttcgcttaagcgtgtcttaaattaaatgtgtagatcggctaaaaaagtaattgtttatttatgtcaccaagatcattcatatataaattaaagttccacttaaaaatagatctaataatttttatcgtaacaaattatggtcggtggatttaatctaatggttagtattatcgggtccaccgttttaaataaaaataaacggttagatatttttcttttttctcaaaatttattagagcgccatgtggcggtttaggagcgtttgtaggaatcctacatagcggcttgtcggtgatatgggaccgggagtatcatgaccagaggcttgaggcagacacaatcgcccacgtggcctggcaccttcggggacgtcgggcccgagggtgaggtgtccgccctcctcctgatttcccccgaggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttattcggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagaggggggacttttccctgggagaaggctgaggggaaaggaagttaatcctttgtaacttgtccatacacaaatccacaaaaacacaggagtagggtattacgcttcgcagcggcccgaacctgtatacatcgtccgtgtctcgtgtgtcttgcgggcgggtgatctttccacatacagagagatacagagagagcttgagatctcaccctaagcccccggccgaactggcaaaggggggcctgcgcggtctcccggtgaggggccacgagctccgtcatctggcgcgccaggtagggggctcagtgtgtgctttctgagctctcagactcttccgtgtgcgccaagtttttcttgttcagcctaa

SEQ ID NO: 32947 - DNA, 1501 bp, Oryza sativa
gctagctccttgaatagaagaacaaagtacactgagccatttgatgccaatggtgcatctactgcctgtattaaagcaacataatgtcatgacaaaaaggtgagcaatataccataggaacccagagagcagaagcgagggaaggaggtagagatatattgtcgtctggaaatattgaatgcaaaatgaaaatatgctcaattatgaatggacattccagtgccctggcattgtgcaagtttggactggatgcaacaaataaacaatggaacatcagttcatatttaaaaaactataaaacttatccagatctatttgaaagggtaaagaatagtgtcacatttcaaagttccgagttgaatttcagattttgatgatagttcagtcttgtaaatggactttttccttcatccctcaataaaataaaaaccagaactctttccaatcacaggatctttcagagttaaaggagacacaggttacctctgtatgggtctatattctgaatttcatcaacattgcaagacgcaactgtaaagccaaatgccaggatttatcaagaataaacgcacgcgtgactgacctcacataggatggagagcatgtccctcgggttgcagtttgacacgaagaattcaatgatagcgttggcaatgtcccagcaattcctcatcagtgcccccagcttcgccacaggttttaccagctctagtgagagagcatctatggccaactattacgagacggcaacaatgtcaggagatcaccaaaattactcccgtcccaccccgcgaatcgcaacatgaaacaccacgcggagagaccaatcacacgcaagcacaggatatcgaacctgattcgaggacggggacgagaggaacgcgtgcacctcccggagcatctcctcgacgaccccggccgccgcctcgtcttcggcgtcggcctccgcatcagctgcatcggcggcggcgttgaggaggtcggagacggccgccgcggcggatccatcggagcaatccccggactcgaacgcctggagcagaaggagatcctagggtttagctagggtacacggcagaaggagatcctagggctcagcttgcgcgattaccttggagagggcggcgagcgcttcccgcagccgcgccggggtaggggctacagcggcggcggcggatgtgtcgccggcgtccatggagcggcggcggaggcgtgcgtggtggtgtggtgttgcttctgtggacacgaggcccatactaaagtggacgcgtacttttgggccggtagcccattagacaatttggagtccgactcggactcgatgagcaataccagcgagtgggcctaagcccaaatcacccatgcgatctagtgggccatcggtttccaagtcggtttacacgaactgcatttcccattccgtgacgaacacgacgaatgcatcagatcagataggcgtaggggaaggagtccgagtaggagtcgacgagcattccccgcc

SEQ ID NO: 32948 - DNA, 1501 bp, Oryza sativa
tcgctctcgccgctttgccgggccggccgcaatacgaccggcatattgtgcaagcccgcacgcacgcacgcacgctggggttgcggggtgagatgagaggtactagaccggtggggagatgagatgggatcggtgactgttttttttttctcttttgctgtgcctccgctcaacttactgtattctggccgtcaatcaatcatgcatgtcagtgacactaaacagggtgcgaggtgatcgatcgcgtaatttattgggtcaggttagcctggctggaattttctacataccctaagctattagatgtgtgcatgcttagctacacctgatttattgcaccgtgccaacacacgacctaattttctataaaatgctactacgtgtgtgtaactccaagttgatagcggtacatgtttctttagaatgtttatgggtattttagttattaacgttgttcggctgtcatttacagcacctaagccagttttcttgttctaggatataagtagttgcattggttgcgatactgtcaatagcagcggagcagcctcattaagttacctacgctaactaatttaacacaaaagcttaaagtgttgagaaaaggtttagactagagatctttagctctattatcgaaagtcacatgcatcgatcactgtcttcaagcaatttgtttacactccaacactaagtaactaggaaatgttttcttttacccgatttgtatgtttagtgcgaattctcagttctgtcgtgctgaattgatcatctgacttgggatttaaccgagtataatcaaggagccgtgatcgatctgaactccctacagttggcaccttccgatcgtaatctcagccgtcgattcttaatccgacggccatcgaccctcacatccagcgacgttcgtgcaccgtggagtacagatcgagcagggaatgttattggcatatcttaagcaggatcctgatgacgtcccacacacagcaaggaggagggacaagatgcttcggattccgttaatacctgtcattgctgctcgctaatcaagcgccctggagtgtaattatattctctgctgctgttgccctgcctgtacttagctaagcttgtccctgacatgattaagaaactcgctgctgtccccccagcttgccttagtttttcttttattacatgtacacgagtctgtgattaatgcacttgtgttgtgacgactataattaataaacttgatattagcagtagtaatttctctccacacatccatggttgcttggtcattaatgccgttgattagcatgctgcttgcatcgatcctctgccacagtttcagcgaggaaaaagtatagtagcaagttggtgatcaagtagcgagtcaaggatgtctatctcgtttctacgtgcatgcacgtctacgtgtcgatcggttactacagtggacacatcgatcggtttaattttgatcaagctgatcgatatgattcacgcggattaattc

SEQ ID NO: 32949 - DNA, 1501 bp, Oryza sativa
cgactgctgggtttcttccttgatgggaagatgtggtatgcatgttttgaggtttcatactatttgccagctctgaactggctccccctcaaattctggggttacttttagtgactatgagcttgagagttcattttcgtcccgttttcaccaaacgtctccagttactttagagatttaaggagccagagttcttgtcctattttttttcgaggcctctagacaagatgaggtatacctttgcattcttcggtatttcaccctcctccagtgtattatattcgagtaatgcaacttggtcatgctctccgaatcacaaaagtgataggcagttatctaattctcatgtgtgcttttcatactttgcattcgctggtgcttggtaaaatgtgcatcctttgtttgaccatttttcctaacatttactccctccgtcccaatatatagcaaccgaggaccggatttgatagtcctaggatatgtcaaatccggtcctaggttgctatatattgggacggagggagtatcatttaagggttatttctcttcccctgaatgactggaaataatccttcttattgtcaaggaatttaggctacacttgtacctctgctaaaaatttccatttttttcggagggagcccttatggttgtgggatatgcacgtgtgtcgagtcaacactaattaagcattaacttcaaggccaacactcttgctaggcgtctgggagacaaagttcttgcgaagaacctcatcatgagactcgagcacctgtatgatgtcgatcatctcgtcatactccttgtatgacacttgcctgtagttacaagtgctctaagcgacgctagggtggaaggtggagagcatcttttcgatcttttccgcgtccgtgataaccttaccatagagggagaggttggtacagatccggtgcatcgcggaattgtactcggagacacttttgaagtcgacgaacctagtcctgctctgcttggggtaggatggtgtacttcaacttcttgaaccacttcttgagtgcggcccaaagagtgagtgggctcctaaatcccatgtactcattcttgagcgtggtgcagaggtggtgccgcaggaagtgcagcgcctgatcattctcatcaggggtaggcgcacggtcctgcggggtgcccatcccaatcgtctggcggagcttcttggccccaaggacgatctagacattggatgctcaagtcaggtagttctggccatgctgggccagtttggcgaactccttattcgtgattcctaacattctgtggcaaaaagtgacaaaatattcataagttacttctagtaacatagtcgcaaatatgaatgcaaatatttcatggtttttccaatatttttattcataggcaatgcgaataagaaatgtgaaatattcaataaagaaatactagagttcatattaaaaatgcgtacaaatacatacatagaaaaagggtgaaaaagttgcatata

SEQ ID NO: 32950 - DNA, 1501 bp, Oryza sativa
ggttcacaggattttcaaaacgtatgaataggaaaaacgtaggaatactatagaaatatatgtgtaaacctatggattgaaaaactcagaaatttttcctatgttattgagcaaaccaacccaagaaacgcaaatattaggttgaagtggattattttttcctatgcttttccttcaaaaatggaggaatagaaaactttcctatagttttcctatagtgcattcctataaaatgaatgatagtttaaaactcatttctattcctataatatttctttgcaattcatttgaaacgaataagcccttagtttggcactcctatcagcatgtgtagcatactagcatctatcctagcctggtgcatgcactgtagcttcgtatactactactggtactacctccacctccgtcccaattcccaaattagatgttgtttgattttttgattctaacgtttggtctggtcttatttaaaaaactagtgcaaatgtaaaaacagataagttataattaaaatactttttgacgataaagcaagttataaataaaataaataataattttataattttttaattaaataagataagtggttaaatattttagaacgaaaagtattttagaacgggatggagtagtataatacacgcactgaaaacaaaacgaatatccacctaccttaccacgagtcgtaaactattacgccagcagtaacacatgatactctgtgctctctccagaatgattcatggcagcatacgagtagtagtattacctcagctgcaaaggctatacgtaggctgcgagatgctgctctgtctcacataaacaaaacactagccatgaccgtgacacaaggagggcgtatgtgatgccttcagccttcacgcatgagcaaacatcgagtggcaatgtgctatacgccatactagctagagtagcactcgatcagacggttaatttgaacattgaagtggatagcaaatgaactgaaagcaaacacaggattacaacaaagctgctggttttaagctgaattgagtagcgaggtcactttaacccgccttccgcagcttccctgaaacaacactcgaaaatgcacagccccacaaagtttgacaaggtagaaagaaagaagatagctctctctgtaaaacgataaaaatgatccacagatgaaaggagctccctttgcaaaaggctgcggctggttttgctctctggaagaacattatacaagaaccaatctaatcatgcgttctttggctctagaccagcaaagcacaaagctttctctcatcatttcgtccatataggcatatagccgatcactcattcactctccacgctttcacttcactcgcccactcccactctcactctctcaatccatccaaccagaaaaaccaccacgcgcgtgcgcccgccgcgcacgacgcacgcacgcacgcgcgcgcgcgcgagacgcgagacgagagagagacgatgcctccgcttcgcc

SEQ ID NO: 32951 - DNA, 1501 bp, Oryza sativa
taggacatgccttgttaaggtcggtgtagtcgatgcacatccgaagcttgccgttcgccttgggaacgaccaccgggttcgccagccactccggatggatgacttcacggatgaatccggcctccagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcagaggggccaagcctctcgtcaccaccctcgggcttggacgcagcagcgaggcggtcggcgcgctgctccatgcaagcgagcgcgactttaagatcgccatggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgataatcggctgggacggtcggagcaccatccccggggccttgatggcatcaaaagccgcgggggaaaggatgttgagggccgctcctccatctatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcggagcgccctcgacggcgaggacatgaccctcgtcgccggaacggtccgacctcttcttcctcctcctgtcacgccgccctgtctgagc

SEQ ID NO: 32952 - DNA, 1501 bp, Oryza sativa
atggtcaaacgttggacacgaaaccagtgtttgtcttttttttattggaacggagggagtagtcacgaggtgcccgggcccgacgatttgtaagcaggagaaggaaaccggaaacccggttgccgcgcaaggttggagttggacgacgacgagtcgacgatacgacggcacgacgtatgactgctcgattcgacaggagggccaagcgaagaaaactcgcctggatattgtggttttgtggcatgttgggtacatggttcgtcgaagtcgtagcctgcaaagtcggaatccgatggtactcgtagttcagtagcgatgggcgatggcctttctcgtgggagaagttcggcccaagtagaatgaagtgggccgagagaggctatggtctggccctaaacatggcccatcgctgcgttgtcgctcaccggtcaccaccaccaccacggccctctttctcctcgtgagtggcgagccgggtacgagttaggccgacggtgaggcaggtgtgcagcactgcggtcggaagttggtggtggcgacggcggtggcgaccggttagtgacaacgcggcaatggcgaacaactcggggcgcactgagggttgaatgcaggatatatttttttgtagtggtgccgctacaggcgatgaggagctcgacggcgaagcgggagctctataaggctcgaggagatggaggagaaaggaggaagggagattgacgttgtccttgctgcccccccaccctttgctgctggattgattccatgggaatttcgaaggttcatcgtcgtcacctctgcgcaccaactctggaggcccgagctcggtgagggaggcagatccagcagcatcgtggccctccaccaccgggcacacctgccgcgccgtcaacatcacagctaatgagaagttgctgcacttgtgcgggggcaccactatgcccgactctgactccgcctcaccgccgtcattgtgatcgaccacccctttgtctttcttgaccatgttcgttggtgggaccatgcgcgatcatatccaaccatgaatagctggggacgaccaccgtagggcggtgagccaactaggagagggcgaagaggacggaaagggcctctcccgctcgtggaagcaataccgcttccacttggtcttcttcttagcaaggatagcgatgttggagacgtcgtcgatgagctaccacgatcacttggctttaaaggatgaagacgattgtcgcacggattaggcttaggggatgccatcgccgccgtgtgcacaccccaattccttcgctgccatcgcctgctaccacccagcagccaccctgtttgtgctgagaagacaatggggagagaggtacgagcagagagggaaggagagagaggggattacatgtggatcccactttagtttttaaattcttttttatgagttggctgccatgtagaaactatgttagcgaaaaccactctcaaaacaaccaagggttttatttttcat

SEQ ID NO: 32953 - DNA, 1501 bp, Oryza sativa
acgttgcccaaagccccaaactcacaaatccatacagtataattctttcagaagacgaaaacgtagagatgtcttgctagctagctaaaatttacaattgatattaacagattatcaaagcgtacatatataaacaattgcaaagaggctattaagcgagccattcatcatgcatgcctagaaacaccaacacgtagacgtagttcatgagatcaacaacttggaggagattgtgcaacgggcggctgcggcggcggcggcgcggcgaggcgggcggtgccggcgatgaggatgtagaggggaccgggcgggtaggtggcgccgaagaggcggaacccctgctgcttgaaggcccagacatggacgacgtccttctccttgatgccgcaccgggcgatgaagtcgaggtagccttcccccttgatgatggcggcgccgctgctgtcccaccgcgtcagcagcagccgcttcatgccgccgcgcaggtgcaccagcgtcaccggcagcccgccgtgcgacctccccttcttcttcttcttcttcctcccgcccggccccgccgtctcctcctcctcctgctgctgctgctgctccgcgacggcgacggcggtgtcgctctccggttgcggcggagttgttactgcagcttcctcctcctcctcctcctgctgctgctccacgacgacggcggtgttgttctcctccggttgcggcggagttaatcctgcagcttgagcttcatcctcctccttgcgcaggaagctggcagcgatggcctcgcggcgggtgagcatggggatgaggctgcggccgacgccgccgcacgcgaggcggaaccgattctggtgcgagtcgaggtcggtgcgggtcaccgttttctcctcgatgaacaccagcggcaggtcgtacgggagccccagccggtagaacactatcttccgtatccacgacggctcgttcggcacttcccccgccgccagcgacgacgacgacgccggcgccacggcggcgagcgggaccgcatcgatgggcgcagacgcgaaagccgccgccacgtacggcaccagagcgccggccgccgcccgcttcttcccccgtagacgatcttcctcccccgccccgccggcgacgagaagccgcttgcggccaacgacgcggtggctgttgccgttgccgttgccccccgccggcgccatcgtaggctgtgcacccccttgctttttgccggagcacatggccgccggtgaggtcgtcgtcgatcggagatggatcgatcgacttgagctgtgtcgcgaattcgaccgagatctctctagcaatggagacgcggggttgtggatggctctcatcccgcaatgcgcagcgctggatttatagcggcggggaatgctcgtcgactcctactcggactccttcccctacgcctatctgatctgatgcattcgtcgtgttcgtcacggaatgggaaatgcagttcgtgtaaaccgacttggaaaccgat

SEQ ID NO: 32954 - DNA, 1501 bp, Oryza sativa
gtggaagcggtattgcttccacgagcgggagaggccctttccgtcctcttcgccctctcctagttggctcaccgccctacggtggtcgtccccagctattcatggttggatatgatcgcgcatggtcccaccaacgaacatggtcaagaaagacaaaggggtggtcgatcacaatgacggcggtgaggcggagtcagagtcgggcatagtggtgcccccgcacaagtgcagcaacttctcattagctgtgatgttgacggcgcggcaggtgtgcccggtggtggagggccacgatgctgctggatctgcctccctcaccgagctcgggcctccagagttggtgcgcagaggtgacgacgatgaaccttcgaaattcccatggaatcaatccagcagcaaagggtgggggggcagcaaggacaacgtcaatctcccttcctcctttctcctccatctcctcgagccttatagagctcccgcttcgccgtcgagctcctcatcgcctgtagcggcaccactacaaaaaaatatatcctgcattcaaccctcagtgcgccccgagttgttcgccattgccgcgttgtcactaaccggtcgccaccgccgtcgccaccaccaacttccgaccgcagtgctgcacacctgcctcaccgtcggcctaactcgtacccggctcgccactcacgaggagaaagagggccgtggtggtggtggtgaccggtgagcgacaacgcagcgatgggccatgtttagggccagaccatagcctctctcggcccacttcattctacttgggccgaacttctcccacgagaaaggccatcgcccatcgctactgaactacgagtaccatcggattccgactttgcaggctacgacttcgacgaaccatgtacccaacatgccacaaaaccacaatatccaggcgagttttcttcgcttggccctcctgtcgaatcgagcagtcatacgtcgtgccgtcgtatcgtcgactcgtcgtcgtccaactccaaccttgcgcggcaaccgggtttccggtttccttctcctgcttacaaatcgtcgggcccgggcacctcgtgactactccctccgttccaataaaaaaaagacaaacactggtttcgtgtccaacgtttgaccatccgttttatttgaaaaaattatgaaaaaaattaaaaagataagtcacgcataaaatattaatcatgttttatcatctaacaacaacgcaagtacgaattaaaaaaaatttcatataagacgaacagtcaaagttggatacgaaaacccatacgaaaacccatagcttgtggacggagagagtacgtgagaacggagggaaaaaaaaaagaaacagcctgatatgcggccgtcaatcgcggcgcactccatcgtatctcatcatctcctctcccccaccgcgcgcgcgcgcagcccgcgtggttagatcccgtttctaccagcgcatatgatgtgcaaggcactccaagccagaaaa

SEQ ID NO: 32955 - DNA, 224 bp, Oryza sativa
agaaagtcgctggccattgaatgaaggttgaaacgggcgtccaccgagagagctgacgagcggagcagaagacgtgtgctgtgcttgtcagaggtcacttccggctgtagactagccctcattgtaaaaagcatgtttcctttcttaggcagcgagaggcccatgtggtgacccctgaccagataaaaaggaggcccaggcctaggagagaggggatttgggat

SEQ ID NO: 32956 - DNA, 173 bp, Oryza sativa
ccctattttaaaatttaaacataggccaaaccactaatgtgtaggtctttaccttaggcgatattatgtttttgaaaagatagggcgtagtatgtattattgaatccggcgttagatctggttagtatgatatgaacttagttaacctagttagtttttcatcaagcaacaat

SEQ ID NO: 32957 - DNA, 1501 bp, Oryza sativa
ttagtatgcccgtttatcacaaaactacaggtactttgtacaatctatcacaaaactacagatttaagaacttgtttcacaaaactatagaattagtgtattcgtttatcataggactacacatttagtgtcttcatttatcacaaaactacaaatttagtgtctccattatcacaaaactacaggttttgacaatgctaaaacctgtagttttgtgataatgaagacactaaacctgtagttttatgataaatgaagatattaaatctgtagttttgtgaaacaagttcttaaatctgtagttttgtgatatattgtgtaaaatacctgtagttttgtgataaacgaagacattaaatttgtagttttgtgaaataagttcttaaatctatagttttgtgatagatcatgcaaagtatatgtagttttatgaaatttactcaaaaataaataaaacagagattaattcaaactccagttcatgatttttaaaatggtaaaatttccattagcaaaactctagttcatgattctaaaatagtaagtccagtttatgactgataaaaccatgtacatttcttagctaatggttaatggaatgccagttctcctgcattttcgtcaaaaataaaacagaacacgtaacatctcaacaccacatatcataaatgacatattgtagaggtgatcccttcctaatacagcaattcagtgtgggattaacaattctttggaaaagaaaaagagaactgcggtttgtcaaaagagggatttcttaaacccacacagtgacagttgtaaaagagtggccggatatatgaatttatcaattatcgcatgtcttcatacactggacattatcaggtaaaacaccaaaacaaatgaactggtaactatgcttcaaccattttcaggctaaacatacaaaatggctatgcaaacattacattttacaagtaaaaatgaaaatcagaacatgcaatctcctttgtgaatgtatgtcttagacagctgaataggtcccagctgatgggagattggtcgagagtgctcagagttgaaaattgaaaattgatggccatggttggatcatgaggattaagtgtactgctaaattggaaaggccgaaacaacttaaggaacaactaagaaggggcaagcagcagattcacgagagttcagatgccgacaaaacgtcatctgcaattttgtaatatcataaatgctttaactgaagatttttccataagccaaaactagaaatggatgataaaggtgtgccgtatttagaagctataagatagcgtttacctccttttgttatgggcatggaccaggcccatgcagcagtttaggcattataaattaggaattactcatataaaggtaggagattatctagttaggaaagagatgaggtctattagaaagttagagatagagattgcactggtttctatggtactagatattagttccttggatatcaagcctgtcctcc

SEQ ID NO: 32958 - DNA, 1501 bp, Oryza sativa
tgacacaacgcctaataggaattattttgcagcattaatatgaaaagctaaatcattgttataagcagttggttgggaggttgctcaatcccaaaggatacactggatgataattatcctggcaaatttcaattttgtttatggttgacatgatattgtgaaaaaagggaaattggttttatggctcgaggttgtatatcttattgatgagaatgaggtcaaatgttatacaaatatttctgcgcagtattatgttcattagatcatccgcttcatcaaatttacgccatctagcgatattacagaaataagataaatgtatgattctgcaatagcctcttccagttgtttcttggcaatagtttaccttagctgtttaatttcagatgattcttccagactacacaagttgtcattggctgcaaaattcttttcacttgtggagccaaaagtgcaataatgctcatgatgccgagaccgttgaaattcttaccgaggtaatatggatttctgttattgtctaggtttcaccatttttttataagaaccttgatttagtttgtatgagttgtttctgctggttagcggagtgagtagttaatatgtttttggatgatctggtccttttctatcatgtatagtttttagtcgtgagactaagttcaagctagcacatctcaaataaagtggctgccatgtccattctctttttcagcatgaactgaaatgttgtggtattttttttaatgtaaaaatagataatgttgacttaattattgagtgtcacattaataatcttttgcaatccttgcatgggctgtataaatgttgaccacagtaggtcataatattttctcatgatttgcaccggctagctcactttcttgtctcatcatacagtccgcttgtgtggcttatgttcacctgaaatgtgttaatttatagtttttgtgatcctagctgaatttgtgtttccatgggatcatttgtttggtttgctacaaaatggggttatccttttttaccctgttctttatttagcggacggaatagtatgcagatggcatgaaatagattcctaatttgggtatgtgtctttcttgtctaagatgaaagtgtatttttgtgcacatcgaacttgaagatttcaaaccactgtcttgaaatcatatggatattggtctgtttgattactaagctagtgacccagttgtagtcacttgggaagttgttccaaagcattgtctcttggacattgtggcactctttgttaaagcaagtggatcaccagtgccaaataggagagataagttgttcagtttattgtagaaatttgaccttgttatgtagtttgactttcttgaagctaactatgtgtctgtctgctactgatgaaataatatatggaataatggaaatgatctgcactacacgtgctttactatttgattattcccttgttacacttgatgtgctactgtttctcacactatttaaagct

SEQ ID NO: 32959 - DNA, 1501 bp, Oryza sativa
ctatttttgtgacaatatttttacataattcgtacatgaaaaatacgcaaagagacattttgttacgcctagatatgtcgtgttacatgctttttaaccaaaccccgtgtccaatatacacagtcatattctaccaatgcgataaaactttacacgattcgtgcaaatacaaaatacgagaaaagatacctctatattatacctaacacatgtcacggttaaactggagtacgttttcagccaaactccccgaggactacctttttagccaaactctgcgttcaaaatacgcatagaaatacgtgcaaaatactacagctgccaccccctgcatttggcgtacatgatcaaagcttgtaggagtagcagtagtagtcctatataaaaccgggagagggaggccgatggtgatggccccaccgttttaaccttgattcatctcctagtttccactgatctccagcgctttttggatcgacggcgacgccgccctctccatctccagagagagccctcttctccgtttcttcctactaggctactactactcctcctcggctcaaccctcccgtcccctcacccccacgcgcgccgccttctccccagaacgcgccgcggcgaagcgccgccgaagcagcccccactcctccgcgcgcggcggcggcggcgcagtctccagacgcttcctcctccggggatctcggtatggctgactactgggttttttttttcctttttcgcgattcctccccctgattaatctgctgcgattccgtacaattctgccgcgccctgttgcatatagattactcgcgcgggggggtttggttggttgggaggtggttttgttaatctgtttgagagttgagttgctagtggatgattcgtgtgcggttttagcattggcgggggcgcctctgctctcgctctctctctctcgcgcggcggcggaggaagcctcgcttcctcgcggggcgcggtggagtgtgacggcctcgaccactgcttccggaaatcagtcgcagccttctcccctgtgtgcgcggcgtgctcgcgcgcacggccggtgacggcgaggggagcaggtttgtaggagcacgcgggccggggcggcgttcatgtaaggttggaatcgaactgaatgtgttcggtttttctcgtagtcatcactccgccgcctccgcgccacgttaggtcggttccatgggtttcagttgtgtagtgcgatccatgtggtacacggaagagccaatcccttgtagatgcaggatccataccctgtttgttgtctggttttcctcccatgattgaatttagtgggaacaagtaggatcgttaagaaattctactactacctcgacagatggtgttgcattcgtacacgtttttactgtgttctactatggtggtgactggacttcagtttagaatgttgttatattcttgatagttaaggttaatgattgtaagtcactgtgttttcttgaattcagcctttgaa

SEQ ID NO: 32960 - DNA, 1501 bp, Oryza sativa
aattactgttctgggagattcataacatttgtgaaaaagaaaattaaagcaagaataatagcaaaaaaggaaaaaaaatgacagctgtgggatttgaacccacgccctttcggaccagagcctaaatctggcgccttagaccactcggccaaactgtctttgctggcttactgcatataagaattattttaaatggtttataaaaaactggattgactaaagtttctgcatgacagaagaacaacaaaagatgatttttactgttaaaacacgttagaaacttgagtgttttatagccatactcctactcgtattgtgcagcctttgaatttgaagttctaattgagttttcatacgaagtgagtataattcaactgattagcttacttataatggaacctgtccaccgggatttaagtccttgaaaagaatgcttgtatttattgctgtttcttttagtgttaggtgatatacccacaaacagtgaggtatctttagtgacttcgttaatcttgacatatgttggtctagtcttttgaaagtgcccgtaggagtaaggtgtgtattcataggggtgaatatgcgtatattgtgagcgcatatatttgtgtatttctaaattaattttacatgttgtttgtttcctactccatctgccctacaatgtaagcatttttgaagtttttgatggagattaaaagagaactaaaatttatggttgtgatgataaagtaaaagaataaattaaatgtgagatttttgtgattttcaagatgattagatgagaaagtccgtggagaagttgctagacaaattctatatgctgtaagttgtattttaaggtaaatggagtttcctatttagctaaaaaataattagatgtttgaagttcaaaaaagcaaaaataaaggtaattaaagaagttgtcatattctggtacaaattttgggtgttattttggaccaaaaattgaatgttagaagtgtttgaagttcaaaaaagaggaatgtttgaagtttacttaaaaccaaataattagataactaaaaaattgatatatctaaacatcaatgttgaatttggaaaattttaaaaaagacaactatataagggcccatccgggttcgaaccggagacctattgatctgcagtcaattgctctaccactgagctatggacccaattgctgttagtactgattgtattttatttatactgtatagtgctactgagctatggacccagttcactttttttattttataaattagattagataatggtgtggtgcttagaactatttgcgtgtccagcaaagctaatgacaaaagaaaaggaaggcgttgttgctttaattgcaaataactttgcggtacctttacgtgtgtacgcagcttatttttattttcctaccaaacttgcgtgctaccgagacaacttagatagaaggaaaattgttatgcacataagtcacattgattacaagaacgattcttctttc

SEQ ID NO: 32961 - DNA, 1501 bp, Oryza sativa
tttttttttaaaaaaaagagggggtactccaaaacgaaaaaaaatatatttcattttggcacttttttttacctaattaaaatattttttctaaattaacaaaaaaatgaaaaataaaaatcaagttttctgatgaaatagtttcgttgtttcgtgctaggggggggtccaaaattctcaatttcttgtaccgagattgcaaaccctgtagggattaagccacattatggacgtacttagaacaaattaatcactgatgggaatgatagtagtatgataccgagtgggttcgcattctttccttgtctgtctctctgcctgtggttcatccgttccctacttttcgttagacggaacaaaccaaccagcgatcgatcgatcgatcgagctcgaaatgcggtggtggatatatgttgccagcagatgcgacgtccaatttcaacgacaagcgttttcgcgagctcggcggtgacggcttcagctcaccaacccaacccagcaaaaccgcgaaaccaaattaacctgcaaccccaagagagaaaaacacacgtcgctcaaactgaataagaccgttatttttgttgacacatcggtcgatcgttcggttcgttggtgcccatcggattattatgcctgtcaatgtgttatgcatatgccatatcgtttaaacacattatgcaattctgtagtatcatttattgaaaattgttatgcgtacgataaaattgatacgattttattacaatcctatcttgcgtgcgtacaattggaccacgaaaatacgttgattgtaaaagattttatcgtgtgcatagcagtgctcgttatttatttgccagtagctttgaatttttttgttctatactttgcgcttaaacatagctttaagagaaaatgaccatgttacccttgtggcttagcggcggtcatttgcactaatatacaatcattaaggatgctgattagccacgaatggattaagaaacgcttaataatggaactactagtacattttcacggcccgccccagtcgagtgacagtcacgaggcacgcgacacgtaaataaatacggagctcttaattacgcttcgtcctcctcccctcccctcccccctctctctctctcctcgcggctgcaaatcgagaggaagaggaagacgagaggagaggagagcgcgtggcgtcgagaggaaaagccggagccattgagccgcaggcctcctcctcgcgcgcgagcgcggccggcatctccggctcggatcgagcttgaaggtacgcgttgttccatccgtggtccctccctttcccgcgccatttcttgatgggacacgctgtagattggagatccatccggggattggtttctttccctccaatttgacccgccatgtttcttcgggatttctttctttcgatgcgtttgtgcttcgctgatagtagtagcggtttgtttccaggagaaattggggggcttgagctgaaagatcttggtacaattct

SEQ ID NO: 32962 - DNA, 1501 bp, Oryza sativa
gaagctcgcgtacgccttccggtactttgccacccacttctcgaacagctcgatcagccggtcgtgcgacgccaggtcctcctccgagtacccgacaatggagaactcgccgccgctgcggccggcggcgcacgcggcgccgccgcacaggcacagcagcaggaggacgacgcccacggtcaccttcgtctccatgtcgatctctgtctgaatttttcctcttctccttcttctttttttaactgaagacgaaagaaactgtttctgaattgaagagaggatgcatgcaatgcatggggtatttgtagccattgatccgggcaatttaatttgcttggaagcaaaggctccgaaagtgagaacagtttgagtgtttgccgaatcatgccaaggctttaagctttgctctgaatgtcaggccgagactttgctttcaagcatgaatgctgggtgcagatcgagctgcagaaaagatggctttcttttcttttcttttcttggttacatagctgcaacttgagagaagatagatagatagatctatctgagtgcgcatcaacatggctgaaagaaagcaatcgagaatggatgcaagcatgcgaagtctcaactaaagaaagattgtacatggaaccaactgcaacctgatggatgaacgatctgcatcagtaagtgcttttcaagatagtggttcctgcatctgctgaagatagtagacagtgaggaccgatttctatctctgtgccattgttaagttaatgccatctctttcgtaaagaggatgttgtctgttggaccatggtttctacttggagtaaaacaggggcatcaagttcatcataccatgtcatctgcgtgcatacatcattctctgacatactatttttcttctgcacaagatgcaaaagtcaatataaactcgctggctgaagaattggagcaatgcaaatatgttcttgttttgagcttgttcacgacctgtatgctcactgttaaggttgatatacaatttactagtaaaaaacagagagtccttttctttcttctgaattttcacttgaaattactagtgtacaactgtacatcaacaatgtgaatgctaactgagcgtgaaatgccatatactcctatcttttaccattcgtcactaataaaaatattccgacagacaatggaaatagtaggcaggagaagaggggaaatagtttttttttttttgaaactggggaaatagtatgttaattgtacgcagaacttaatgcaactaatatgggccgcacgtgaccccccatcccattgttgggccgcgaggaatctatatcccccttttggcccaactaattaatatgggccgcaatccccgttcagctccacgtaatatgggccgcctttgatcccggcccaataaccgtcgccttcccccccaatctgctccggcgaattgaagaaattcaggcattcagctgccaacagaccaaaaaaactagaatattagggaagg

SEQ ID NO: 32963 - DNA, 1501 bp, Oryza sativa
gtgaacagacaacagtgtattgaaagccacattttgtcgcttaatttattaccagaacgcttaaactagcttgaacatgagtattagctgaggttcgtggagtactcctagatgacatagttttgacatatgtatatgtgatagtcccacatgtcatatcgagatggaaacaaaaggattcttttttttctaaagaaaaaaggaaaaattgaagactgatttctagtctacaccaagggatgtacgtaaccatgcattcagatcgagtcactaccacatactcccctccgtaaaaaaaaaatcaaaccctagatttaaatttggacatagggtttgattttttttaacagactagtacttctcaattttggtgaacctttttttttttacctttgaaccaactagctagggatttgattttgatatcttgcaaaaatggctaggtggtgtatactgagtgtgtgtgtagagttctgttattgtattgatatactgtttttgtatttggttaattcctgtaccaggcaagaacgtgcatcagttgattttaattgatcgccttctatgattgaataattaatatcattagaaggctaccttcgacaactcatgcatgtcacccttattttatcctgcactataagaggatatcatagttagctatcttaattaaaccgagaattttctgtttgattgttattcatgatcgcctggcagcagagatgccgagatacgtacttctacttggatgtttatatctatttctaacccagtgatgccggaagaggctgataattggatgcacttatcaagctaagataattatacgtttggtaaaattttacagtaaaagtacgcgaaattattcagactagtaatcatggaattgatcaaacatattgttcttttgcaaatagacaaataaaacaacattaatttgaaacactatttatttgaagcagcgcaaatagataaaaacaagagtaaactttacttgggccacctagcttttattatgaatgttttcacttggattgccctttaaccgatgctttcactttggatcggataatcttacattgtaacacttggatcaccctgactcttttctcaaccatataaggccatcaccaatgcgtgtctttgggttgttccctcgccgacagacgtctgcttttccatccgcgccggctccccacgatggagcgcgtcccccggctgagggacgagtctctcgccacttttcggctgagcgatgcagtcgagggacgcattggggggcgacgggctcctgtagacatcggttccccagctcgtattcctattccaccccttagcagagctagagtcgccgccggccgacgacgacgaagagggagagaggagcttcattgcgaccaccgggaccgggatggcttcctccgcgtcctcccagagcgcggcacagccgggacggcgccgaggcggacccataagagagagagagcggcaagcggcgggg

SEQ ID NO: 32964 - DNA, 1501 bp, Oryza sativa
ttcaattttgattgtaagatttctgtttgcaaaagctaccagctacgaaagtgtgagccatcaattggatgatttgatatgtgaagctgaagttggataagaggcttagacgcatatgagttggaaaaaacagtagcagtagtacccaaaagatctgtgcaaaaagttataccgctggaacatcatgagcagaaaaaaacttagtaaatacgaactgctgcttgatttcagcgaaaataagtttgaggagattcgctgagctaccagcatgatatgtttctaccgaaaatacaagcttctgaaacattaacaatgcagcctacccatcgtaatcattagttatcacttagtgctaatacttgatacgagaaacttgaagccgcttttgctcccgaaagagaattgtctagtgaccatacttctggaactcccactcgctgttgtctgcatagataaaatagaaaagtaaggcacggtgaacgagcagaggtaacaaccacaccaattaagtggcattttccagggcaaccaacctagagggcacacttgacgggtcttgagccaacggctgatgcagtggaagtggaatgcatggttgcaaactcctgacacaacaaagatagattgttcatcagtacatggatagttgacttcacagctcgatttaattcactgcgaaaatgcaatatccactaaaagcaacacaaaaagacgagaagaatccagttacacggaaagaaaacaaagttccataatactcccccaggagagaaacttcagtattataaatatattgaacatagcatttgactgtgcaagtcagtattgtttaattcaaaacaatacttgaacatataatccagagggcacacagaaggtgcaagtgtacatatccctaaacaacaacatgctgtaaacataagatcagtcaaagtagattaaactgtgggcagaagaagaacatattaacatgccgggtagccaaggaagatccacacacaagaatctcatacaaatatataaagcaattgtagctaaaagcctttgatgaaaatatacaccactaacttcaactagttccagatgcaagaattcacttccatcaattgacacagctaacatgaacactcacccaccctccccaacccacattccagtgattctctttgacaaatcataggaactaggaaacccagacatgaactgtattatcatatttgagtttcatgtgtgcatagttcaaggtataattataattgaacagtagatggttaatccagaagaaggtactcctagccagtagccattcaattatcctatcataactacatacttctttatgaaagataaattcaacatattctacaagggccatgtcacgtccaaagctaactgcgacatattatataattatagacttagataaaaaaccaagagacaaaccaatatagcaaaccatgcataattatagtacaaatttccaactatgaatataaccagt

SEQ ID NO: 32965 - DNA, 1501 bp, Oryza sativa
tagatgcactaataacagaggttctgcaattgtgtactgaatgaattagtttagtttctgaatgtgtgtgcatttgcacaagtaaggttgcaaccaactatgtagtaagatgtagctgtcagttttgccactgaaaacaaacaaaggagggaaggtatatgtgcatatacctgatggagagatgagatgaggccttgtacactgaattattgccacaacatagcaaagattgtacttgggacaatttccccttgcattgacttcttgtctttagtggtacttacctacaaaataaaacaacttaagtgactggtatcttaattggctagtaaactacttataaattaaaataactaatcatttaaacattttttcctataacatagtttccgatgttatattggtttaaatgaagttgtattatatatgttagcttctcctatgatttatttaaacaattattgcaaataacatttatatatatacatatgttgctgatataggatggctggtgagtattggacactcagggttttcaaacatgatcgtggaccaaacactgatattttggagaaaaagatagagagaaataatatatgctactccaacttgatcaggctattggaaacagagggttatgaagcaagtgatgagttatttttcacaagtagcgatacatactattgtggcactttgaccaagattgaaggtgaaacacatgtgaaggacatgatcatggagaatgacaagagcaagatggctgatttacacttgttcaaggcaatacagagaacacccttttctcctctaaaaattgataatgttgaggtcattgcagggtcatctcagcaggaagataacattgattacaaccctgaactgataggcgtggcagacgaccaacatagcatttcaagtggtgacacggatcatgaacaagaaaaggtcgattatgttgagaaactaaatgagatgaagaggcagagggaagatccaatgacccattgtgaaggtgacactgatattgatgatttgtatacccctgaggacgctgatgtagatttgggtgttgcagacatagacgatatgtcatgtgagctgtctgatccacctagtgaggatggtggattgagcacacttgaatgtgagacagacgaagagaacaaaccaccaccagggaaaaggaggagaggaaaaggaattcaagttcagaggatttattttgacgagagcaatatgatggacacaagccaattgtgcaagggcatgtgtttcaccgacgcaggacaatttagaaaggctttgaagtcgtaccacattgtaaaagggagggattataagtacaccaggaataaagctgataggataaaagtgaagtgtagtcaagataaggttaagtgtgatttcttcattagagcatcacaagttgggagcgagaaaaccttcatggttagagagatgattgctccccacacatgtccaagtcatagaaactgcaccc

SEQ ID NO: 32966 - DNA, 1501 bp, Oryza sativa
gtgctcacagaggtccatgatgtggttgcggcagatggcgcagttgtccacgacgatgtctgcacgagaagaagaagaagaagaaaaccgcgacggaatcgcatcagatcgcacacgagaaagccaacaagcgagacgcgggcgccatcggcggacgcggacgcggacgcttaccccaggcccagagggagacagcgttccacttcttgatctcgaagcgcttgcccttcttggccccggaggaggaggcgccggcgatggaggggggcacggccacggcgacgtcgcccttgtccatggcgaaccctagggtgggaggggagcgcgaggaggaggagtagattgggacgagacgagaagcgaccgcgaggagagagacgagaggtaaaatagaaaagaggaggcggcggcgcagagtctaataaaggcctcagtccaagcccttgtaggtacagtattaacgggccatcaaaagcccaaagtattaacgggccatgcttgggttcttgctgaagatacagtttttctcttaattctttttggtgcatgtgtcatgtgtgagagagtaaatttattttaaatatcacaccaaggcctatttggggaggattatttgaatcacctagtgagtactcccttcgtttcaggttataagacgttttgatttagtcaaagttaaactgctttaagttgaccaagtttgtagaaaaaagtagtaacattttcaacacaagacaaatttattatcaaaatatatttaattattgttttgctcaaactaatttagtgttataaatattactatatttatctataagcttagtcaaacttaaacaatttgtctttaaccaaagtcaaaacgtcttataacgtgaaacggagggagtagtagctagttgatgagaatatggaaaatttgtgtttcttatattctaacttctattcactcagtttcaaattacttatctcgttctagatttttcataagtcaaccatttgaatatttgaccatcaatttctacaaactcatttagcttagcattattagatttatattatattttcagattgaccatgagaaatacttttatgaattataattcacgtgttgttgaactacacggatttttataaactaatggtcaaagatatgcatatttgacttaggacaaacctaaaacacgtaatttaaaacaggggagtaatttattttttgagtgatattttgatcatactttgttaaaaatattacaaaaatataattatattgttacccgtggtagttcacaattgccaaatatcctgaggcagacgagaacgataataatcgctgattcacgtgtgaccatgtgaggttggaccaacggcgtgacgtcaaagttcagacgatagcatgacgaggtgcaaaatcaagatccaactgtacgctgacagcagagctgacttgctaaatatcactaggcattcccacacacaggtgacaaagaagacaacagcaatt

SEQ ID NO: 32967 - DNA, 1501 bp, Oryza sativa
tggagtcacgtgccatcccatccgtttgggatgccacggccacttaggctgactcgtgcaacaagaacaccaccaataactaaataactactccatccgtttcgaaatgtttgacgccgttgactttttatcacatatttaaccattcgtcttattaaaaaaatttaaataattattagttcttttcctatcatttgattcattgttaaatatatttttatgtaggcatataattttacatatctcataaaaaaatttgaataagacgaacggttaaacatgtgctaaaaaagtcaatggtatcaaacatttcgaaacggagggagtataataagagcaagtttaatagtatagccaactattgatccaaattatctatagctaatctaatagtcaattcatacaatagttaactataaaaatatactacaccattaatactctgtcccacctctcatacacacataacatcttggagtccgtgttgcagctggctacaaatctgcagcccactttcttctctctcttctcttttcttctcgatacgtggttatagctgatttatagcttgctattgtacctgctctaactatagtattatatataccaatatcttcatcttaaaatataataactagtaaatgtttattttacgaatataatggctatatatcgcctctactctacgggcttgttcactttgttaccatttggaaccttaccaagttttggcattgccaaaatttagtaaggttgtcaaaattttgccaagatttcatatgtacttattaaaatttagcaacaaactaaatatagctaaaattttgacaactttatcaagaaaaaatggtatagttgaaaatgacatcaaaataaacaggcactactaatagagtactagaagaagtaagtgctaccgttttccttttttttcctcttcccttgtccgcgatttcttttgtctcccagtcaaccctcttcttttcataaaaaacaatttattccgattttcacattatcattaaaaaaagcaagttttaaattgggttagtggttataacctatatcttttcactcagccaaataaacttttgcatagaatatgtatgttcaatatatcatgggaagtttaattctagtattcaaacaacgaaaagaatataagtgggtaatcttttttgccgtatataaaagtttattttttaattgatttataaaatttggaaagaaaacattgaataagttagaaaaaaatctacttatttgtccactatattattattttatgaaaaatttactcgtaaatttacacagtacacgagttgtacttgaatcggagtaaagaagttgtagcattttcttggaagcatgtcgttgaagagcatgagcgctgctcaaccaaatctccattttctaaatcaaccaagccttgacctagcttgctaccaccattcgtgcacacacattctctctttctctctcagcaatggcaagggtggca

SEQ ID NO: 32968 - DNA, 334 bp, Oryza sativa
aagttggataccactctggagttcttacaatggaaggcaaaaaatggtgttagtgacaaggcatttggcgatttattgtaactcgtcaagaacattcttccggagggaaacaaattgcccgagacaacgtacgaggctaagaagatagtctgccctctaggactggaagttcagaagattcacgcatgtccgaatgattgtatcctatatcgcggtgaggagtacgagaacctagaagcatgctctgtttgcaaagcactacgatacaagattagacgagatgatccaggagaagttgacgggcagctaacgaagaagagaattcctgctaagg

SEQ ID NO: 32969 - DNA, 786 bp, Oryza sativa
aatacattttattggtaatacatatatgattatatatgtaacttggcccgtttagagtaatacattttcctggtaatgttgcagagaagacgtcgtcgtcgtccctcaagccgaattggtagctagccatcgaagtaattcgcgcaggcaagtgatgtaaagaagtgattgttagatatttaatataagattgttagacttagcatatatgattattacaattttaatataagattgttatcgatttaatataagtttgttagacttagcatatatgattgttagcgatttaatataagattgttagacttagcatatatatatatatatatatatatatatgattattacaattttaatataagattagtagcgatttaatatgagattagtagagatttaatataagattagtagcgatttaatataagattgttatacttagcatacatatatgattattacaattttaatatgagattagtagcgatttaatataagattgttagacttagcatatatgattattacaattttaatataagattattagagatttaatataagattgttagacttagcatatatatatatatatatatatatatatatatatatatatatatatatatatatatatatatatgattattacaattttaatatgagattagtagccatttaatataagattattagagatttaatataagattagcagagttttaatattacggttagcaaatacatcctatatacctaacaaatattttttgtatgcacaga

SEQ ID NO: 32970 - DNA, 1501 bp, Oryza sativa
gtagaaaaacacatgaatctaaaaatttcccacaagattagagctcttactaagttttcttcaaaaaatatataaaatgaaccattccatataaattctatagtatctgaaaagtttcaatcagtgaatcaaataggcacataaaaaaaagtcctatatgattttaatgctatgaaattcatgcatagaatcctttaattagcccttatacatcagtacttacaaccttgtcatcatgatgtacttcctccgtcccaaaaaaaaaacttaacctattaagggatgtaagttttttttggatggagagagtaactcgcaactctcttgccttgtggagtactccctccgtcccataatataagggattttgaatttttgcttgcaacgtttgatcactcgtcttattcaaaaaattttgaaattattatttattttatttgtgacttactttattatccacagtactttaagcacaacttttcgttttttatatttgcaaaaaaaatttgaataagacgagtggtcaaacgttgcaagtaaaaattcaaaatcccttatattgtgggacggagggagtagtacctaagaccaaatacaaacatattactcataatacaaggttagtataaccgttcgcaactctctcgtcttgcagtatatatgctccctctagtcatatagtagtaatactttagactatgttcggttagtcccgagagaaagattaaaagggatttatttcacacctattatggtgtggaattactccccctcaaacccctccaatccgctttaaccccctccaaaccaaacaaggccttatgttttgaaaataaaataatcaaactttataacttttgtttctaaaatacgaagaccatacgtaaaattagttttgtataaattagttttaagaagtacttcaacatccataaaatcatatatctattgttatttttatttatactatagtagaaaataaaggctattgattttttatatttatactgtagtagaaaataaaaagttacagttgttcttttaaggccgtttcgttatcaaccggagggagtagcacacatccaagcccaccgaaaaacgccccacgcagaaaccgggccctataaggttattgcaggcttgcagttatgacaattgacaagaacgatcactaaatcctgggctacaagagccttcggtgtgcgctgaaaaggtcagattaacactgaagcttcgcccaggttaatcgtgctcgaagttgcacaatgacgaggtgaaaggggccaaaacttcttttcccggttcgctggttttttaagtgccggcgggcgatgggaggtggacgactgtgctgtgtgcagagtagtatagagaaaattgattagcgtacaaaattgacccattgcatagttgtacaaaatcataaaagagaacagggtcgatgttgcaggaaagatctgaaatgtaaatgaacagagatagaggaaattagtgacgaatg

SEQ ID NO: 32971 - DNA, 1501 bp, Oryza sativa
tggcgatggatcagtttaacaactctgccgatgcaaaagttttgtttggttccatcaaggcctgtggagagggaatctcccttgttggtgcatctcgagtcatcattctagatgttcatttgaacccatctgtcacccgtcaagcaatcggacgtgcattcaggcccggacagcagaagaaagtgtttgtgtacaggcttgttgctgctgattctccagaggtgaagttccatgaaactgcattcaagaaagaagttatcccaaagctatggtttgaatggagtgagctctgcactactgaagacttcaaactgaatcaagttgatattgatgactctgaagatgaactattggaggctaatgctattcgccaggatatcaaggctttgtatagaaggtcagctatctctttctccccgtgcgcatgtgcaagttaaaccctggagatgctctctctgtcttatccaaaattgtcttgtaggtaacaagttatatgtggctgctgtacaccatgtacataatgcaatgctgatctttctgggtgatcatcgctgtgaagtaaggggatttctcgtgaatcattcttcacgttacaaaatctttgccccttattctgttctgattgtatgaccatcagctttttcgttaaccttcatcatttttcttccttcaggatgttacagtagccccttctaatgccggagttccgttcatgctaggatttatcgttaacctcggtcgtttccctacctatttgaaccactgtccgctttgttaacatgtgccagcttggcgcagcggttcgcgagctgatcctagtcttatttccttctgaagatctccaggactaataactatggtttctgccgttcctgctaacaacttaaataatgccactgtttccttacctgtcttttgtgcacttcaattggtcttcaaatttgccctttttgatagggtaaagatagtttctttctgcgcgtaacggaatgtaggttatccgtcgtgcatttgtgcatctcttttatctcctttgttgcagtacctggtttttgtgtcgaccattctagtttcaattctggctcccatgaaagatgctttaagactcgcaatgccaggatgcatactttttttttatgcatactcgatcgttggctcgttgcactcatcgactccagatcagttgccagcggcaactaatctctcaaaggcctggcggttgtgttcacctggtgctggtgcatccgagggtgacgacaaggacaggggaagaggagctgtttgtacttttgcagggcccgctttttttcagcttagaagcataatatcacctgattgttacgaattatttgcttcatgtttaagaataataatttctcatgaaactttcttttactttattgcccagaccacttgttttaaactacaactatttattatgtttagataatatgcaatatttaatgtattcatattattaatttatctgcaataaaacaaa

SEQ ID NO: 32972 - DNA, 1501 bp, Oryza sativa
ctgcatttgtttgatcccttttcctctgcacaagctagtttggtcaaaccagagctggttgcctgtttagtaaggttcggcctctgtaatcacaattgacttgtacaaaaaaagctactaagataattaaataattacttactgttactattgtctttctcaagaaagtattctatggagaaactactgacttgtagcagaatgggatcgagcaaaatcaacacacattgcagccgaatgtattagaagaaaaaaaagagaagaagctaattaagaatcaaagacaaatgtagtagtagctaagaaagctatgcttgtgatccaagatattattgtagctagctgcaagatcttaaatttggtgtatgtttgtggactaagtaagcagctagtactactaaaatggtgggtagctaagctagctatagcttggaattgtgtgaaactgatttatgggctagcatgcagctggagtactaatttagtttagagtccatgcgtctgtgttttgttgtgtgcccgggatcagcggacaggggtcttgcatttgaggtggcctgaagaactgaaatgtttttaatccaacaacccatttgcacatgcatttgctagctggtttgcaattgctacatgttcatcatatcaattgaatttgataacaagctcacaggtatgactgaatgcattgtagtgatgtagcagccatgtatgacaacaagctcacaggtatgactgaatgattcaacatgaaattaattattgaatttaaagaaaccttttctttcgttacaatacattctctgaatgactatgcatacatatggccatgcatgtatatcgatagatcttgcgtaggcacattagcaatttgacatgtgtggtttcaactatctccagctccaaatgctcaagtttacgcaaccaacgataactgaataaatacagcttgtgtagcttgtagcttatgcaatctagcatgcttgttgccattcaaatggaattaggtcgtcgatgaaatgcagccagacttcagttttaatctttccccttgttctagtactttaaatattaattcatatgtggctgatacagtgatatggaggaggtattaatttgatgataaaaaaaagaaaagaaaagaaagatgtggaagtgaagaactgaagtaactgaagaagggagaactgaggtagctctacatgtgcttttttcttgggatgcctttgtataaacaaagcaaaatgaaatgatccagttattggttatggggtggaccatgagtgacacgtcgccctgcctccccttttgcaagctttcagcagaaagtgtccattttttgttggccatcacccatctttctttaattcttttttacttgccattgtcaatccacagcaggcaggtaggcaccaccatatgcattttttttgttatttttttcttctcaaaaaaataaatgaatttgagattgggtagcattgagttatgtcgttcgagaaag

SEQ ID NO: 32973 - DNA, 1501 bp, Oryza sativa
tctcgacattatattatatcatctgaactccgaaggatgggattttgagcataattggagaagagagtctgatggcaatgctggtctgttggcagctgagaaatgcccaggggtcttccggctagctccacaaggtggtgggctagacgacctgggttcaaagcctcacccctcctaattatttgatattaggtccttccctaatattctagtttttttggtctgttggcagctgaatgcctgaatttcttcaattcgccggagcagattgggggggaaggcgacggttattgggccgggatcaaaggcggcccatattacgtggagctgaacggggattgcggcccatattaattagttgggccaaaagggggatatagattcctcgcggcccaacaatgggatggggggtcacgtgcggcccatattagttgcattaagttctgcgtacaattaacatactatttccccagtttcaaaaaaaaaaaaactatttcccctcttctcctgcctactatttccattgtctgtcggaatatttttattagtgacgaatggtaaaagataggagtatatggcatttcacgctcagttagcattcacattgttgatgtacagttgtacactagtaatttcaagtgaaaattcagaagaaagaaaaggactctctgttttttactagtaaattgtatatcaaccttaacagtgagcatacaggtcgtgaacaagctcaaaacaagaacatatttgcattgctccaattcttcagccagcgagtttatattgacttttgcatcttgtgcagaagaaaaatagtatgtcagagaatgatgtatgcacgcagatgacatggtatgatgaacttgatgcccctgttttactccaagtagaaaccatggtccaacagacaacatcctctttacgaaagagatggcattaacttaacaatggcacagagatagaaatcggtcctcactgtctactatcttcagcagatgcaggaaccactatcttgaaaagcacttactgatgcagatcgttcatccatcaggttgcagttggttccatgtacaatctttctttagttgagacttcgcatgcttgcatccattctcgattgctttctttcagccatgttgatgcgcactcagatagatctatctatctatcttctctcaagttgcagctatgtaaccaagaaaagaaaagaaaagaaagccatcttttctgcagctcgatctgcacccagcattcatgcttgaaagcaaagtctcggcctgacattcagagcaaagcttaaagccttggcatgattcggcaaacactcaaactgttctcactttcggagcctttgcttccaagcaaattaaattgcccggatcaatggctacaaataccccatgcattgcatgcatcctctcttcaattcagaaacagtttctttcgtcttcagttaaaaaaagaagaaggagaagaggaaaaattcagacagagatcgaca

SEQ ID NO: 32974 - DNA, 1501 bp, Oryza sativa
cttccaaattatgatctactcactccagaagcttctgttgtcctgttaactgatagcatcttctcttctaatgttctgtggactgtgtttaatttagcactagcatttaatttggggcctacttgaatatcattatattatattgctaaaatttgatggtttgccatttaatttgtttgtaagttcactgaatcatgtgtaatctagatagtactaagttagtggtaggtgtgttagctccctccaactgaagaagatgagacatgcaaagcaccctgcgtcatgtacaacccacaaagttctaattaacgttcttaactatatataaaatatcataacaataactccttaatgtgaaaggtaaatagcctctttgagtaatccacatgaagatgtggatctgaaagacaaatgaggatgtagatctgaaaacaattgtaaataaattcataggataagaaaaagacaatgcttgatttgatactgctatggtcactagtcataagagaaaatgacttcaaagttggaatatgttttggattgtcaataggtgcttcaattggactctcagctgagccaccaaccttacaacttttgagcggctaacataatattcctttctccaaataagcaagaataaaaaccagagttcaaatacaattagaaaagattaacatttacttgctcggttttacgattccaaaaagaaaaaaaattctactatgttttctcgcatggttattacgacaacgtctaccacatcatgcatgcttttttttcattaacggtttgggtgggacaaatatactccttccgtcctcaaatataagagattttgatattttccttgtactgtttcaccattcgtcttatttaaaattttttaaaattattatttattttatttgtgacttactttattatccaaaatacttaaaccacaacttttcgttttatatttgtacaatttttttagaataagatgagtggtcaaacgttataagaaaatagtgaatattccttatattaggggacggagctagtagcatatattcgattaaggattttaagcagtgacagtgattatagaccaatccctttggaattatgataatagaaattgaattgaaaagggaaaaggtgaaggaaaagaggtgtgggtttagccgtttattgaaaggtgagatgggggtaggtaagctaatataagctctccactcctacaccaacacaacacaaactccgatcttgtttctctctctctctctcccttgtttcagtggctcagaaattttcctcttttcttattattgctttcctttatttaaggaaggagttgggctctctctctttctctgagtctgaatccccacgagacgagaaacctagcaaaaatctcgtctttcgccgcgctctccctcctctgattcctgctgttcttgatcttggatctcaattcccaaccaagaacacacagacagagaaaggaaggagaagaaga

SEQ ID NO: 32975 - DNA, 1501 bp, Oryza sativa
caaagagctttccaaatgcattctcacctcactaggtaccaatagctgtctagtgcaagatgataacttgacaaaacatgatggtttcaaaacacagttcagccataaacgagtcagcaggcaaatggtatctagtaaaatgtttttacaagctcactgctcaccacaggcacagcaaccatgctaagttgctaacaagtaacacagagctggtttgtcaaaaatccacaggaaataagaagatgccagaagcacttcgatacaacataaagtcactgcacttagcaacatttaaaaccttttgcggtttagctctgcaaggtattttgtaacattgctttgacttccattaacatagtggtcataggaagagtaatctctacatttgcaggtaaaagtcgagacagtaacattacgatttccttgatagtgtaagcatacacaaaaaaaaattactctagcaatgatcgacatccaaaagcacccaaatttcatagttcagactctcatgcctaccaccagtgcacttttattatccgaacaatgaaactaaccatccttcctagagagtttcaccgcatcaagatcgtagctactgacccgacagacaccccgagagcgcacgagatggcgaccacccgcgttcggagcagcatgaggttcacattcttcgtggcctggaggcacagcgtgagcacctgcagccgcccgttggcctccatcttctggaagaaggcgatgggcttgatggcgcggcgcagcaccagggcggccgtgaaggggaacgcgaacgccaccaccccctgcacggccgcggccgaccccacgccgacgggcgccgcgcccgatgcgatccacgcgcccgcggcgaggtgcgccccgccgaggagcgcgagggagccgctgatccgctgcacggcggcgcggagcgcgtcgagctccctccgcgtctcgtccgcgagcggcgaggtgtcgcgctccaccgtgggcccctcgatctcctggtgcttcatcgactccggggacaccggagcggggccgccgccgccatcgggttgcgagggagcggagaagtggcggtgcgggtggaggaagaggaggggatgcggcttagggagaagcctggccgtctcggcggcggggctcaggaggcggcgggagaggtgggagatcgccatgggagagcaactctgctgcggagtgtgcggcggcgcaagagaagtcgtctcctcctccggtcaagccgaaggcgtaatcctataatccgctttccacataatgtcacggtctccaatctttccgttttccaggaccggaagcgggttaacataggatcctgcggctggacacgtggcggagcaagggaaaaacgctagggagacgggggacggagcacatgccggccacaccgttcagcggctgccgcctggttcggatttgccttcctttccaaaccagagagcggtttacagaaaaccgcctttctcttcttccgtcttct

SEQ ID NO: 32976 - DNA, 1501 bp, Oryza sativa
tgtaaacaacgtccatacttggacgctgttggaaccagcgtccacctccctggtgcagccaagccacgaatagagtgagaacaatcaaaagaaaaccctgacaatcaaaagaaaaccctaactctagcgatgagcgctcgatcgcgcatgccggcaaccggccacgcatcgtcgtaactcatatacgagttcaccctctctacgactttgatccatccgcttcgtcgtccaagccactctcgtcgtcgacgccggggccttcgatttgtccgtgttttacggcgccaccaatcctgcaatccagccacggcgccgtgtgcattggcagctctctcgtcgtgagcaataggtttgccctgcaatttatatcatgcatgcatgtcttttcacttatagcatgtctctgctcaccctcatctaattagcattaattgatatgtactacattgttcatacctatacttgatatatgacattagtgttttattgaatatatgtatagattattatccaactagtagacatataccatgcctttgttaattgttgagttcgtttggaagacacaaccaggaaataaaatgactattgttcattgacatttttaataagcaaaacaacattttttaaaacttgaaaggatatatcagcagattattatctaacttaaagttaattatataacttgttttgctaacttgtttagtttgttttgcagagttgactgagaaaaaatgattattgttctagtatatgttgatgggagaatacaatatggagctaagggtgcagaatataatattcctccaaaaataacttttccggcagtggaggctacgacctttgaggaagtcaaaaaagaaatttttcaggcccttggatacattgaggatcattgtgcaatgaatatccaagctcggtttgatatcggaaatcctgggccacaatattttcaattgattcctatttatgaagacaggggatggaggatgatatttgagaagacatgtgggcaggttgttgagctttatgttgaatgcgcctatacggaagcaagattaagtcaggttaatagtacaaccttggttgcatcaactaggcattcggaaaggaatggctcaggtgtttctttggagccaggtacagttcattcacaagcaaaggttgtacccactttagcagatggtatgcattcaacagttcagttgtcttcacctatcaaccaggataatgtggtttccgaaacacaaccaactatagatgatgacaatactgcagaagacacatatgttggtgaggagacatatgttggtgaggatagatttggactagacgatgacaacaagcaggattgtgatggtgcccttaataatagttcagatgatgagcccccataaccacgagttgttcattctgtcaatgcatttccttttatgcgtgcatctggacaaaatcctataaaagcatttaatgatatatctgtgttgaaggagacaacagc

SEQ ID NO: 32977 - DNA, 1501 bp, Oryza sativa
tcaacatcttcccgacatagttttgtatggaataatgaggcgatgggccactgctagttcagaattactagctttcatttgttcctcttcagcatttttctttactctggtacaggcataagccctctcacaagacaccattcttcctcttggcttcattgttactgtgttgttgctcatcagttatcaccatatttgactgtattatgtgttgtttgaactgtgatatgagatctaaactgttttccagtattgtttttcttctgtattccagtgttgtttggtagttccatgattgtttgtcattaaatctatgaagaattaattattttgttgtttataaacaaaaagaatccagtgaaaattgctggtgtttgttttgtttgaaagttttaatgtatatagttttcagcacaacctgtttcaatactcctgaagtcctgagaaccgaaacatattctgcagaaatgctgatgaaaaacagtgaagtttatgaatgctgatatttttgtactcccccaatggcatcagctactagcctacgagcagcctctgctgcaaattcttgtagacctcagtgcatcggcctctgttgcaaaataacacctacgagaattggtgctgcagctgcatgtatatctgtgttggactgttggttgggtccagctctctaagcgtcacaattctgaatttcggatggttgtgttgcacaggagttgctgcgtttactgaattgctcttacgccctagaacttcaaggtgaaaagttttggcgtgtcacatcggatatacggatacacatttgaagtattaaacttggccttgaaactctagatgtgaaaagttttgttacacacatttgaagtattagacgtagtctaataacaaaataaattacaaaatccgtctgtaaaccgcgagacgaatttattaagcctaattaatccgttattaccaaatgtttactatagcacgacattatcgaatcatggcgcaattaggcttaaaagatccgtctcgcaatttgcacgcaatttatgtaattagtttttttatctatatttaatactccatacatatgtccaaacattcaatatgacagggtaaaaagtttttgtgtgggaactaacatggcctcagtcgtgttctctgcaaaatgaacagttacttgtgttctctccaatctgaacaccaatccaagcaaagctcgtctcaactcgagccttcacaaaatcagaaacaagctgcaaagttcgaaatataagaataaaatggaaaaagggaaatcaccatctaaacgggcttcttctagttaaatgggccgtttttattctggtacagttaggcccagtacgcgagcggagccctaactccgcgccgctataaaagcgtgaccccgtcgcgtgcgactagggtttatctcctctcgccgcagcctccctcggagccagacaaaggagagaagcgcgaaggcggcggcggcggcggcgcaaggcgaaga

SEQ ID NO: 32978 - DNA, 1501 bp, Oryza sativa
cgacctctgccgcctccatgcggcctccggccccgcacggcctccggccccgcacggcctccgcctccgttccatgggtcatcgtcgaggccgtcattgccaaggtcgccgttgcgagccgccgccgtcagcctctgcatgatcgtcgtcgcgcacttgcacgggaagagggccgtgagaagaggaagagggagaaaaagaggaggaagaaggggtagtagaagctgacgtgtgggtcccagtgtcataggctcgtaatggagagtattgatggagagcctattggagtgaggaatgagtttgggttaccaaatcaattggaaagctgactatataagtgtttggagagtccgatttggagaggctattggagatgctgttacatggagcaaatcttgctaatcaaacaaatccaatatatccatggttgcatctttggcgaccacaaggcctgctagtttcttcttgtgctggaatcttgatctatgttcaaaaaggttttcttgctagtgaggctagctagctttgcttagtcaaaatgtacgacaagcatgcaatcatcaatttctaacgctggtcttatgtgctaattaactttgctcgtttgctactctacttcgattctacttaagttgtagctaggcagaaggactttggtccatattttctcttttttttgtagagtttgaatatttttgtatttagttgtaaatgtttatcttatatattttttagtatatgttagaacaatttattagttgaccctttttatctaaaatatagaagtgagtgtgtttaaatagagaagagtataaatttcacaaaaatacatatactttgatgaaactatcacaaaactacatattttaaaaaggtgtatcacaaaactgtagatttaggatgaaagatcactgactatacatttaataatacaattatcacaaaactacaaatttagcttcatgtttagtactaaactacaacatttgtaaccgtaacatagcagtagtggtaaggattattaaactatagaatctgtagttttatttttatgataactctggtattaaatctaatattcgattttaaatatgcagttttgtgatagattttatattaaatatatagttttgttttgtaacactttcaatatgtagttttgtgataatttagttaaactacccgtagttttgtgaaatttactcaatagagaataaggggaatgataataagaatggttagattttcacttaatgttgagaaaaactgaccaaaattcatctaaaaattggacaatcccattaagtaaacctattcgatttttcacacccagttcatgctctcaaaaactcccatttcatgggtgataactgataagtaaagtacctttttttttcttttcttctttgataatcaagcaggtgtactcaataagaacaggttttgcacgacacacattgatcagctcacctcttcatcctcctgcacgcgagaatggcca

SEQ ID NO: 32979 - DNA, 1501 bp, Oryza sativa
cttgatccttcttaaattaattgtgaaatttttgtcagatgctggaggacgctgttcactttctcagtaaggatacagttgtacaagcaatgtcacgttctgctaacaaagtaagtttgctgtatatttgtattattcagatattcaacatatccctgcgtaacataggtaaatgctgttcttgcttgcatacttttctgttaaacctgcctcagtaagcctaccacttagcatctagcgctgagatcagaactatgttttcttaatctagtgcatcaagttcaatcatgtatgttcccactccttgtcagccttgacacttacataagtgctgctggtgttatctactccaatatccaggaccagtacttatcaatgagattattatgactctgatttttattatttctgtattgttaatagtatgctttgtgtgcaatcagacgagaaatgctatttctgggacttactcggcgcctcagagatccgcaagttctgctgctcttttggttggagatcctgctattacgttggacagggctgggaattttgtgcttcctagggctgatgtcatgaagctgagagatcgtttaagaaatgaagaaattacggcaggatcgttcttttgtggagtgaagaattgtttaatgattggatcccctgtagatgtagattatcggaggaatatgtgtgcccatgcacgtattttggctttggaagaagcaattgatactgaatgggtttacatgtgggacaagtttggtggttatttacttcttctgcttggcttgactgccaaagctgagcaaatacaggtatgcatttgggactactcccacctaatcttttttgttcttaaaatctgtaacaatgttggaaatgtctgttgtttcaggatgaagttcgtcttagactttttctggacagcataggtctttctgacttaagtgccaaagaaatcaagaaatggatgcctgaagatcgaagacattttgaacttattcaagaaaggttattgttaaaacttttatgtatgcaatgtttctatctgcaaccctgtaaacctctgtgcccgccatctaaattctcttattcgcttattcagctacataagggaaaaagaaatggaagaggaggtcttgatgcaaaggcgcgaggaagaagggaagggaagggaaaggaggaaggcattgttggagagagaggaacgaaaatggaaggagcttgaaatatcactgctatcttctattcctaatgctggaagcagggatgctgcagccatggcagcagctgtcagagctgtgggtggtgattctgctctggaagattcttttgcaagggacagggtctcgtcaatagctcgtcacataagaaaggcacaattggctcggcgagcagagcaggttctgttactgttcctgtaatcattagattttatcaacttctaaagcacaccttaatgatgatatagttctcatggtgtaccttttgagtgcatgaa

SEQ ID NO: 32980 - DNA, 897 bp, Oryza sativa
accaagtttctgatgaacatagaaggaatcaactacagatgacaagagatgctccaattgtgcactagataaagagtaacataattttctctacaattttttggggttgggatgcatgatattcgcaggcctcagatccacattaacaaggtgttaggatccaacaattgacaagcactctaccaagcaatgcaaaagtacctttgccacagctgcaagacattttattggcaactaacagagaaggactacatgcaaatggcttgtctagctcaggatgcaacattccatggtcaacccaacccacaaaaaaaagaaggttgatgcatgcacaccacaattgaagtcagcttgccatctaaacaggtgttacaacaagttagcaacaactagagttgataaaagagaggaaatcaaggtttaaataacttctaaaattggaacaatatggcgcaaaacagtactatctattaacttattataagcaaaaacttgtcagatggaacatgctccagttaacactcagatccataccaaccaacatgcagtgcaccaagactactcagagtcatggttgctgacatatcagcgagtaaaaaaattgaatgaaactatggtttgtaaccttgtaaattttggcccagttttatgttatggaaagtgcatgcacaaattttcagttgcaaggaaaaagtattagcatgtgcctcaattattagaacaattttctaaataaaattttagctcctaaggtctactagacttacaagcaaataaattctttccattaacacgttgtgttgtacactgtaccatattatttcaaagtcaagtatgtctcacgtaagactaatgattcattcaacctaattgatttattgtacaagaattccagca

SEQ ID NO: 32981 - DNA, 175 bp, Oryza sativa
gcgggggtggatggatccgcgcaccggtggtatacctctcccacggccacctcctcccgaccaagctccgcggcatcttctttcttctctcttcttcacaagcttgagagggaggggggaggtggctggcgggagtgtgtgagcgctaggcagcggtgggtggagcaagcggcga

SEQ ID NO: 32982 - DNA, 1229 bp, Oryza sativa
aaactatcttatacttgaagtccctcagtgtgtaaacctcatggtttccttgttgcattgggactaactcttgtcgacctttacctcatatattccaacttcatctccatacgagattacattcatatgtccagccttatttcctcgcttcactaatagcttatcaaccctttgagaccattgcttgccattgttaagtaaattaacaacatttcgccttctctcaacaaaccattctaagcactttgaaaatgtttcctccacaatggctgccaccggtaacctccgagaaaacttaaacacattgttcaatgactcagatccattgcttgtcatcattccccaacaatatcctccatccttgcattgaaataccttctcgggcttttcttgctcatctttatcttcctgcaagtgctttccaacctttttaacatatgttattgcctcaggacaaatatttgcaattgatgacattccttcatcaaattttctaggtttctttttcttcactgtccacttaaatgtcttgagcactatttcattgcgacaaaatttccatagattctcagctacatgctgtgagcaaaggcggtgcacacattcaccggcgctctcattccatccaatgtggggctgcttaaacaaccattttatggctttatgtcgatcagatataacacacagaaacttaactttccatagcctattacctcacttcgtagccatctcataaaccacccccagtttgcactatcttccttttccacaatagcaaatgcaagaggtagtagttgattgttagcatcatatccacaagcaatcaacaatctacccttgtacctccctaacaaaaagcatgcatcaacacttataactggccgtaggtagggaatggcatcgatacaaggtccaaatgcccaagcaacacttttaaatgctcgccgtccttcctgagtcgttggctttgacaaaaggacatactttgtacctgggtttttagcttttatagcttgtaagaaagggatgaggaggccatatgaaccttcccaactaccaaaaagttgtgctattgccttatctctgcctcgccataatttactataagatggcttcacatttctatatctctgttggactagtgacctcacattttttatactcaattccagatcatcccttaatgcatcacgtatcacattagcaatcatagaagatgataactgagc

SEQ ID NO: 32983 - DNA, 1501 bp, Oryza sativa
agaaaagaaaatagcactaatgtaatgggccgttatggtaactagaaaggagacatacttcttgtagtaaggtgcttctctatcaagtcgagcaagtgttcccgccaaaattgacacctgcattcggtgaatgaaaatcagaaaccgttgcagtatgaaacacaatctatcggataatttttgaagttattatgctgatgtgtacccatggaatgtaaaggattaagtgattaacctccacatctaggtccagaaaatgtatatacatattaatgcatcactatctagtgttagtacaaatcattgtcccgtcaaagcatgtcacataggacacaacagaatctgaattaccacacttaaataggaagtaaaataatttgttccagtgcctctttccagcctaatatgtgaaatgttttgatctataccattgattggcacatatctacagtttctgagccaactagttgaagagatgtctcctgaatcaacaaatattgattaaaggcccgtaataggatgttgtatgcattgtctttttccctatatgctaaaatcttataagcactacagaccacacaatattacaggaaagaggagacagttcacttgctgaaatgccaaactgtaccatttgattatatagttttcagtgaactacatgtgtggaacatagaggtttcaatgaattgtatcattttagcctttattagatgcaagaagagacagttcgcttgctgttgctgaaatgccaaactgcatcatgtgataatagagcccacaatgaactgtacgatgtacagaacatttgctttgtgagctctacattgtgcttctcaacaatgggtgtgtttagttcgcgctaaaattgaaagtttggttgaaattggaacgatgcgacggaaaagttggaagtttatgtgtgtaggaaagttttgatgtgatggaaaagttggaagtttgaagaaaaagtttggaactaaacaaggccaatataagaaactaaagcctaaagcctaacaattaaaaatgattgtcccatagtccataagagaatttctggagatgtaaatcctagcaagtttcttgtgctacattgctcattatatgatagttcacaatatcaactaggaaagaggttaatctagtttttacgtaaccttttcgccgctgtcattgccgacaacccggatttccagaccaacagatgctgcttcaggtgctagcgggatctcatcatacttaaggaacttgatagcacctggatcatagcgaaaaaaaccaaaatcatgtacctgtttcgagaagagggggaaaaattttggattaacattatgccattagcacagggagaacaaaatagaatagaacagaaatgaaatgaaatgaaatgaaagcaaacacttacaggatctctgtacaggggatacacggggatctcctccctgttcacgaacatcgcctccgcgacgacaggccctgcgaacacagcgacagcagc

SEQ ID NO: 32984 - DNA, 1501 bp, Oryza sativa
ggtgcaagagcttcgtctctcttttttaggcccttcagtctccaaaaagttcgtgagatttttacccttcttagatcttctggtgttcgcgtgttcattatcgttgcttttttggctgctgtttcagtcgtgatcggtggttttcttggaggaggctgcatccgagtcttctcggaattaactcggtgattttttgttcttcccaccatctgttcctggatgcatctctttctttttttcttttttttttacggtgctacacagatgcgcaatggcaacacgagggtggctgcttcgtctcgatctctcgcttgtttccatttgaaactattttctgttccggaatgttcgagatcgccatttcttcatgtgggtttagggttttagaacgtgtaggcttgtaacatcctttcctatcgttgggcttctgctgcgattgctggtcttgttgggcgagcggaaactggatgtctctgcccgtgctttttacctgttatttggtttaattttctgctttttatatgccaaatcttcattaggattcccttcttgctgaccgagttattttttttcctgcaagatcgacgcgttctgtttattaagcgtattaacacttttccattttgttgccagtttccgggggttgtgcactactgcagtgttacattgttcggcagttcgtttttggtaaacatctatccatccttagaccatagtagaactgaaatttgggaccgcagagttttctccccctcgtttattcttgttcttgaatgctagattcgagaatctatgattatacttccttttaatcaattccctaaattagtcgttaccatatgttttgattatacttcctcgagtgaatttcttcattcttcagattgtctggtttattcttgcaagatgattgtaatcttgtctactttttgtatgatgcagttgtgtttgttttcacttccctctgttggaatgcactgataaaatttactattatgctgtgctaaatttctatgtattttttactgtatcatcatagttcaccttaggtctaactttcatgctagatcttgggttcaaaatgatggcatttgtgtatcttgaagattataaatgcaagatataaaaagaagaaaaaaaaatcctggaatgcatccgtgggacctgtgtctaccaaaaaattgctttgtatggactgctttagagtcatgagtcatctttgcttgctcgctcatcaacaatatgtgtccaaaatattggagttatgctttgagctttgcaaacagtggcataccgcgtatctattttttgtttctgcaaaatgcagttcaaattcaagctagttaacctttctattcattctgccccaataattcctattcgtattttcaccgttacttctagtatttaggtgatctgtaacctgatcttagtatggaatttaaggatattttattcctattattatgtttcagcgaagcagactccgctatggctcaac

SEQ ID NO: 32985 - DNA, 1501 bp, Oryza sativa; identical to SEQ ID NO: 24609

SEQ ID NO: 32986 - DNA, 1501 bp, Oryza sativa
gcgggcgaagagagggcggtcggcgacgatgatgatgagcttcgtcggcgacggctggagggagagaggggagcgggaggagggcgaccggcgctgacctcgccggcgagccgccgccgtcgctgcccgaggccagatccggcaagcccaggccggatctggccacctcgccgccactccgacgacgacgaccctgcggtgttctaccttcgcggccggtcggcgcggctcaacttccccgaggagatctccttgctggcttcgccgtcagagggtggcggcgcaggcgagccccgcgagcccgacggcggcacgctgtccgcggcctcgatccggaagaaggccatcgaggtcggctcccatgtcgacgcgctccagaccggcatgatggtcgcgccgacccaccaccgcgagcagcagaagcaccaccaccacccgcacctgcaaccgcacggcgaggagcaacaccaccacgaggattggattagttctaagtatgaagacattcatacttaaaaatctcttgttgatctcttcctctcgcccctgtcttggttggattagttgccatattagagtaagcactaatccatccatacttcttgctcgatcttgatttcgcgtggttaagtaagtcgtattagcctttcaggttaaggaggttgttaaggtttttaagtaagaacctcctgtagcttacttactagtttgtgatgcttgctgtattttcttctagttcttggcttggtcttaaggagtttttgtttgattgtataagctgttttcttagataatggatcgtataagttgttggatggatcagcaagtattaggcctggtccttccttccttgtgtactactattactcccatgtagtactatgtttggttcagttaagcatttttgtgtgtaaactgtgtttgaactctgctttttgatgatgtggaattggaatttgggggagacactgagcgagagagagaacggtcgtcgccgacgccgtgtggtgtgattggtgtcgaattgaaacggcaacgaacgaacccacaggtacggttgggctcgtctcgatcggaattgactagagggttccagggtatttcgggaatttgccacctggggctactgtggactaggacacccactgtggcctgagtacccccacccggttgctttggattttgaagccactgctcagggagataatacatcgtgaggttgttctctatagccactctatgagtgccctcagccactgctcagggggataatacatcgtgaggttgtactctatagccactctatgagtgccctcctcggttaatgaggacactcttctagtagtggctcacattgctgatgcccttagcagtgtgcttctcttctagtagcttgtctggtgagcacttggaacgcaagcaaacatacagtaggctgctactattctgcattgaatactgttgtgctgaatctggaaatgacaaagctgaggtactctct

SEQ ID NO: 32987 - DNA, 578 bp, Oryza sativa
acagaaagaaacaaaaatccaattcaagaacaccatgactgaagcagaaaaactattcatttattcattcattcaagaatggttcgaatagctgcactggaaccaaacaaagtagcattaaggttgtgtttagatccaaagtgtggatccaaacttcattccttttctatcacatcaacctgtcatacacacacaatttttcagtcacatcatctctgatttcaatcaaaatccaaactttgcgccgaactaaaaaaaaacacagcataaaggctgcaaatctacactactacagttcacaagcaggggcaaggtctctctgctcgtgaacttgttgtttagtggcatttcaaatacagtatctgacttgttgttgttgctatgtccaaaaccttaatcttgtctgatgctcactgaacagaagaggctttgggggcctcgtcagtgtccccagagaaattctcagaaaaattaaaaatgagagagaaagaaggaatcacgatgacaaggacatcacgtgactgaccacgccctgacaaaacccaattaaccaatcgagctactccactccaacaaca

SEQ ID NO: 32988 - DNA, 1501 bp, Oryza sativa
atccacagacggagccgaggccgcggacgaggaggacgagcggcgagtgcggcggagtgggaagagaagcggagctggcgccggacggggaggacaagcggcgggtacggcggtgcgatgagaggagccggaggggatggaatggataggatcgaatgggcggagtgggaggggaagggtaggtggaggaaattatttcttccactcgcccatgctaaccgcacccaggtcacgcgcactgtaggagtagttgccttgtatagcgtctccatccaattaaggccctgtttgtttcagcttttgattcttataatttagattattaagccagattactataagttggattataataagctggcatagaataagttgtgagttgtttgtttgtctggattattgaaggcatagattattgggtctgaaaggctaaagtctataatgccctcagctatctgttcagttaatgatataggtgggtaatttttctcaagtatgtagaggtagtgggtctttagccactcaataatctgaaaaaagctcctctagagcagcttatcagattataataatctgacttatagattataataatctgctataataatctacttgtttgtttaagcttactcctaataagttagattataataatcctaaactgaatcaaacagggcttaagccacacatatatgggtgcttacactctggggtgagtgtttttgggccaactttttaggctaagggtacgggacccatagcttgcaatgtgagaggcctcagtgaacttgattattccaagtctgcgggacagaccatctctgatagcttccttgttagctctgtccacaaggagcacactgcacacgtctcttgaaggtttcgaagcgctgaaccatctcggcatggtcacgctcctggttgaaagccttgcaccactgcttatacaaggcccacagggcatcatctgaaacaaggtccttctcttctgccacaaagatcaccctaccttcgccgtcgacgtggcaggaaacgcccctaggctaaacgcataggcctaggcaaaattaggcccaaaatccctacagaatgtagactgatcatccggcccattataccaaacgtagccataatccacatggatcatacagaaactacgatccgttttggcccaacacgtttagattagcctgaaattttcatcagaggcctaatccgaaggagatccgacgaaaatatccccccctccggttcgcgtgacctcggttggtggtctccccttctaaaatctcgccgagtccacaagcgcatttaccagcagctccactcccatccatccccgcgaccctcgctgatctcaccaccaccccgacccacccgcaccgccccaccatcacatcgcccgcgtgagattgctacccaaaaatcctcacctccgacgacgaattgaggaggaggggagagagagctcaaaaaccctaggaggaggtttgaggggcca

SEQ ID NO: 32989 - DNA, 1501 bp, Oryza sativa
aaccctaaacagtactactacacaaacagcgaaaaggcgtttccgaaatcggttagacgccccatctccccccaattggagattctcacaggtggaccatccaaccgcgtgagaaaaaaaataattattctaaacggatctcttaactcagccgattgtgatactacatatattttcgcaggccactgagttaaacagctcacctggacagaaggtggctaagataaagatttcttgcctatttcaaattaaaatttgaaaatatatctcaaattaaaatttttcagtttttgagtggcattattatgtagtatagtacgataactaggggtagtgtgtaacatataaaaatatatactccctccattaataaatgtttgacgccgttaacttttttaaacatgtttgaccgttcgtcttatttaaaacatttaagtaattattatttcttttcctaccatttgattcattgttaaatatacttttatgtatatatatagttttacatatttcataaaaaaatttgaataagatgaacggtcaagcatatttaaaaaagtcaactgcgtcgaacatttaggaaggagggagtatttgtgtcaacaaatatattggatatgtgtgagttaagacatattaacatatgtttctaaattcgattacaaatgagccatctcggatcgcataacaatagtctcataacatatattatttttttgagtaaatttcacgaagctatggatatattgaccaaactataaaaatgtacatagatttaacacaagatttattgtaatggttagtgataatttggtcaaagtttgaggttagtgataatttggtctaataacaaaataaattacagattccgctagaaaaccaccagatgaatttattaagtctaattaatccgtcattagcgaatgtttattgtagcactatattatcaaattatagcgcagttaggcttaaaagattcgtttcgcaattttctaacgaattttgtaattggttcttttttttgtctatatttaatattatatacatgtgtctaaacatttgatgcgacagcgtgaaaaatttgtttggtaactaaagatgcccttatttcgtcttccggaccttttggcactcagccaacggaaggccctcacgccatctcgcctgatcgcgcccagatctttttcaccgagccggcgcttgcgttttgattggcaagcaacgcgagacctcgagacgctcgtgatcgagctcgtccgcgtcgcctttcccttcccctccgctgctctgctccgcgcgcgcggtgcaccgtgcacgcctctgcagcacgcattactaacgtgcggactcaagggccagaggcagcggcgctgcagcgcatgggcgcgcgaggcgtaaacccccacacccccatcgtcatgtgggcatgggcatggggaccctgcctgcccgtgttgaccttggaggtgcggtagccggtaggtccacaccaccaggccac

SEQ ID NO: 32990 - DNA, 1501 bp, Oryza sativa
gaattttgctgtttatatggggatgagattgaagatcaaacctccatggccatcataaacaccaaagaatgacgtgttagtgagagcatcaagattttcaatagtcgcatgctggagaatagaagagtacacaaattagcctttagaatttcaccaaaattagttgcaagccaaccccccatttctcctacaaaagactggaaggttactcacggcatcttccatggtgctacggtatccttgcatagctgatgaagcataagcaagtacagtgttccctccagaatgagtagactttgttatgtcaggaacttggaggggacgttgaggttgagccatagcggagtctgcttcgctgaaacataataataggaataaaatatccttaaattccatactaagatcaggttacagatcacctaaatactagaagtaacggtgaaaatacgaataggaattattggggcagaatgaatagaaaggttaactagcttgaatttgaactgcattttgcagaaacaaaaaatagatacgcggtatgccactgtttgcaaagctcaaagcataactccaatattttggacacatattgttgatgagcgagcaagcaaagatgactcatgactctaaagcagtccatacaaagcaattttttggtagacacaggtcccacggatgcattccaggatttttttttcttctttttatatcttgcatttataatcttcaagatacacaaatgccatcattttgaacccaagatctagcatgaaagttagacctaaggtgaactatgatgatacagtaaaaaatacatagaaatttagcacagcataatagtaaattttatcagtgcattccaacagagggaagtgaaaacaaacacaactgcatcatacaaaaagtagacaagattacaatcatcttgcaagaataaaccagacaatctgaagaatgaagaaattcactcgaggaagtataatcaaaacatatggtaacgactaatttagggaattgattaaaaggaagtataatcatagattctcgaatctagcattcaagaacaagaataaacgagggggagaaaactctgcggtcccaaatttcagttctactatggtctaaggatggatagatgtttaccaaaaacgaactgccgaacaatgtaacactgcagtagtgcacaacccccggaaactggcaacaaaatggaaaagtgttaatacgcttaataaacagaacgcgtcgatcttgcaggaaaaaaaataactcggtcagcaagaagggaatcctaatgaagatttggcatataaaaagcagaaaattaaaccaaataacaggtaaaaagcacgggcagagacatccagtttccgctcgcccaacaagaccagcaatcgcagcagaagcccaacgataggaaaggatgttacaagcctacacgttctaaaaccctaaacccacatgaagaaatggcgatctcgaacattccggaacagaaaat

SEQ ID NO: 32991 - DNA, 1501 bp, Oryza sativa
tggggcagggtgataaaatcttgcccggacactgaacttctgcgtgattgcttgtcgggggttcatggatggatagatggttacagtgtagccccttgaacagaccgagagatccaacctaagattccgctttgttcctaaaggcaagcgaagcgtttagctcgtgtggatgtggggctagcaatgtttcacgagttttgagggcaatttcagtttcttgatattgttgatctttctttgcatgtttgaacttagaagaaaaaaaatcatttgacgcaacatatttccccacagtttgtgttcttttcctctcttttttttttaaaaaaaaatgcaccgaagacacactaacacctaccatatgcagcggatctagtgactgcggtgtgtttggatgtggttgcggcatgtctacatttggagaaggtggtcaagtagttttttacctagggatatgaatgacgatctagtcgtaaggattggtggctcttaatactccgaccttttgaaggagggggccaaggagttgttcatgggtgacgatttagtctttgaattgatggccctcaatagcactcgactatttagttacattttaattctcaattaatagaaaaaacccttgaatcgacaccattcatccatctatctctggatccgggctcgcctccactcattcctcgttctagactgttgcctttgcaggggctggtctttttctaagaaatctctagccaaccttcccacaagaagttttttcttaacaccaatgaattttattaatgctagaggaaaatgatagctccaagaatttctttattctcaacgctctatgtcattttttttctttttgagtgtggttttatatgctcggctttgtgcattttagtaatgcaaaggctgaaagtgttctaaaaaaattatatcaccttaatcttaatgtaattgactgagttcaaaaaaaacttacattatctttaagaaaaaaacaggttgtctctaacacatccttaaaaagattctatagtgggtgcagtcccacatccacgatttcattatcgcgttattagtgttgacctctagcctatgttactttgtgtgttttgttgggtcttttatttattcatatcaaacatagggtggtcttatagagcaaagcacaaattataaagattagtgcaatgaaactgcatgtgatcccaattcgtgcaatgatgcaaaggaaacgaatttagaattccaacgtgtggatgtggtgtttcccaacagagtgattatcacgcgagaggaagacacgtacgaaaacaatatcatcacggttttatgcaggctaagctacacagagccacataaaattaatggccgttaatatcacaaattcacaaggtcgctttgtgttcattcagctcgcaggtttgctggattatagttgagcagagaactggaggatatgtgaaacaaacgaattacgtgctcaacatcacttcagtccaaacagcct

SEQ ID NO: 32992 - DNA, 1501 bp, Oryza sativa
agagaaatcctaacatatccaaggtaaggtagtccttctctcacttgaaaatagaaaacactatttcttcgcacaaaaccaactatcctttgctactatatttcttttactccaagcaaccataccttccccgagactagctttcttttactccgagaaacaataccgtcctcgataaggtagtctccctttcttaattaataggatgcgtcacatattatacttagttctttatgaacgaagcaagcatatattaataaaatgataggattaatggtgaataggtaagaggcaagggattggtaaagagcactaaagtaatagaaaaatacaaaccagtggtaaaaaggaaaataagaataaagttattttcagacatactccctccatcccaaaattactcaggctttgtttagttcctgaaaaaagttgaaagtttggggaaagttgaacgtttggaaaaaaaaaagttgaaagtttatgtgtgtaagaaagttttggatgtgatgtaaagttgaaagtttggggtagttgagggtgaactaaacacgacctcaatctagatgggtatgcgacctcttctaatataatctctcctaatatagagctggcttggtttgaggcctaaattggccttaccaatatttgtcaatttcaatagtgtttattgtctatttggtttggagccaaattttggcatgcctaagaaaataggccatttcaacagttaatttaggctattttggtttcaatccaaacacaattttacctttgccaaaattagccatgccaaaagttgacaaaatttgacattgataaaaattggtaaggccaatttagaccacaaaccaaaccagcccatagtaacaactcttaacttgtattacaagaccactccttcccagctaaagcctgttcaaattgttgcaaaaataaaccttactaatttatggcaaattagtaatattgctaaaattttagcaaaatttcttatatatttaccaagtttagcacaaactaagatatttttttagcaactttaaaaaaataatatgatcgaaaataacgtcaatctgaaccgcccttaaaccggagtaacaaccacttattaatcaaccaccagtagaagtaaaaccgcggggcccacgtgtaggccgcagaacggaccaacagtcgcgggcccacaaaaccggcagcacaatccgggggatgccgagcgcccgcccggtactcttttgccttatcccttccactcccctgtggcccccatccccccaacccccacagcgccaccaaccttcttacccactccacccactgacaacgttggccacctttacccctaccccacatgtcagtgacagagtctgcggggcaggcgtaccagctcgggcctccggggcgacacgtggagctcccacgttgctccatctctcgctataaaccatttcttctccacctttccttccccttctcgagtccctctcctcccccctctctc

SEQ ID NO: 32993 - DNA, 1501 bp, Oryza sativa
ggcccgtaaagaggcaaaatgttcctgcataaagaaaccggatgaaaactgcgattcacttgtaagaaaaatcacatgtaggaagcagagtttctatcagcaactttaatactttatcaggaccttttgaataaatataaattgcaaaagaaatttgactagtgaccaacaagatcaagcggtgaaaaacaccaaattataataactatccacaactactggtgcaaagaatgcaatgtgagtacatgctttaccagtgcattactgtttcattaccgtactgatctacacaaaaatggatcaaccagcgagactacttgaaaaaaaacacctcagtcattctaaatagagaaatctctagtatagctgcttgttgacagccactatcattgcgccaacactgctttttattaaaaaaataaaaataaaaaataaaacctaccatttttgcccttttaattgccacaatgtggccatctcgcagctgtgctctgtagacctttccaaaataaccttcaccaatcatcaggtctggtgcaaagttatgtgtcagtttaataacttgttcaagactcaggttcaatggctcatttctacttggtgatgaagacaatgaaaatctagatggacttgcaggtactcgaagagggcttggaggaactctatcagacattgacctcagctcagaagaattcactggaaaaacaaggatgaaggaatgtgtcacaattcatgatggtcatttatacttccaaacgtgacatctacattgtttcattgtgttaacagattagatcaccaatagatgaaagcttgctatttaacttacaggaatttccatcccttccaagaacagggtcttcgctcccatccttccttcttgaaccaaaacaggggcacatggcttcaaaacacacaagaaacatccctgtaggtttagtggctaccagaatgctatctgatttcagtttgccaacaaagaagtgtggtgcgcctcatttggatgagatgtcttaaattagcatagtgtcctaagcccttttactctgacaagtgcaatccaaactgcaaaaagatcgaagcattcagtttagcattttggaaagaatgccactaaaagatatacgaggagcgataacatgagtcccgggtagtacattagtacaaaatgaatagcagaaatagacatatttgtcaccaaaatatgcaccgatcaatcaagaaaggagaactctcagcttctccacgtgtaatcagaagattcataatgagtggaacaacaatttaccatctagtagaagaataattcggttctagacatccatgctattttgcaatattagttacactttgtatgaatgaattatctcccaaaccataggtagacttccttttggcgtatgccttgcacaatgcattttaagtgccagtctttgacctctacatatttatagcgagtatcttgttgagcaactgagcaatgcatgcaacaagaatgcag

SEQ ID NO: 32994 - DNA, 1501 bp, Oryza sativa
aaaattctcagaaaccgcctataaactaggttggatatgtaacacatgctaatacaaggaatctggaaagacttcttgtctagattcgttgtaataggatatgtcacatccaactaaaatcccttatatttagggacggatagagtattttttaaaattttaagctcacaaacaatcctttctgaatgtaagcacctttctgacgtatatataccatataaactttccgtataaaccagaccgctgactaaaaaattgcaacgactccaatccgtgtgcagaccattgtattgatgtatactaggagaagctttttcagaaagtacagtagtaccaagtgcaaagcgagatgcttcttcgtgtgcacagcataacagcttttccgctgtggacgtagcaaaaaaaaaaaaaagaaagaaaaaccgcaaagtcaagtaaacttcatcaccacaacaaaaacgaggcccacccgcacccactcgcccccgacccgcattttattttctcctcgtctcctctcctctcctcctatcctccgccggacgcgcacgcacacgcacacctacgcatcgccgcctcctcctcttcctcccactccgcggaagcgcgtaaccaccacctcgttcgttcttatctccaaagccgaagacccaccgagccgatcccgacgcttcccccatggctcctccgctcctcccccgcggcgcggccctcctcctcctcctccgctccgccgcccgacggccggcggcggcgtcctcccgcggcttcctgtcgagcgctgcggcgggaggccgcgagggggcgctggccgccgccgcggtggcggtggtggggtccggcctgggtctgtggctggtgcccccctcgctcgcggactccggcgaggcggtggccgacgccccggcggtacagatctcggtaggctccggctccggcgcggtaggcgccgtggaggagcgaggccggaagaggaggttcctcctcggaggtgagcttcgcttttgcttcttatcccccctccgcgatttgcttcccgcttcacgattgatctcgcgattgttctcatggagtgcgtccgatcggtttgcgcgtcgccgccgccgccgccgttgtcccgtgatgcttgtttcctttacttctctactaagctttacggacgctttgtcatgttctctgatttctctcccgtaaacagtttgcgtccgtagcgtcgctgctacttttccgatcgtctttttagcactttaattgctgggatgagctggtggtgatctgcgatccgtacgacgatttctttgctgcgctgatctatctgcagataagcgataagtgacaaacatccgaagagaaaatccaaactagatgatgcggccgtttgtagtgttaggaaagtctttggcgctttctgcttctgtctgagtgcgttaatgcttctcactaccattatatttgcgcgttgaactcaactgctcagtgaagttgtagaatggtttaatga

SEQ ID NO: 32995 - DNA, 1501 bp, Oryza sativa
aaataataagcgacgatgagtcgatgatgaatggctgcatgtttgggtgcatcggcggagattgagcccccaaacaccccaaccaaaaaaacaggaccaaagtacccaaagaaaataaaatcaatgtggtaaatttttagttttacctacactatggtaaagaacaaatttatattatttgattatattagtttgaatcaaatgaagaaacgatttgattatattatttttattggtagtctgcttacatcggtaagtaatattaatcgtgactagctatattttttggtgcaacattttccaagaaaaaaaaatcaaaatgtataatgtgaatcacatatattacaatttcaaccatatatttttactataattttaaatcttagaacataatttttcgtgcttgtcatataggaactatgaaacaaataattatctatttgattaaaatattaatttagaataacatataagtaaaaagaaaaaatattttttataaaatgtatcaaatgttagaaaatgtatatgttatattcccaggtggccaagtatcctggtgtaattgtgcctaagaagaaagagaaaattgtcgtatggcatacctcgaggatattttcccgttgactcgacgtcaactccgactcctcgtggggtgtggatcccctagagttgatgctagaaccacctgatgtagttccagaaatatcaacctctatctgtttctaccagctgagaaattctaccaactgagattaatttctcctaattaactctcttaactagtgttgatttagtgagaaaaatattttccttttcaccaatgagataagcaacacatatccccgtgagatcggtttatccttattctacatattgaaaaaaaattgtctcgaacaacgctacttgaaattgatataataaaaacaagaagaaaatacatatgtttttttagattatattgtacttgcatgttacttttgggaaaagagtgttatttgttttagtgttggctggagcgtaattgctattatggaaggaaacaccttaaagaaaaggtagttttcctttaattctacactaatcaagttaactagatgaataccctgccgcgttgctgcggggaattaagttacataatatgtacaaataggattcaatataattattaaaactaaaacaaattgatacttatgaattttgagtctaaaaataattaagattgcatggtgttatgagagaagaaagaagagacaatttgaaccatagatctatcatcaaaaggctagaaataattgggacgatgtggcttaatgggagaagagagaaatagcattaactacatttagtggggatgaactatgtaagtataggattaggtgcgatgagtgccttaattgatctcattcgcacaagaagaatgactataaatttgccaaatcctcgtgtaagttgtcaaatgggccatgtattttcgtgttggcccgggcatgtatgtaacaat

SEQ ID NO: 32996 - DNA, 1501 bp, Oryza sativa
caaagccaggttgttttgagcatcgtcctattgcaggataaacatatcattttgaagatcataatagagtaagtatttatatcattggttatgttaacaacctacttcctcctcgctagatgtttcaccaattacatgctccaagggattctcggtctcaagattcctctgacctagaagtgcaagtgttctcttcacagaagtagggacctttggcttttcttccttaggtctggtgtgttgatgcaactgcgttgagataatatttagagacaagctaatcgttgtctaagaactccaaataacaaaatagcgcaactaaacactaaccaaaaatggtgtcccagcagaggaggcacttctatcctgtaaactgtcaagaagttcagaaattgaaacatttgctttcttggttgaacaagcaaactctgagggcaaatcttcagtttcctccttgatattttccaactgctcagccatcatggtttcaggagctctgtttgttggcattactgatgaaacttcttgctccccaatgtatgggttttcagtcttcacattcagtgaaacagaactggatccacgtattgagaatttgagcctgtgttcaccttttctccctgtatcaatgaagaaacgataaacaactcacagtgtaaaaaaacagaaattgttatgtacgaaagctcctaaaaccgaattcctcctttatccgtaaggcaaacaagaatatacatatctatgcagtagataaataggatttatggcaacgtacttttgcctgttccagcagataggaatgatatactaggaggaactttgtgcacataggctagctcatcggcttcttccagaacttcatcccagatggttgattcatctggcaccaccattttgttttccttctctctttcttttgaagcagcacaagctaatgacagtcttgttggtgcaagaacatcctgttaatatataaaggcacatgttcagcaagcactcatacgccactgctacaagtggaaatacactattagtagttaaaacaaacttttgttaatagatgccaaatacatttgttagaaaaaagaccaaaaataaaacaaacttcttgttgtacatcttataaagtggtctggtgccaagagaaaaaaaaagaaatttggaatctctctaatttcattgaagacataagtgcatgtcctgccaacctgaagtggtgttaatgaaatttgcgggcgaaaaaaaaaggtacagcagcataacatatcacatttcacatgctgtagcaacatcagcagatgcagcacctcatcagatattgcatcctcagcagaatcagacacatgatcagagtgttgctcggattgaggaccagcgcgctgatcatcacggaagctctccataccaacgctagaaccggtccatgggcgggtctaacatgggaaactttttgggaacaaacaaactgttatcagtatcaaggttaaggcaaatttccaga

SEQ ID NO: 32997 - DNA, 1501 bp, Oryza sativa
agaccaagtagaagaatagcataggaggtcaatatctagtctcagagtaacttatcccagaaacaagaaatactccaaatttggtcctttctttatgtggcacacaagtaaagcgattgcttggcttgcttgtagcaggaagatagaagcatcatctgagttacacagaataagatagcagctgtgcacgtgagctcaactggtctattagtatcagtacccagtggaggcttccttgagtggattttcctcaattgcttacaggataaattttaccaacacattttagtttactttcctgagttagcttataaaaataagctataaaatcgtttacaacatagtaagaattgttccaacaagatgcctttattcgttccctgatactacattgaaagttagaaactgctacaagggaatgtcaggattgcattccatagagtttgcaataattccatattgattttccttgtttagaattgagtcatttttttcgcgaacgtgtttagagctcagtcataattacgtgccaaacaagatcaagcacttcacctgcaatgcacaatcacgaaaagctccaagcaactcttcagtgagaatgttccactccaccagttcattaaatacctgctgactaagatctctaggcagcagcgagaaatcagaatacttcccaatatcctgaaatcacccctcatcaagtcaggcaacaatacacacagaaaactcaatcatccaaggccacaagcactacctcgcggactttggccacacagagctccattagcgatgggcaccgcacaggcactggtccctgcaccttcctgtgtacatcagagccgctgcggggcaaggtgtgcagtagccacttgaagctgctgctcttggagaaccttgcactgtagagatcttcctcatcaacaagcagctggcctcttttcctagagcaagcactttccatggcgacgatgcgagcaccgatcacaaaccaatcacttttcttgatggactaaaaagcgcatatcattctagctcgtgactgtgtgattctttgtcatccattcccagcacgattacgacttggcatagacttcgctctctttggccccattctgcacatcaaacaatcgtgtaaattgacttaaaattatcagattatatacagatactgccaaacaatactaaaccccacgagtcctcagtttttggtgggtgtgttcatctttcacgcaacctaggctcttacaataattacggattgctgccaatcctaagtgcaatccaggaaaactaacagatgacactagctcaagaaaaatgaaccatgtcttacgaatcaaagcatcaaccctatctacgtattatcaaatcccccaaacccctaatagttcagtcactgtaccctactttcgattgttccacaccctgttctgcaaatcactccatcaagggagaagaaaccgtaaaattaaaaaaaatgcccaaaattccaacccagaat

SEQ ID NO: 32998 - DNA, 1501 bp, Oryza sativa
cgggggtccggcgctaagctcgagagattcttctccggtgagtccttttgctttcttggagctctatcctgacgcgtggtgtttctgtggtggtttggtgtaatcgttattgcttgtttacgcggttagattgcttcatctaaaacaaggatggttttcttgcttgatggtgtggatggcaaaccgtaggaggtttgtcgcatcaccgatcgcagatgattctaccgttgtgttcttgggacatcgccatgggagcctctgtggtagtactagctttcttgatggttaccctgtgccgtcttgtatgcatttttctataatggacagtcacctcgcgttaagattgcgtgttagactttctgaagctctaattttgctataatagcgaggggaagaggggaatacctcgtttggtgctgttctccatttgcgggatagctcaaagtcaactctcagtcaactcatttctttgcctgctttctgtacacatgtgttcgtctatgttataatgatttggttgttcaacaagttcattaattgggaccttatcggtggtgatgtgtgtagtaggagtgctatgcgtactacatagcacgattttgcttttgtaatctgcattcttgttgcatgcattgctcagttgctcaacaagatactcgctataaatatgtagaggtcaaagactggcacttaaaatgcattgtgcaaggcatacgccaaaaggaagtctacctatggtttgggagataattcattcatacaaagtgtaactaatattgcaaaatagcatggatgtctagaaccgaattattcttctactagatggtaaattgttgttccactcattatgaatcttctgattacacgtggagaagctgagagttctcctttcttgattgatcggtgcatattttggtgacaaatatgtctatttctgctattcattttgtactaatgtactacccgggactcatgttatcgctcctcgtatatcttttagtggcattctttccaaaatgctaaactgaatgcttcgatctttttgcagtttggattgcacttgtcagagtaaaagggcttaggacactatgctaatttaagacatctcatccaaatgaggcgcaccacacttctttgttggcaaactgaaatcagatagcattctggtagccactaaacctacagggatgtttcttgtgtgttttgaagccatgtgcccctgttttggttcaagaaggaaggatgggagcgaagaccctgttcttggaagggatggaaattcctgtaagttaaatagcaagctttcatctattggtgatctaatctgttaacacaatgaaacaatgtagatgtcacgtttggaagtataaatgaccatcatgaattgtgacacattccttcatccttgtttttccagtgaattcttctgagctgaggtcaatgtctgatagagttcctccaagccctcttcgagtacctgcaagtccatctagattttcat

SEQ ID NO: 32999 - DNA, 1501 bp, Oryza sativa
ttttgttaaatcactatataaattttatagaaaacaaacactctattagttgatccatatcctaaccttagtcttcaaaaattctgactctaccatgctgaatccaatgtgtttcttatgaggtttcttgtgcccccttcttctttacaaaattaaagtagctagttcatcctagttattcccttgagaggcatatcgaatatggattctgtagattagaaacttaggcaaaggtcctcttgctgcttggaaatctttcgtaggaacatagagatcctccaaacgagcagctgcaggcgtgcaggcctcttgcagaatcggaatatggttcacatacaacgccttttgcaatagtgcgtaatgatccaacagctagtactaattactcaatttgtgcttggccattgatttgtaatgataatctaggagtatatgcgactgtggccggtagtgtgcggtgataggcatcgaagaataagaaacgacgtaacagagaaaaatgagcgtctaataatgtggccccttgacacctttcggccagagagttatttatgtgcttaatcgcattctgaaccactagtccggggctctacttgcagcgattaagttgacttgggactgttcgatgtgacgcggcacggcggtgatgagcgggccagcgttgactcaacacctacaaagataagagagatcgatacactgtcgaatggagaagaacagtcagcgcgacaagggtagccactcactcagtttcatactcagatgatacactgtcgaaggagcacatctcgttgccccggcgtatgggcatatggccgtgtgtccgtgtgtctgtgtgcaatgcccacctcacgtctctcgggccgaagctcacggaggaaggagagaacggcaaaacagggccggtggaacgaggccggaaagaagggacgcgcgcgatttcatgcgtatctccgtgattttcccgtcccgcgcgcgacgactcccgagtcacatggcgtcacggcctcgcgaccgtgtttgcttttgtggccaccgcgcgcgtacggcgctcggcacggacgcggacgcggcaaccgagccgcagaaaccacacggagaggtacgtacgcgaggccgcgaggtcgcagcgttgcaccggcgttggccggatcgcacggagaggctctgcactgtgaggaagaatgtgccttcgccgatcgctctcattctggaaaaggaacagcgatgtacacaactttctagagtctgctagggcatccgaagactggagtcaccaaattgttgcgcgcactggtaaatttttaaggtatcggtgaaagaaaagggtttgcggttaaagtgagagatgctcattcgacgacccacaaagagtaatttaaaagaggagatttaattagtatgcatgttagtaatactttgtcaatgcgttcccacgtacacacacacacaaaaaaaacctagctaacatgcatgttaatgtcattaactcttcatccgt

SEQ ID NO: 33000 - DNA, 1501 bp, Oryza sativa
catgggaccggccgtcgaggctcggccagccatcgggaccacgagcgctccgctgcgccgtgccaagacgccagtgggcgcagccggtggccaccacttcctccgcgcacaagggcctcccgcaaccgccggtgggcgcacccgccccccgcctccgttgcagcaccaggcccccgcctccgtcacgtgcccgccacccggctcagtcctccgtcgccggcctcctgcagccttccctgcgctggcgagggcataccggcccccacctctcctaggcagctcgccgtcgtcagccggccaggagggcgacggatctggtcaaggggccaccgccatcaccggatccggccgccgccatcaccgggccgagggccaccaccgcctcgctgctgcatcgccgatcgagacccgcgtcctccatcgctgccgctcgctgcccctctctgcctccgtcgtgtcgcccaccgcgctggcccgcaggtggggggccagatcctgccacaggggcgccggatccgccgccccaagctgaccggccgactccacctccggccgtgccatcatcggccatctccgtcctcctcacgcagagggcggttccgctgactcgtatgggcctcgccgccgccttcctggctcaccgccggctttgccgccgccgagctccggcggtggcgaggtggaggatggggaagaaggtgtggcggcgcgggcggctagggtttcgcccccgagccgcccgcgtgagagcgacgcgggggtcaagactccgacctcgagaccctaggacagaatagacttctccattaagcctagatacatatttaaaatgtactctcttaatgacctgtttaattcatattacatagaaaatatatttattatattttaaaacagatctggtatataataccaactcgatgaagaacagaagtaaccgtaagccggatgcgactatgcgagcagtcgagcacgcagagcaaaactgcacaaagtacggtaatacccacccctcaggtcacaaaccagctaagccccggatacccccaatcgtaaatatcccaatctctcgtgcccaaaaccaccacgacccaaataccggcccgcacacaaatacaccagcgcacaccaccaggcaccaggagagagtgtgccagtaaaatccccgcgaggcgcataggaaagtacgagactacccacgcaagcgtgcggaaactacgatccggacccacacccaccctcccctcagccctaaaagcacccgggataaaaccccaccctcctcccgtcgtccacgcctccgctcccccttcctcctcctcctcccctcctcccctcgcaaacgcaaccttctctcgccgaagagggagaagggaaaaggggtttcgatttctccgcgatttccccgcggattcctccccccaccgcctcgatcgagctcgcgcgcggcccccccggattcggttcatccccctcccatccccccgtctgagaagcatgg

SEQ ID NO: 33001 - DNA, 1501 bp, Oryza sativa
aatatagcgctgatgacttagctcaagcaccacatgccatccagaagattaggaccggcctcatgtaattttcttcgatatatcatgccatttttccaaacaaaggattgagttagcgatatccgatattttaatcaaaggtttattatagtagactacccaattatcaataactttttcggtatatgctatatcatctgattgtctttttatgtgtttcttaagttcaaatcttagatctaatagagaaagcacatgttaagtagataagtgtaggggtactcgagaaagcatgggtgtagatgttctttttttattttaaattcaaaatgtttactgattattttgtataataaacctagtatttgtttgggctccatgttatgcaagaaaccgcatcgcaacaattttttatactacgctgttatttgttcctctgtaacgcaacatcaacaaactgattttcacatgccatgttaatcagttgtttttatattcacaaatgtattcctctctcttttctcttatatcttttctctaagttacccgtggtctaaatctaccacatatgaacatattatgtgctatacgatatgagcggctctgtaaaaagtcacttcgcctggttgtccagatatgtttgtatgtgacaaatacaatacccatctagctagaaatacccgacttatgtcaaataaatttgatcagacagagtaatagatttcatagtatatgattataaaccttatatagagaccagagtcattttatatatctcacacatctcccaccacatgtattggatgtcttaataaccctcaaataactttatttaaagaacatagatcgttcctcagattgacccagcttttttaagagccaagataacagggatcctcaaaacaactttaacaatcaaatcatctctcaatttctgcactttcaaatatggaacctcaatgccgcaaaacatttttagctttttccaaacgacgtaaaattttattagtaggctggtaggaaagctaacgatatgcacactaatatatttttttcacaaacattgttgtgttatactgtgccattgtggttgaatcttgtttttttataactcagttaacgcaatcaatcggttgacgggcctttcgattttggcccaaaggcccaacccaaaccccagcgagagtcgtcgagatgacatccgaacgaatagctgcgagaggggaggagggaaaaggggaggaaaaaaaaaacagtttgggatccgaaaaacttgagaggggaaaatctggttctcaaatcttaacacactccatctctatcgcatctcccaccccccactaccgctgctctcgccctctcctccccctccccctccccctccagtcccctcgcgaaaccctaactgtctccccctcctcctcctcctcctgctcggggtagatcttcgcgcgggctctcccgctggggcggcaccgcgcgcgccccgccgtgatggcgt

SEQ ID NO: 33002 - DNA, 1501 bp, Oryza sativa
caaatgaattataaacacgaagttttcttaggtaaaggccatgaacaaaatattgatctctatctgaaataaacacctgtacagtacaggagcattgctcgcctggaagctggagccaatcgagaactgtggcatcgctttgaaagcaaaatgaccttggacgtcagggtgtcaggtgttgccgtgttgagttactactggctgtcctaggtgtttaaacatccagaaacatggaacaaaaatcccatcatggtaaaagtaaaccgcttccctagggctagggatccttctgtctttgcttttttaatctggaaaatggcaagaagccaagaacacacactctctctcagtatttttcaacggttggtaagctgtaaataaaagcataaacaaacagcaaatgactcctcagtagtagtactagtacaggagtagcagtactcccttcgtcccataataagtgcagttttgcactattcaccgttcgtcttgtttgaaaaaaatttatgattagtatttttattgctattagatgataaaatatgaatagtactttatgtgtaacaaaattttttaaattttttcataaatttttcaaataagatggatattcacgactacacttattttgaaacgtaggtagtattaaaaaagcttcatgagaagaaccaaatctctctctctctctcacacacacaaaccccagccagtgcagctgctgctgctaccccagaagctattggagcccaaccatccagaactcccagaccccagagcactagttgttcatttgtagagccctgagtcctctcctgcttcctgaacaccacatcccaatctttgctgaaacctcccgatccgcgggtacttctggcatcgcaaaccgaatattaccgccgatccattggatacccagcgtttcttttcctgtagcacctgcgaaaaattccatcttttttggctaccaaacatgaagaaatgggatgcatgatgctgcttggagtggacgccagctatatggaaggtgagtttcttgcttgtcatccgtggaaagaatggttccgatattgaatcggtccttgttttatgtttcttgttctctatcgaaaaaaaaaatccttttgttaaacttatcttgatagatgcgtattgcttgctgttttgtatagttttcatctggatatttatgttgcttgatctggatttgcaacttctttattgatatggatctcaatagacctcaaactttattgcttctgcaccccaagaacccatttcatcatgaactagttagatgtaacagcatgttgttcttggtattacgactgcagatttctagcctatcttcttgattggattgtcgccatcgcgaggtatctcggtgaaatattgagtactttccttccaaatagcaactagagaaaaacatagagcaacttcagtagagcctgcagcttcagtgattgtctgaataaatcttgtcactgctaagttggataga

SEQ ID NO: 33003 - DNA, 1501 bp, Oryza sativa
caaaattaccatggtgtatcctatacatcaacacactattgctaatgtccgcaaactaaatcgcctttgggaggacgcgaagagggccgcctgcaaaatcaccatggtacgtcctttcgcattgtgctacgtcacatagtccatcctattgtaggagaggaggacgttttatatgttccgctctatacggtatagcgggaggagtatatttttgcaaaactttgaaaaattaatttatttttaaaaacatttagaaagtaaataaaaatgaaaaaaaataatccgtgaaaacccccattccggcccaaccccgtcgccgcggttgtgggcctcctgctacggcacaactacttcaggcccaggaaccatgggccgcattacgtacagccttcttctcccccgcctcccgaacctccgtccctaccaccaccggcccggagctccggcgagccccgtcctcgcgctctcgccggcgggcccgtccaaagaagcggcgacgccgtccgtctccgctgcctcttatgcagaggaacaatgccgcaacaaccgcatgcagaggaataattctgccacaagatttcagaggaggagcctcctgtcaacgacacgcgaatttaggctgcggccgggagtgatcgcgtgaagctagcaggttattctttccggcgacctcttctcccccacttctagtcctatcactctttaccacctcataaatagacaacccggtcccgacgggatcggccgagaagtggtttgatggtcaatgcgacttcccaaacagggtcgatcgaattcttaggacagcgagagcgggtacaatagaagagattctctttcttccctgaacattggcgcaagaacagctagattattacctctaccaatccgtgtaattgtcaggtctttcgcgttttctcaggcgttgcggtggccaggagagagcacgcgatcggcatggattgatgaatgagacgaccaggtgaaggaggatagctaactttgcatgcatgaaacttaattatgcatttttctgaaaattttgctccagcatgcgagttttcattggttgtgattgactgtatgtctttggttaatctgcatgaaatgcgcttgggaatttataattgtggttcaaagacattgtgacttcttatccaaaaaaaagaagaattttcacatgtgactttgattggaatgtcgaaaccatattatggattttactacttctgcccatctgaatttgctttctacctgactacatgttccacattttcagggtgattttcatactacatcttaccgtaccgtgttcagtaggccggcatcatggatgaagaaaatgctagctccacgaacgtaagttttctttccaagttgcgaactcgtacatactacgcacatggacgaactccaaagcaccaatttaatcaccaccatcatttccgtttaaccacaccgtcttactgtttgttttccttgtacagagcatcaaactaga

SEQ ID NO: 33004 - DNA, 1501 bp, Oryza sativa
tgtgggaccgatttatcattgacacgcaaaagaaattgtgagactcacgtgtcccttctctctctccttcctccagttccttctcttcctcgccgctctctctttttctcccgcgacgggcggcgagggtcaaagcggcggcagcatcggtgcgctagccaggcggtggcaagcaacagccgccatcggtgatccgaccaagccgcaccaagcaggatccgcggcgagcaagcctgcgacatcgcctttgctggaccgcagggatgttttcttctcaattccaagcttgctctgctacttcgttggaccctgcggccatctacacgcagcggtaggccaatagctgtcgtcttgccagatctttatgtcccattggtagacaagcatatctgttttatgagtcgagatatccggttttgtagtttatggtcacggattaaatttcgacacttataagggtcacaagggaacttattccgacgttcctgctgtgcagaaccgagtccacatcaaatatagtagtaggccggtaagagttatgggccaaccagcaatgcgatgcatttcgaactgaaataagtttactttggatctctcatctttgtagaaaattgtatactcgatgttccagagtagtatagtgccgattttggccaacgtgacaagttgactactgtcaccccgactgagtcagcatggaacccagatcgatcccaattaactcgtcacgttaactaaaatcagacaatatactgtcataggatctcgagtacacctgttttacaagttgagggatgcattacatctggtagcggtttagtttaacgacctaattcaaacttgatgtcaatgagggacctagagtgaacttatttatttccaactcaagttgcggcccatgttagcatgaggccctgcaccgagatgtttcaggcccatctcggcccactctgcttggacgcctcacgccaccgtgtaatgagtgaacggatttaaccaggggaaggctagggttctaaagcctcgggaatttcttcttctccgctgctgctcctcccgtgccgccgccgtctcgcgccagtgcgtctcttcctcgcgcggcgatcatggcggagcaggtgagaacccttcccgagttgctcgtatcaactatcaattgtgacctgtttgtttttctcttgcatgcgtgtttaagatctcgtttcgttagcggcgttgtggtagtaggtgatctagtgcgtgcgggtgcagtccggttggtgattttttttttctgcgtagcgttgtgattttggtgcatagctgttggaatgccgcagtctctaatggcatgctagcgcgaaatggctaggtggattatacagattgtatcagttgtttaagctctagaatttgttaccttctggtggtaattttgatcgctgtatagatggattggtagatggactattatgttattagttgctgtaggtttaacagaaattaaacgtctttgctcatt

SEQ ID NO: 33005 - DNA, 1501 bp, Oryza sativa
gctcatttgcaaaagcagcatttagcaaaacatttaagagaagtaaaacagtggagtaattaatcagaaattttaatcaacactgaacagcacacccatgctgcacaggcccaaccatcctgaacaaccatacccagctgtacagatctaactccaaaccaggagctaaacaaattattaccaggtataacatcaataattattgtgagaggtgtgagactaatcacaaaaaacattgctcaacccgcccataaccgcgggcacggctattcgaatagttttactctggccagaggtgtaccgctgtacccacaagacacagcctcaacatcatgtctaccatgtgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatattatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctacctgaaccaatatataaagctcaactagtcaagttataataacccaaggtatcaaggaataaaggaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaacgaagaaaaagactaataaaaaccaaataaacagtacaaaaacaagcataaacagtacatgtggatatttttaacatgtagatctcaattttagaaaaatttagagacttgaaccaactaaatccgagctaagatgaattagttatgaatttttaaagattaaatcggattaaaatacttatatgggtattaattgaattatgacgcaataatgaattatttttgaaaaggaaaaaggaattattgcgtcagcggctagggttcacggtggaccgggtgcacggcgacggctcacggaaacgaacggccgagattgatccatccaaaacggacggccaagatccatcggatccaccgcggctcacggatggacgacgacga

SEQ ID NO: 33006 - DNA, 1501 bp, Oryza sativa
tggtagtcttgtttcgtgatattcgtgaagagggggggagctaaggggggattcgtaagatcagaattggatcacgcgggggcgcgctcgggatcgggggttccaaacacagcttcttcgttgaattgtaagtttcttcgctgaaaccctctccgtaggttggtacttctgatttttttttcctttacagattttgtggtttgtagggcgtattgctatgtgttgctattgtttatgatgggaattttggtttgttggtgtagataagcttatctatgtaaaacaaaaggtcagtaggttacctctttgatcttgcttgtgcagttaggctatcctgtttgagttgttcgtgatttgcagattactgcaaaagctatcctgtaaaatttcttgtcgtggtaaagattgtactaagaatttttgtgtgttcagatcctaagacatagaaaaatagttttttttcgtctccccataggaatataacaaatgttctttttctgtgacaccatgatcgaattttgttttttaatgcaaatgtatggtattatcattaacataggatgggatcagggacgaaacatatgtgaatataggaacatttgcatatgtccaacggaaaagtctcaactctaaatcttaatccaaatgacatcacgattgtaaatccgaccagatcttaaatctgaatccaagtgagactcaattgtaaatctaaatataagaaagaatactgatatatgattcattgtaaaggacgctgtggcttgtaggaattgagtattactggaaaattaggaattgaatcagattgtgagatattaattgacctgtcctgttgtggcatatttactcctagttagaacttggaatctatcatattgttatgtaactgtttactctttggtatcgttttgatagcttcttatctcagttttacttttttgcattaaagactcagatgcttcggtctggcacatatatcttctacaaacatatgcccttattttctctttgggccatatatatttgtctgaacctgatatttaccttgttatatacttgtgcagtaagtggatgtactaatggagtcaaagggtggcaaaaagaagtctagcagtagtcgttccttgatgtatgaagctccccttggctacagcattgaggacgttcgacctgccggaggcgtgaagaagttccagtctgctgcttactccaacgtaagcatcaaatacagatttaattccctcctttgtatcttccgatgtgttgctaatcatgtcaattgttccttttgttgcagtgcgcgaagaagccatcctgatagccctttcggcttctccatcctagtagtttaggatttcttgcaattccattttggcacttttcttctgacctatttctctggctgctgcttcctgataatcgaccagttctctagtcttgctccctgcactcctccctcctccatctccggcacagtgttctgaccaacctgctccaa

SEQ ID NO: 33007 - DNA, 1501 bp, Oryza sativa
ggccaaccaccggtggcagtgttcatcagaattctggtagggacaggcgtaatgggtatactagcttagaatcacgtagcaaaagaattaacgcaactccggatatagagtatcacgcgaagccaaaagcaaggtgtctcacgactgactaaaagttgaccctacctgaccaacattcgaaaaaaaaagaaccataaaaaatcattcaaaatatatatgactataatcacgaaacaactatacatatacaaacaaccactccctccgtcccagaaaaaaaaagacaaaccctgggtttccatgtctaacatttgaccgtccgtcttgtttaaaaaaattatgaaaaaaaaataaaaagacaagtcacgcataaagtattaatcatgttttatcatctaacaacaataaaaatactaattataaaaaattttcatataacacggacagtcaaacgttgtacacgaaaaccaaaggtttgtcttttttttttagggacggagggagtagtgcgtatgatccatacccgatataatgcgcgtagacacaactattgttttcctaaactccgatggtgagaaaccgagcgtaagaattgatagatgaaacgtgattagatactaactatacgtatagaaaaaaattataatgtaattatattgtaactaacatataattataataattatagtataacacggtggtgtagatgcgccgcggcatccacaggttgcatgttttcttaacttttgtcacatgttagatagcaattatctctttttttctgagggagagagagaggagataataaaatactcgatattgaattgccgatggattactcattaccatgtgtataaggtatgataactccaaatctcatgtgcttgtgtgtttttactttttagagctctataaaaataacatgggtgctaaactattgttctggaattatttcttgaaggcccaattaatttcgggctgggccattagcaagcaagccgcgtcgaatttgtcgctttgaatgggccggaaatgctagggttaccgtctccctcccaaagccccgcctggtgattcgccgtctccctccgtcgccgtgccttcccccgccaccgtcctgctcaccggcgttccgccggaacgacttgaagtccacctctcgagctcggcggcctcccccttagggcagaagcggacgaggcgaatggaagaggttaggggcagggagagcaaagaccaccgcggcggcggcggcggcggcggaggtgatggggacggcgagcggacgggacggtggcgcgccgaggaggtcatcgctgggaaccgcgcggttctggaggctctccgggagctcgtgatgtatcctgtcctctacgcacgggaggcccgcgtgctcggcctcaatgtattgtcgcctatcccctcttctcttcgtccttattatcatcaagtgcacctgcttgtaaatagcaatccatttttgaaataatctttgcattgg

SEQ ID NO: 33008 - DNA, 1501 bp, Oryza sativa
tttagcacctcggttaaactagtacaactagaatcaacatggtgaatggacgtaaatatggtggtagtgtaaccacaaatttgtattggtcatgtagtatccttcccctgaaaacattttcaggggaagtctgaattttctttgtcgatactataactaacttaagaaaaaaatgaagaaatgacagcgagggtgggagccaaatgacaaccaaaatcgaatcttttcggctcgatcatttctcttcttttccaactcttttcgccgccttgaattaaaatatacaggacagtcaatgatccgtcgccaccagaagaaaagagttttgttaggtacacacttttgtcgacggctaattgttgccgggcggcacgcaggtgcagcgatcgatcttatcaccacacaagcgtttttccaatgctttgtcctgaccgacaattttttttgtacaaatccattattagcggcaaaaactccgtccaagatggcatattttcctaagaaaaaaaaaactcttcctattgagtcctctcgatagcatcctgttctgactttaagtagatataatatgtggacttcacattcagcgagtttatatgtcagtgatgaccaataccagagaacaatactttggagagacttgtctctttccaatacgaccaaagccagccttcaatcgaaggccgtacacggtacactgttcactgagccatcgcaatttatatatggtctcagtcgaaattgatggccggttagtggttcgattgactgctgtcatggaaggccatgatgtgaagctctaacggtagccatacttcgcctctcccccgtgaaaccaccgatgccaaaccaccatatctatcagcctatcatgcgccgcgcgcgaccacaaatgcgccggacaggatggccgccgagatgggcaccggatcgatcggctagaaaacgtcaccgatacgtggggtttttcaatgccattgcaaatggcttcctttttggcaactttttcttttgccatgacttgaatcatccagcaccgatcgatgatattacggctgcatgtaggcacgctcaacagaaactcggtgctgctgtaaatagtttgcctagttagctgggccacctctggattgtactctcaccgtatcaaaataagtataacagcttaatatatgatgagacactaggatacgttacattgctatattttgatatggaagtagtactactgttgtacgtgatggtccagtccaacgccccctggcttcttcagaagtggttagttctccagtcatccaaagcagcagtacaatcctggttgttcccacttgagaaaaaatatctttggttgctcgtcataatagaggggggaaggcaaggtaccatatgctttgtaggtgttctgtacttaggcaccaagactgggtgttgtgttaatttgtggtcctcgttatagacatcagacaatcactccattatcttgtgtatcatgttaactacc

SEQ ID NO: 33009 - DNA, 1501 bp, Oryza sativa
tataataataatatttttatcgatggttatcatttttaaaatttagttttttttaatttctaacggtgtggcattgaagttgacactaaatagatgaattcatgaatatgaaaatttttcgaccgtttctgcttgttttttaaaaaataataaaataatgatgccgtttccgaccatttccaaccactttcatccctagacttgggagagaggaacgaacaggagactgggagaggtggagagtaggtgagcagcagttgtcgtggaccttattcttatgaacatggtgggctgctgggccaactcaatagtcaatattcattataataagttcactttaggtctctcttattgacgatgagtttagattgtgtccttcaaccaatttgcaagatcggtgtaaccgaggtcacatgacagtataacatccagttttaactaacgtgacgagttgactattatcaatctggttgagtcagcgtgagacccacatgggtcttacatgttagcagccaactctctctaccgagtccctttacctaatatctatctacccatcccttttccccatctctttcccgacaggaactggagcaactgctggaaaagccatcatgctcaagaaccccgtagttaccttggccacgtagcttgtgttgccatcggggtaagccgagggggcaacacgatgttacgcgatcgaggtcgatgctgggttcctgaggttgagggttgctcgagcagccgcctggcaagctcaaggtcttctagtccactggttgtcacccctctcccattagctgctatccttcttcccgctgctcaccgcctttctggccttctccaccggtggagagaaattggcaagagggatgggtagagagaagaggcgatgaaggaaaaaagagttaaccgctaatatatggggctcatgtgggtctcacgtttactcgatcagtatgatcatagttggctcatcatgtcagttaaaatagggtgttatactattttagaatctcgggtacaccgatattataaattaactgacattatactggtattgtggataaggacgcaattcaaactcagcatttaaatgtcgaaagtgaacttatttcatattcacttattaattcctatcaggccttgattaggtcgtaagtagctacacagtaataacgcagtgcaaagagatgatgcgcaatagtaaaaggcacaaagtcaaaattagtgttgacatgttgcccagttttctactactagtacatagattaatggtgcaaaattaccatggttaaattagtaggagtatacagtactataatagttgcaaggtggggggtgtcaagtcaaaaccttgagcgcggatacccatcaacgcacacttgctcttgctcagctcgccaacgccaagatgcgcctcgtcaatctctcccaccgatcaatcgcgagacctgcattctagccgtgcgaattccggcgggcttccgccgtagatccc

SEQ ID NO: 33010 - DNA, 1501 bp, Oryza sativa
cttccttagagttatgtttgggcaaaagtctgccgcaaagacttatggtatcttagagtttgttagagatagtgatcgtgtccggtatggacatatcttgtaattctcgggtataaatagaccccgagccctatgtaattttgaacacacacgttcaatacaatttcggcgtatcgccacctttttgttttaattttgtttcgacgagttcttgctttcgggttgagctgcatcggttttgatcttcaacaagaggtaaaacttgttatgacgacttgtgttctcgagattagtgcttccatctttatgacactctaatcttgtctatataattcgtcgagttatcatatatcttacataatctttggtaatatcgtcatctaacctacaatcggctaaaatcttgtgccgcatcactattctgattaagatttcccccttgcaactcctgagcaccatcaccttgaactccatgcgctccatcgccttgaactccatggaccccttgagagttgtaaccttgacttcctagagaaccgtcggtagcacctttgtccaaagctccaatgcaggtccaaagctcgtcttcgaatgtatgagcgtgccaattgatttgatcctgtaatcaacaagaaatagagacaaagaattcgtggttaaatctataaatgatagccgatcggctaggtgccgatgacatatcatttatctttgagccgatgtcatatatgaatcgattggcggttataaatagatagtgaggaactaaatctattcgatcggctgtagatattaacgatatatagttcttatattaatatatacttaaatcaagtgattgggatagatcggtcaccatgccgagacagtataaatcacttagatcgaaatatatattaataacaggattatatatgtttatagcatagccgatcagatagatctaacatgtatcggctaatactctgatactactttatataaagatatcaaaacaaatataatataccaaacaaaagcttaatatacttaaatgcaataagatcctgacataaagggcggatttaacatgtcattgaagcatatagatcgaatatggttaaatcatataagatcggttgaaactccgatactaccctaatcggcaaccagaggacatgctagagattgatattctaagcacgacttaatagatcaaactcaactgatgtagcattaagtatgaaaagaagaacaatatctagacaatcaagccgctgggtgtttcataaagtggtagatatcttacataatctaggacaacgtcgctatttaacctaatcggctgccttctattaacagatgttagccgattgtaggttagatgacgatattgccaaagattatgtaagatatatgataactcgacgaattatatagacaagattagagtgtcataaagatggaagcactaatctcgagaacacaagtcgtcataacaagttttacctcttgttgaaga

SEQ ID NO: 33011 - DNA, 1501 bp, Oryza sativa
ctcgttttctccttaaaatgagacaccttcttctttatataaaatgtcggcaatggcctgaccgttcgaaaaaatgtatctaggcttagaaattgtcttagaagcttgaaattctcaaaagcagctgataagaattcataaattctaaaagttttttttactttttactttgaatttattttctagacttttggtaaaaacatgaacagtttgaaggggttaggcattttatataagactagaaaaaatgtctgtgcaatgcaacgggtgaaagctattttaatcttatcgttattacttattatacgatttagttaaggtgaaattcactttgagaattcgcttggatatatatatattttagaaaaccataagttgcaattaggagtccgaccatctaaagttagcacgtgagttttttttaaagagatttcctatacgactccttctgtatttccaaaagcgaacgaactttaaaaaccgactcaaatacagatctgtatttccaaaagtgaacaaacttaaaagccgactcatacacggatggcgtaccaaagtaccgacaaaaacatcttaatccttataatagtagagtgggtatggttgtcagaaactcctcccttaaataacgactaggaatatatagttgagtgaggtggtggataggtcatgatttaaagtatattttacaggtgttagatattgtttttgtatgtttgtgatccccccttgtttaccatactaataacgtttattgcaacaagcccatagactcgattgcacgagtacatatgactagggatgggttaggacgatgaattgagatccaacctcttatggtctatagagtggaagaagggatataagcataattgagacctaaccatttgtagcgctgggaggaggaataagaatggctccgcttttaatcattagagactagcttggtttcaatttatggtctttgctatctttttctcgtttggatttataagatgcaaatccgtattgagcaggtgtttgatactacctcacatattccccatgcccaaatgtaattatgctttatttatttccatatctgcattatatttaaaaaaatcccatctctactgcatctaagtcccactctgatatattttcataaatagaaagttttataaggaaaatgtgagctctattgattatgaaatcaagttacaattgtttaatagaagctcacgaatataagttggtgtttgcacatgccataccgcacaatgcattgtgcacataactagctaagttattttataatgaaaataattattctagcttttgtttcaaagaaactataaaagttgcaggataaatgattacaaattataaatttacggtttaattaaaagcaagacaaccacttaaaatacaacttaaatacatatatttctatatatatggttggtcagagtatatatggtgaagagaagatgcacatcggtggtatgcacggcaaaggaca

SEQ ID NO: 33012 - DNA, 1501 bp, Oryza sativa
acacacggtcgtcacacgcatcgctgctttagattggatcaaatgtctcgaaccaaccagtcctctctcctctcgatcacgagaatggtaggttcaaaatccataaaaaagacggagagaatgttaggttaaaacctgctgttctgttctggtaatggccatctcctgctttctcctttctcccagtgatgcaaggcgcttgatttgctatgcagctaatgtgcagtatttgactaaccagcgaattccaatttgttcgatgctcacaacgctacatgaactagcagacaaacacctgaaaaagaacacgagtactagtactcttgagtattgaagtctcagagaggaatacaggggaaaaaatgcttgggagagatgccatgccgcgctatgttgttcaacttcaaacaagccattatagaacgaaccagaaaggtcattgggaatgcatccccgcttctggacgagtcaagtttggtcaacgtcggactgccaacaaggccatcggatgatcgcgtcgtcccatcggacggtcacgaagccgccacgtcgcgcttgtcaccacgctggccactccggactcgtggactccaccgcagcagcagcagcagcagcagcagcagcagtgaatgctactctcgctctgctactcactcctggcgccggtgacctctctgccactccaccggacggcgacggcgaggcgggtgagctctctcgccgcctccggctctcctgccaccgggcctccacattcggcgtcgcactccttcgtcttcgcgtgatccggtaagccgtcgccgctcgtggcaacggagatctggttattttggtgcttgatgtgtgtggatgagctgagagtttcgtggattagtggagtctaagagatggccttggcttgggtggtgggattggcgcgtcgcggcggcggaatgcgcttgtctgtctctcgacccctgatttggttagtctcgatggttccggtggttttgttcttaggaatttccgaagaacttcatccagttgtcgaccaatggcgttgtttgtagttctagatttggtccagttgcgtgctcggtggagatgatctcgatgcagagctatctccatatgaattatcgattttggttgcgtttcacggatggatttgtttaggtttgagataaatgttgttggcctgttgaaactcccaggtattgagctgttttgttgttgttgttgtgtgcggcagtaattaatgttttttcccttgggccatcagctgtttctgcgattggcatttaatagtatttctgtcaattggtgggggagatgtgatgctagaacgatttaaaatgctagtagttatatgtgtctcttataatcatatctgaccaattcaaatgctcagcctggcagatcgggatcgactaagcattggcctttgcaagttttgaagtgcatttcaccgttgcttttgtcttgagcaagagtttatagagccatacagctccgacaaaag

SEQ ID NO: 33013 - DNA, 1501 bp, Oryza sativa
aacattttaagtattttttttttgggattctggtgtcagtatatagttacaaagagatatatgcgacatgttgtgatgtggagggggctaagagcaaaagtgttgcctatgtgacataccatgttggtggtcaaacgtggtcaaagaacgattagactgggtgtgatacattaaaccaagttcacatatctaaacgtgcaattttttagtccacagacttaagtgacaccaccacacaaatttaggggaccggccatgtatttcactctataaacagccataaatccacagaaattttgttcacatctcgttctaatcgtttcaaccatgccccgttctcgccgcggccctcccaagggcgccaactcgtcggtcgccggcgctgcgccgcgcgggggacgcgtgagtggcctcaatcaagcgtacaaccggatggcgaaggccagccgggtgcccaacccgctggccacgcccacgactcaccagggggagctcccgggaagacgtgtcgaagtgaaagaactgaagttctagtcaaaatatgataaataaaaatattgttttttaagaacattcatttgaatgctgtcgtgctctataattcttaagactatttttaactttcccttcaactaatcggcagcaggaagctagtatggtttgctttctctcatagccgtggatcctattctctgcattcttctgaggtgcagcagcccgcggagcagctgggccaccaggtcgccggcgacggggtggacctgcccgtggcggcccaggagcaggcgccagtcatgggccaggagggccatgtgccggcggcgcccgtgcacgcgccggagtccgatcctccggcagcgtgagggcgagtgcaactgacaagatcgttctgcaagcgaggagggtgtagtggcaccgaagccacgcaacgcaaaacaaagcataatcggccatgcaaagtagtatgtagtaggaaaaaggcagtgaatcggctggtagtttgtagtaggagaaggagaatgaacaagaagtatcttgaatctggagacgttaatgagaagttatcctatatgaatttcttctttctactgtttgattgaattgctgtttgtttttcttttcttttttgcgtttttgtgatattttctttgggctgggctaaactgttcgaggaagagggtgggctccggcctttcgatcggtgctcaaaggtgggtcttttggcctcttcgtgcctcttgatcttgatctgtaggagtatattttggctgtgtttagtttagtgtaaagtttgaattttgattgaaattgaagatgatttgactgtagagttgcgtgtgtatgatatgttaatgtaatagaaaaagactgaagtttggatccaaactctgtatctaaacacagcctctgctagaaccgtcgtcctcttcgtgcccttgtgtgattgctaatagatctgtgtagattccctcactctctcaaaaaaaaaaaacagtgcaga

SEQ ID NO: 33014 - DNA, 1501 bp, Oryza sativa
cacaatcccctgctccttcaccgccacgcccttcctcttcgcgtcttccgcctcgccgttgccgccgtcgtcgccgccgccggtgccgaccgcggagtacagcggcagcgcgaccgactcgggcgccttcacgtgcagcgcccgcacgttcctccacttcctcggcacgcacgccgcagccgcctccacggcggccaccacgttctccaccgcctcctcccgcgccatcgccgcgtggcccacccgcacggcgcggcacgtgccgccctccacccgcagctccacgcgccgcgccgcctccctcgcggactccgcccacgcctggtcggcgaggtcgacgggcacgacccgggcggccttggccgccgccttgcccttgccgcccgggcggaccctgaggcggcggtcgacgagcaccaggccgcggcgcgcggcgggcgggagcgacccgagcgcgggcgaggggagcgggtcgatgtcgtcgggcaggtccgccgggaggcggtcggagacgagggagatggacgggaacggcgagcgcgggaggcggagggtgtgctcgaagcggcgggcgggggcgcgcttgagggtgacgaggaggtagatgggctccggcgccggggtggggtggtgctggagccaccggaggagcgccgccaccgcgcgggccacgtcctcgcggcgtacgcggctggccggggcggactccatcgatggcggcggcggcggcggcgggagtttgggaattgggagtggtcgactcgcgggggtttagggtttgtatccactacgcttgttggacccgaagtgggtttggtcctggttgaaccggaccaggaagccggttgggcggctcggatgtgagccacggctggagtgatcggctcggctcggctcagccggtgctgagggaccatggtccatggagcaaacacaacacatcattgacacacaactataccaacgttctatctcctttgatgtcatgacatcaaataaacaaaccaaaccatatcttggccagtatgtcatcaatctggtcacgccataaatctcaaggggttcaagtcttcaagacatggctagatagatatatatcaaacctttctacggagtatttgtatggtcataagtgtcatgatggtccaaaagaggcaaagatgatgttactatgatcaatgaggtctactctaatttgtttgttccccggaggatggttacatgcctttgttgagacaattattccatttgaaaacttcacaataaactcacttggtaattactccctttaatttgaaggaaccctatagttttcacttcaacatcatattacacttgctagtaataaaatgtggtaccggtaactatcgagaaccacaaactaattataggtgcatactttctatttgcgcatctccctgtcctcaaaacaatgaggtccacatatactcagacacgctaatcaaaccacccgaaccaccttttatcactgtgtattcac

SEQ ID NO: 33015 - DNA, 1501 bp, Oryza sativa
ttaacaaaaaaaaagtctaaatataacctacaatttactaaattcaatagaattaaactatagttttcacatccctactttttctaggcatgcaacctaataagagacgtgcttacggaatttttttttgtgatttttgtgttgaaaatttctattatttctttgcatatataaaaatgttgttgaatttcggtcaggaccgagaccaagtccgaatttgtcagtcctgatatttttgcgttgaaattcggtcttcacttttcaaaaaccgaaatgaccgaaaaccgagaccgaaattttcggtcagaccgaatgcccacccctacttctgactgctctctttagttataggtcattaggttatgttgtactactccgtcccagagaaaaacgaatttctagctacgaaacagacatatatgtgtccaagttcgtatgtaggattggtctttttttttttttaggatggagggggtattgtctaatgcaatttttgttgtgttctctatggaggcgttttagtcaattttgctccaattaattatgcagttataaagttctagggatttttaataaacaagttaactcttttcttttataatgaaaagaaaaatccatctcttttcagaggttttctttggggaaaaatatctatgaggatttgaatttaaacactaaagggacctgcactcctggttcgattactgggtcgaacaaaagtttagtttgttagctgcaacatttgaaatcgatcatgagacccacttagaaaatgaatctctaatcagatgcatccatcgtcccttgcaccgtcagtcacaacggctgcataccacctttttcgtcgctgagttctattctttctttgtgatcgatttttatctgacgagtaacaatcggttgttacagtgtggttttctccatttttttttcatgtatactccctccgtctaaaaaaagacaaactctgagtttccgtgtccaactttgattgtccgtcttatatgaaatttttttataatttatattttcattattgttagatgataaaacatgattaatattttatgtgtgacttgtctttttaattttttttcataatttttttaaataagacggatggttagacgttggacacgaaaaccaatatttgtctttttttttgggatgaagggagtaattagttctattttactcctacacacaggagatgctctaatgggtgaagtcatggtcccttccgttttaagaacacaatagctggcttgttagcatgtggcaccggcacgtgcactactcgcccccaggccccagggcggaagatccgggtctcactgcacgaatctggcaccaccaccaccggcaccgccacgcaccgcacaagattcacccagccgtttgcactgctttgctcgccatcgatctcgcgcggccgcgacgactgtctcgcactgtcggctctctcgtctctcccccttcctcctcttcctctcggtcccgc

SEQ ID NO: 33016 - DNA, 1501 bp, Oryza sativa
tgcccggtgcggttcgacaagatgaaggggcccgccatcgagctgggaaagaagtgcaagacgacaggggtgaaggtgtgctgtgaggcgttcaagacattcgcatgcccgcacaacaagctgatcaatgacgtcaacaacggatgcgcggacgaaatgttctacaccatccacacctacggccaattgctgccgggaaccatcttcaagaaatgcctcgagggaccgcatgggatgaagtgttgaattcgatcgtgctgattcgacttgctcgatcgatatcgctccgttgttgctagcctccggcctgatctatactacctataacgatgaatgtccctttcgtcatcttgcaatgtaactaaacttacttttattacttcgaaatgcaatgaaccacaaaaggtttattacaattttctcctaggatattggttgaacataaaatgttaaccataaacacaacatttaaaagtgtgatgaagagggcgagcgtttaaaagttgcatgtcgtaatcttgaggcaatggttatacaactgtttaccaattttggatggagattcacaaacagaattcaataattgtgtactccttatcttgggttggtaggtgtcttctttttcatgtgagaaactttttgttttgtgtgttactctgtaataattggctgtaactcgttgagcaaaggccgggatattctattccattatctaaaaaaaaccataaacccaacatatcaatgcaatctctgtatatctaattgttataagggatcgtgacgctttgagagttgtacaacaacccaaacacttttttcccttcctttcccttcctcatcttgcatgtcgccgttttcatgcgttcgtgaatgctccttcgcctcctatggtggcagtgccaacctcatctcgactagcaccctcagctaacctcctccatttcccttctcccctctcttccccaaggcggtggcatcgagtgcccccaccatgccatcttcgttgaatgaggatgcaaccatcacatagaataaggagcaccttctcctcgtgctcaacacagttgtgcatgacgtcttttacttgggtgcatcacctcatctatggatgtattgtacagaaacgttatcatgccgacactgccataagatcgacaaacaccttaataactcaatgaaagtactcaattaatataaacatgcatgtacggcaaatagacaaacacataaatagatatatgtcatattttggcaagaaaaccgaccatctatcttcggctcttggctatatgtcatagttttgggcatggcataagttaaatttaaagggttcatcaacacatagctagatgtacctctacagagtatttgtaattttgcatgtcaacgggccatgtgtttcaaatattcaaagaaaaatgctgtgtgctggaaattgtttcttctccgaaggatgtgtgtttgcttttgttgagaacagtataaataatatatgaacaat

SEQ ID NO: 33017 - DNA, 1501 bp, Oryza sativa
tgtccgtttgagtttattttttatatggttggttcttgtgatttcctaagtgtgaaaaaaatatcaaaaaaataaaataaaaataaaaaagttacacatctctcctctgcactagttcggagagagaggagaggagaggaaaaattctacaggtcacatattacgtccatttgagttcattttttctatggtgggttcttatgtgtccctaagcgtgaaaaaaatatcaaaaaaataaaagaaaaataaaaaaattcgggggggggcgccagccactctggcgtgctccccctagtcacctcagcatcgccccgccacgtcagcagggggacggcgccagagaggctggcgccgtcctgttggatgacggcgccagccactctagcgccccaaaaagaaccatttctgagataagtttttccaagagtctatttgcgaaataagtttttcaaaaggaccaaaatgtgaaaaattcacgtgcggatctagcccacgtgccaacttggccacgtcccgtggactagggcgaaaaaagcccacagagatatatcttcagccgttcagcgtatgtagtttgaagtgagcccagtatgtgttgggttgccggggcttgatcatggataactcatcgcccctgcttgatacatgcggtgtgcagcgacgcaagtaaaaagaggaggaataagttcacttcgtgaccctcaactgtgatcgaaatctaatccatgaccctaaaccacaaaaccggatatctcgacccccaaactcctaaaaccggtgcaatttgactccctaggtggttttgaagggcagttttgctgacatggcgtcacgtggcgcctacatggtgatattgaccgagtcttcgttccacgtggcgttgacgtggcacttaggtggcattagaattaaaaaatatgtgtgggacccattagtcattcacacataaagaaatatgggccactgacatgtggggcccacatgtcaatcctcttcattcttcctcctccctctctcccttctctctctttctctccctttttccccttcagccggcggcaggcggcgagaacgagcggcgacgacaggatgggcgagggcaggaacggcgagccgtgcagccgcccccgccgctgccatactcctccttccgaggcgtcgcagccgccgccaccctgacacctctccccgccgtcgcagctttcccatgctcgtttgtagtttcaactgcctgagaagagcgccatttatattttttccacgaatatctacatgtatgttcacataagaagacaatctacaagaaacaaataacagatatggtgtaccggcttaaatagactttctacctggtcatataaatactggatctgctgagcttgttgtagaacatgtgttgacagttgacatgagatgattaagtgctgacatctctattatctttgtctctgtttcttggacagcatcaagaagatttgtcaactccacctaagatacgagt

SEQ ID NO: 33018 - DNA, 1501 bp, Oryza sativa
tcgttctagcatcacatctcccccaccaattgacagaaatactattaaatgccaatcgcagaaacagctgatggcccaagggaaaaaacattaattactgccgcacacaacaacaacaacaaaacagctcaatacctgggagtttcaacaggccaacaacatttatctcaaacctaaacaaatccatccgtgaaacgcaaccaaaatcgataattcatatggagatagctctgcatcgagatcatctccaccgagcacgcaactggaccaaatctagaactacaaacaacgccattggtcgacaactggatgaagttcttcggaaattcctaagaacaaaaccaccggaaccatcgagactaaccaaatcaggggtcgagagacagacaagcgcattccgccgccgcgacgcgccaatcccaccacccaagccaaggccatctcttagactccactaatccacgaaactctcagctcatccacacacatcaagcaccaaaataaccagatctccgttgccacgagcggcgacggcttaccggatcacgcgaagacgaaggagtgcgacgccgaatgtggaggcccggtggcaggagagccggaggcggcgagagagctcacccgcctcgccgtcgccgtccggtggagtggcagagaggtcaccggcgccaggagtgagtagcagagcgagagtagcattcactgctgctgctgctgctgctgctgctgctgcggtggagtccacgagtccggagtggccagcgtggtgacaagcgcgacgtggcggcttcgtgaccgtccgatgggacgacgcgatcatccgatggccttgttggcagtccgacgttgaccaaacttgactcgtccagaagcggggatgcattcccaatgacctttctggttcgttctataatggcttgtttgaagttgaacaacatagcgcggcatggcatctctcccaagcattttttcccctgtattcctctctgagacttcaatactcaagagtactagtactcgtgttctttttcaggtgtttgtctgctagttcatgtagcgttgtgagcatcgaacaaattggaattcgctggttagtcaaatactgcacattagctgcatagcaaatcaagcgccttgcatcactgggagaaaggagaaagcaggagatggccattaccagaacagaacagcaggttttaacctaacattctctccgtcttttttatggattttgaacctaccattctcgtgatcgagaggagagaggactggttggttcgagacatttgatccaatctaaagcagcgatgcgtgtgacgaccgtgtgtcatcatccatcgaccataccgcgcgtccgctcctccctcctgcgccactcggtcgtgccgcgcgcgtacgattcgttcgacgacatggccatcgtctccgtcacgactgccaccgccgcagctggcgttctcattctggttgtcgccgctggagcagcagcggccgccggagc

SEQ ID NO: 33019 - DNA, 1501 bp, Oryza sativa; identical to SEQ ID NO: 32984

SEQ ID NO: 33020 - DNA, 1501 bp, Oryza sativa
tgaactaatagctagctaggaaatgataatatgtagtagtagcagtagtagactagtagtagtaatgtaggtaggaaatcagatgcctggcctgcccttgtatgccgcggaatggatacgttttaggccggtttaatccctcgaccgccgccgcattgccgtgtcaggtgtcaccaccaccaccagcagctgctgctcatcatctccgttctgcgagatggatcggagtaggaaggcggccatggcgaaggcgaggagctcctcgatgaagcgtcggtttgcatggagaagaagaaaggaggagatgtgtggtggtgttagagagagagagagagagagagagatagagggagggagctgtgggcgatggtgtccaggcaccggcagcaaggcagctgcgtcgtcttaagaaagagcagaaatggcatggagccctccaaagcatctgatggctggccctgtatgcgtatttatttatgtaggggctaaaggcatcttttcgcaagacgtacactgcacactgctctcattttttgcaagacgtacgctgcacactgctcttatttgagagagagataagagatagagagagcagcaacagcagcagcaattttttctttaaaaaaaataatcgaaaacgcagcaaattctaccactccctcagttctcagatgcataaggttcacaaaaccgtttgctgaccgaaaatcgctcagtgttggttttgtcagttttggcgaaaattgtttgaaaagagatggaattcagataaattgtcaaaattttaagattcaaattgatactccaacagtcaacagagtggtttgtcaactcaagccagctcaaaaccacgaaatgtcgtgaaaaccaagtggttttcgtcggttctatgaacctcaaacgtggaactggtgctcttcgttgcatgatgaggcagcatcgccaatgtgaaaagagaactgaaatattcatggttgatcactttcagcattctccaacggaacaaaggcattgtttagttccaaattttttcttcaaacttcaaaacttttccatcacatcaaaacttttctacccacataaacttttaacttttccatcacatcttccaatttcaactaaacttccaattttggcgtcaactaaacacacccaaagactgattaaaacaggtgtcatacccgaactgtgtttagttcacgctaaaattgaaagtttggttcaaattggaacaatgtgacggaaaagttggaagtttatgtgtgtaggaaagttttgatgtgattaaaacaggtgtcatacccgaactgtgtttagttcacgctaaaattgaaagttttgttcaaattggaacaatgtgacggaaaagttggaagtttatgtatgtaggaaagttttgatgtgatgaaaaagttggtagtttgaagaaaaactttggatctaaacacggcccaaatctgctagtagagcatagagatagattggtgaaaagagtactgta

SEQ ID NO: 33021 - DNA, 1501 bp, Oryza sativa
gtcctttcatgtccttggctccccgcatctttcagccatttcctttcgtcctagcctcctggcatatcgtcctaggctgacttgctcggccgccgcccgtacagcccaaatactcggccagtcggcctggcaaatgaaatatgcttgcttgttgaattgaaattgcgcttgagttgtatgcgtggtgaaaaattctctcactatgcttacgcctatcttgtcaggaggcaggcacgtaactttgcttagtttcgcttgtcgcagtctgcttattagtgtcatactcgctccattcctaatcgatcttcatatatgatttgtgcatcaataccaagacaatcatgtggagcacttaatcagcatcaaaaacatacattagcgtttcgtatccgtgaatgtaacgccatcaattttacatgccgtgtggctggccaatcagttgtgagcgtattaaatcgatgcatgcagcggctcctaatcagttctacatgccgtatagcctaaccaatcagatgcatgtagtgttcgttaggaagtgtcattaacgtccttcccgggattttcatctcctccccaccgtaatgcgacaatcaaaatggaattattattttttttgcaatacgatgatcaaaagggaacggagggagtacttgcttattagtgtcatactgtacatgacctcctatccccaacaaccgtctccgcgtattaccgttgtatgctactcttttctaatatattgacgtgcaaaatttctgcacattcgtggaaaaaaaacacacgtccttgatgataagagcaagttcaatagtatagccaactactggctccaattcatctatagccaatctaatacatattcatacaatagttacatactacactatcaataactggtcccacctgtcatacacacattatgtattggagtccgtattacagctggctataaatctgtagcccgctacacttctctctcctcatttatcttcttaaaatatatttgtagctagcttatagcctgctattgtatctgctctaacagaggccagaatgttcgggcctgatccccacgaggccaatgtgtgtcaacatgctgtagctgaaagcctgaaatcaacaatgccttgcacgcgttgttgaccaacctggacgcgtgcgccgcttgtgcaacagtgcaagtcagtttcggactcaccgcgcgccatgcggttgttgactgttgtgaatgggggtagaaatcgcccgcgtagcagccgcgcgaagccacggcgagctagcgcgcgcggccgcggccgcggaacccgccgtgcgtgtgcgcttcgccggatggtagcgttcatgcgcgtgaaaccgctgaccttgggttccatcacccacgcgaccttggccggccgtacactggctgcgcacgcatcacttcccgtccgcgattggaaaaagtacgcaccaaaggtccctcaacttgtcaacgagttataaaattgtgtcctaaccacaa

SEQ ID NO: 33022 - DNA, 1501 bp, Oryza sativa
caagaaaacaactggatgagcaggctcctatagtccggctacatgataatacaaggagtccactggagtactggaccaatgtgtgccaaatttttttgctgatgcttctctcatctgggaccagcatgtggtggctgtagtcattactggatgtctgattgctaccaagatccaaaagtcatggtgtggtaacagaagcctgtcctttattgcgcccctcagaaatttctatgtttatgtaatgtggtgttgctattgttttactatgcaccaattaaccggttttccggacaaatcttgctccctgtctggaacacagaaattttacaggactttcacaaggtatttgtaaagtccccggaagaactaataaaaactctccatctctaattttgtattgcgttgaaatactagcccatctctaatgcaaagtgcttaaggaagtcctcataaaaaataaccattttatcttgccatgtaggatgagatattttagggtctattcggtttggaaagaatttcacgagaactttgaaggattttttgtaaaaataatgtaaaattcatacgctcccgaaggagtcgtttaatcctgaaagtatcaatgattaactaagcaccaatacgtagcaggtgctgtaaaacttctcttggctactttgatttaaggaactagatgaagatatggatacttctattcgagtggagagttcttatatagatggttaattacgcagcctatatattaacacacttgtgttttttagtttctagcagctacatcattttctataatccttggccctaaaaacaagtccaaatttttactaagattatgaaaatatatagctgtatttaaaaagaacaaaaccagaagctgaaaatttacacccaacttttctatactctcatcagctacttctcagaattttaaactcaataagacctatattaacactcaccatacattgagaaggcttaggccctatttggcacaacttcaaatataagatttttcggtgttgggtgttgagtgttcctaatttcataaatccatgaatctggatatgcaattactttgataacatttgaataatttattttgttcctgtttgaaattaaatataaatatttaaaccactataatttaatacgtaaagaaacagcaactaggttggatataatatctggtgacaaacaatacctgcatatccgcatattattgcgccagaacagcaaccaccgttctctcacctcaaactctccaaagttgaaacaaacaggcgcacaccgctaggccaaaactactctctgcctctctgaaccaaatctaccgctaaagaaagggaaaaaagaaaaaaaaaacagcgagctcccaccacccaccaataccagcggcagtaaattttgagctgcggctgctgttgctgcttggactccacctcggcacctcgcgttccccttcccccctcacctcgcctagggtttcgtctcggctcgc

SEQ ID NO: 33023 - DNA, 1501 bp, Oryza sativa
aaggaccacacgatctgaaacgtaagaacacatcggaccacaaacactagtactactcttcaattttctctcttgttatatagtactgtacagcactgatgctcagtgcaagatgatgtataattggtactccatttacctacgctggatcaacagttcttgattcgatagaaaaagaaaggaaagcaattgcactgaatatgctttctcaatgatgatgaatttttttccgaatatactttctcaatgatgatgaattttccttttgggaagtacattaacaactactccatccgttgcacaatgtaaatcattctaccatttctcatatttatattgatgttaatgaatctagacatatatatctatctaaatttatttacatcaatatgaatatggaaaatgctagaatgacttacattgtaaaacggagaaagtccgtagaaacagagatggcacaacacaagtggactggtggaacactggaaatgatgcggatcaaaacaacttcagggaacgagagaaaacatacccaagattactttggtggtagctggttgcctggatgggtatagtgacagggaaaaaggaatgtactgggtggttgttgatgaacgtgagacaattccaggatatatggattaactgaagaacggagaaattacccgttgaactggccaattgggtagttgtctcttccagctagctatagaacaaagggaatcagctcggtttatttctcgctggtttgtagttctgacaaaatctgttggacatcaatccactctaatcgtacatttcattgaggcacataaagatgagttgggtacttgggttagacttagagagagaactggaaaaggagttcagggactttacttgggctcgctcctcgcggacggtagttgtgaggtgtgggccgagattaaggcccatcctcgaaaatggactcgtccctacctcctgactaccattcaaatacggtacactactgactggacaatttttttgagaactttgaacttcgccagaacatcaacgaaatgtacgatgagagtggaataatatccaacaatttttgtcagaaatacagaaccagcactcagcagggaggataagggtgtgtttagttcacatcaaagttggaaatttggataaaattataacgatgtgacacgaagttggaaatttgtgtgtgggaaagttttgatgtgatggaaaatttgaaagtttgaataaaaagtttgaaactaaactcggccctagctgattccctttttcttccagagctgaagagaagagttcagattgcaaatgtgtcagaactacagactggacaaataaacctacccaattagccagttcttctggatagaagtagattgcaaatgttcagatatgtaagattcaaaacaagcatgttgttaatccgttatttactatgttacgtgattgttcatagcattatactacaccactttaatactttataggtacacac

SEQ ID NO: 33024 - DNA, 1501 bp, Oryza sativa
ttgcaagttgcaacaactagcatcttgatttagcttggattcaagagattttttgggcaaattaattgagcctgatcaaaagatagcatgttgattgagtactatcttattaaaaggcatcaccgagaaaacgatagaccacgtcgaagcagccattgctttctccaagaatctcaaataaagcgacaattcagacattgatcagcagctagctagctagagggtgtgatacagattcatcgatgcaccatggcaagtacatatgttgcatgcatgcatggtaaatatgcatcgtaaggaagatatgtatcccggtgctttaaaatacaaaagaaaagggctcgtagcatcaagtattatttaggcggagagaattgattcaattgtttggaaacacatcatattctcatctacacaatcaattaaaacgacagaacatagctaataattactcttaatttcagtcatgtgcaacaaatatgatgggtgcttaaaaatatacaaaggactagcttgtagtatgcatcaatcctttataatctgcgatcgaattgagttgctagaacatatattgtccacgacaatttgtttttctccaagatcatatatattctgcaaaatcaactaaaatggaagaacatagccatcagaacgaagatttgacatagttccagttcacaagtgtagcctagtggttacaagagcctcagtagcatctaaggtcctgggttcgactcctcatggaagcgaatttttcaggatttaatggcattgtgctttcagtggtaggaatttgccggcccagtcttcgaagatgctcataggggtagggtttgcgtgcgtgtgttcataggggtgggtgcgcgtgcgttgtactgtgtaattctcaaacaaaaaagtatagcttttgaatagatattgttgaatagatttgacatatatagttcctgttcacaagtatatggttgaacaggaactatcatcagaacgaagatttgacatactcaaacgaagattttactccatactcaatcatatctattcaaaactatgtttgagtatgaagtaaaacaaagacgatcagctaaggccacatgttgataacaatatctccctttctttcatcttaactaattgatttatgatcaggttacaaatagaacacaaaagatgcaaccatttcgtgtacatatatacgctctaaagtatagtgcaaaatcgattcccggccctacttaaacctttgacatatatagttttttttttaaggacggactagttaaaatctctgtacctacaaaacaatactcacagcaagtggatgaaatttatcaggtgtacatatttgcagttttaattaactcggcattatctccaagatatatatatatatagataaattcttgtcttatgatttttgccaagaactagctagctggaaactgatgataatttcaaagagcttaggcctcgtttggctaatgggatagggaaatgattt

SEQ ID NO: 33025 - DNA, 1501 bp, Oryza sativa
gtaacgcaaacaatttttcgtttgcaaccaatgtgatgcaacatatccaatagaagcctggaatcttgagttttttttttcttatcatgaataagatgaaagttgctaagtaaaaccctcccctaaaattaattttaaaatcatattctaaaactcaatatgaattatagtgttttagaaaaagtacgaatggacaaattgttttatactcctaagttgttaagaaaagcaaataaatttctttagtacttcaaaactacttcctccgtttcacaatgtaagtcattctaatattttctacgttcatattaatatgaatgtgggatcctatatgtctagatttattaacaatcaatgtgaatgtgggaaatgatagaatgacttacattatgaaattgatagagtacttcatattactcctaaataatattaaattgttagaatcatgttttgtagtctaaacttaattagcaccgtagaaaaaggacgggcagagagctcaacatggtctacggccgagaaaacgatgacagttgatgggatcaatctagtggataaggataaaaataactggagtgctaaatgagttgggttttcagtttttcacccgatatctataaaaggacaaacgggcgaaggctgcacccgctaggctttccccgatatgggacgattttttaggattttgcagtagtggtagaaagaaagcgacagctatgatgattggctccatcgttttgctacctgccttttatcctcagaacctcgatgacatgtgggcccggttctcggggcccacctggcactgcagttggaggcacttctatagggtggattggaatggcggctggcgtccgcggccgctttccttttcctttccttgtaaagctatcctgctttccttgctccctctggttgtcacgttgtgtcattgtgtgttccattgtctcccctaaaatgcgattatatatacagtacaatgtaaaatactgcgtatgtaatactttatcaattacacgagggacgtgtatgttactacccatatacaagtaacaaaacacacgcctaattaagttgtaattctacattgattttttgttagcatgtttttcaaactacaaactttctaagtcccattagttgctcagagccaaaatttaaatttaaatttaatttttttaaaaaaaaattgaagttgattttaaatacatttaacgtagttctttttttatattgacttttaagtcactaagaacacatatataaattttaaccataaattaattttattccttaataaacagttttagtttgttagaaaaatatagtcaatcaataaggacctctatatagaagttgttctaaaatagcaaataaatttatattcaaattcataataattaaaactcaattaatcatagtctatttccgtatcgttacttaggttgtgtttagatggaggggtgtaaagttttagcgtgtcacatcggatatacacatt

SEQ ID NO: 33026 - DNA, 1501 bp, Oryza sativa
aacctttgattaaaatatcggatatcgctaactcaatcctttgtttggaaaaatggcatgatatatcgaagaaaattacatgaggccggtcctaatcttctggatggcatgtggtgcttgagctaagtcatcagcgctatatttgatctgatgatgttggcaaaagtggcaaacacgttgttggtgaccaacaagggagaaaccggggaaaagaggaacatggcgagaaagatgaggaaaaacgtggaagaaggatgactagaaagataacccagcatgaacaattaattaatacgatggatgtggaaatcacagaggaatttcttcttcgttacccaatggatcagatttaatcatgatttgattgggtagtttaggatatgccaaatattgtccccacctgtgtagtaatctacaactatattcacctgtaagcgtagaatccattttttttcaaggaacaatgcattgaagtgataaacaatatagattgattcagggaacatatggcacatccttttgcacaaggggaacaaattattgggacaaaacgacctagaggatgagagaatatcaaactcttccttattcctttagctattattaacaacacattatatggggatgactatgactcctagtcggtatgcatcatccgacaaaagtgcattttcattcgatggattgattcatcgcccaagctaaccatggagctatggtttcttggcaaaccgcccttagagacccgcaggggggggggaggggggatatatcggatatatgaagtgactagagtagaccaagtctattagcgatactttgaactataactttattaatgccgaaagcaaaagataaaatagcaaactatcctgatcaagtaccatatgaaaagaacattgcaagccaagtcatgccaatctaaggagcgcaaacaaagtacgaagatcacggtatatacgagcactccctacagaaataaagcaaactttatgaaataattagggcatatgactcattgagattttaagtcaagcaagtagctagactagactaatctagatagcttaccatatttatatcttatcttactgaaataatgcacaataattagggaaaaagtaatattacaaaggacaagatttatatacttaataccgttgagcactgaagaaagaaatagaaagggtgcaagggttacaggagagtgtgaacatgtagctaagggatttctcataaatgtaaaagcatttttgttcttaaaaatgtataaaaaccatttcccatcttacaatttgtgattgcattttttggaaaaaaaaaagagaaggaatccacaaaagtgcccaacacaaagcttcgaccattgccgtcccaagcgttcaaattttccacctcgaggcctacgggcggcctgtacgatttacctgttggttcggtcgctccgttcctccggcttccgcctttcctcgtcgcggctatacggctattatacctacca

SEQ ID NO: 33027 - DNA, 1501 bp, Oryza sativa
gggcaataactgggccggctaccattgacaacgcaaaccaaaggaaacaagccggccttatgcgatggtaagcccacacgagagaacagccaggtagggattatagcccaacgctcccatcacgacccactacctttggcccatgggagattgcgaatcgcggacgaaaaaagtgcaccgaagttccctcaatttgtcatcgagttacaaaatcgtcctccaaccgtaaaatcggatacaacgcatccctcaacttataaaaccagtgcaaactagaaccctcgatagttttgactctagttttgtctgacgtgacagctgacttagtatagtacccatgtgggccccatacgtcagggtgaccacgtcatcatcatctctttcctctcttctctcccttccttctctctctctctttcccagttttctcctcatacgggccaggcggtggggtgatgtgggaaagggcagctggcgacgggcggtgcggtggcgcgacatcggcaacactagagaaggggcaacgcggcggcgacggcgggtcgggagcaggcaggcgccgcggcggtgggcatggaggtggagtggttgcgggacggggtggaagaagaggaggtcatcgaggctctagcacacgcgcaggcggcgcacaccggggatgggagtgcgatggcgttgcggtagagcgagcatgaggcgtgcgcacggagccaaacatctacgcagtccatgtggaacgagtgcgcgcagagcggtagcgtgcggagctcgtcgccgtcggcaaactcgagcaggcacacggtgcagacgcgtgcggcggtgtcgtctcctccgcctcccccgccgccgtagccgtgcaccgccatcaccgacgacagcaacttgatggcggcgccgttgaatcgatcttggtgcaggcctttcatggcttcgggttcgaccgtcgaggtcctccagctcctccattgcttgtctgttgcctctaagaagctcaccaacggctaccacggtgcctgtttccacctctgtgcccatcactgcggcgcccgcctgcgcccaacccgtcgccggccgccctttcctgcctcgcccctccagctgacccacacgaggggtgcggggaggccggcgagctcgtgccgctctgagcccgtgtgtcgccacctggggaagctaagatccccgggagccaccgtcgccagccgcaccaccctttagccgcgcgcgccaccgtgggcgccaaccctagtgccatgcctgtgtgaaagcagagagcgagagggaggaaggaaggagaaacatagaaagtgaagaggggaaagagagtaggtgctgacatggacacaccgacatgtggggtccacgtgggttccatgctggctcagctaccatatcggataaaaccgggatcaaacccatagaaggatctaaagttgacggttttgtaagttaagggatgtcgtatatctagttttgtggttaggacacaattttataactc

SEQ ID NO: 33028 - DNA, 1501 bp, Oryza sativa
ttcgcatcactcttgtgcgagtggctcgggagcgaaaccctagccgcccgtgccgccacctcccacccaaccttgacacctcgcctccgtcggagttcgccgtcggaaagtcgagcgaccagctgggaaggcggagcagccagctgagaaggcggctgcagagacaagaagacctgacgaggcccgtcctcggcgtgggaggatgaagtggtgcacggcggtagccggaccctggcggccagacacggaaagggcaagtcggatctgatgcccctcaaggcagatgcatggacgactgtggagggcggccgcggaagcgaaggtggtggtaatggtgccagatctggtgctcccatatccaatttcggcagcgatgcaatgtctcagcgcggtaacgctgcatcgacgaagggcaattgccaatgtttggaggaaggtggagacgacaacggggatggggagaagcaggcagcgactgctgggtgtggggctcccaaaggaagactggcttagtacgaggcgcatggccggcggtgggtggccaacgaggcgcatgcagagcatggcacagaggcttgtggtggagctcccgaggggaagttgtcgtggcacggaggagcacgaccggcagcgagaggccagcaaggcacgaggagagtgcgctgcggaggcggtgaggctgacgcggaggctggagcggtgtggcggcgagcctgtcggggtgggagcatgccaggcctagggtgatgcggcggcgaggctactgcggtatgaggacagacgcaacaacgatgcgatcaggcgactcgttggagagacatgggtagcttggtcgaggatgaagtggtccttgaaggctacggcgagctcctttccaagcgttagtacccttgcagtggcggcttgccgtcgcaagatggccacgttggacgggctagtacaggggagaggggatccattcttctctctcaccatcttcttctccaacccacccatgtggatggatctggagcgcaccggaggtcgagatcctactttgatagccggccggcgacaaggcgtcggcgtggtggctgtgcgttgaagaggattagctagtggtgattgtcaaaactaacaggcactcaataacctgggagagtagggaaaatatgggcgaagatctagccttcaggatggctatggcgacgcctgcgggcgccgcgttctccttgggtccttgttgcgttttttttcctctcccagtggtttttttaggtgaaaaccatatcctgattctctaggatgggcagcggcggcattcttggcgccgtttccttcttggaggcgtcgttagaagatccattccttaggggtgttgtgtgcgtgttttatttttttagcagcaagatcgatcagacgtagacgcgtggtttggttgtatttttctttttcttgactatagtcttctaggactatagacttgtattttatttctactatatcaatacaaacgttgcac

SEQ ID NO: 33029 - DNA, 1501 bp, Oryza sativa
agccggcctgatgtggtgggccccatatggcagccgatgtgcgtgtggcttgccatgcctagccactgacaaagtgacatgcggcagacggtttgccccgcccagtcaatgaacaggtgacaggcggcggcaagttaccccgcctcatcacatcgtgatggtggggtttttttttctagcccctagatccgcccagagctggttcatctgctctggtctaaagccgacctcctgtttcccggtgtaaacaggagcccaattaagagtcttcatccattaattggcgaatgacacaatgctccctcgtgtctagcggctcgatttgatgggcccatgttgtggcggtcgaggatgtggtcgtcatgtcaatagaataaaacgtgctctttagcataatcaattatgtcgatgatataggcccgggggtatcatgtttggagggaggaggccgcccctaaacccacgtagcacttccccgaggagggtcgggcccggggtggagtgacagctgcccctccttgcccgagggtatcaaaactagaggaaggaggctgcccctagtgcccacgtggccctctcccgagcggggtcgggcccggggtaggggggcggccgcccccctccgcgaccgggggtcgggcttcctcgaccccctccgcgggtcgccacgtgcgatgcgttaggtggccgcccccaagagcccacctacccgcatttatggcggcatgcagcgcgtctgaccggtccgtgaccgatcgaataaccgatgggactaggggtagtgcacctgcgcactgtccgtctgtcaagcagcctacagccttgaagtgccccgtctcatcataatgacgagaggctttcagcctctcattccagctggagtcggtccgcccgctctggtcaaagaaaggatcccgtttcccggtgtaacaggagcccagaagtctccatcccttaaatgggagatgacgagggcaccccccgtgtcaggtggcctgttctaatgggctcaccaccaaggcaatgtgcatatggcttccgagctaaggcacaagacatgcatttaatgtagagaacattttccctcctctctaggtagctcttatggcatatgtggtaaccccttaaggtacaaaaggaggtccaggcctacgaaggaggtggttgaaacctaaaaattctgaagggaagctgagtcttagcttcctcgctagagattcagagactttgtaatcttagaaaaattatcatacacatgagtagggtattatgctccttagcggcccgaacctatctaaatctcttttgtctcacccctctcgagggcccgaccccctcatttcttcaaatacttccagctcctcaattttcatccactgccctaggccgaactaacaaaggaggagcctcacggtcccccgctcgaggagttcatcctccgataaattccttttcgccttctcccctaagtaatccggtaaactcctgtggtgcctcctta

SEQ ID NO: 33030 - DNA, 1501 bp, Oryza sativa
tcctcggggaccaggcatcttcatcatcatgtaagtgtagtgcgggacggccatgaacttggctaacgccgggcgtccgagtatggcatggtatgctgtctcaaaatcggtgacttcaaagctgatattctctgtgcggaagttttcccgagtgccaaaagtgaccgggagggtgatctggccgagtggagttgcggataatcctggaattactccgtgaaaaggcgcattgcttggttttagcttggagcgaggaatctgcatatcatccaaggtcttggcgaagaggatattgagtgcactgcctccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagctccttgcggtggtcttgaaatcctaccggggtgtcgccgtcgtccttcttcctcgacgtgctttgttcttcgtcggagttcttccgtgtagtcttggtgtattgctccgcgaattgcttgtagacgaaacaatctttggccacgtggttggagttaggatggtgcgggcattgggagttcatgatcttgtcgaacgtgttgacgcgcgaacgctgtcgagaagagtgaatggcggttgcaacaagttcctcaggcttacgcttgcggtccttatgattgttacttccacctcctcccgtagccggcgtatccttttttggcttccaactgggacccgactgctttgatgcggtgacggcgtcttcggctttggcgtactcgttgactttttcaaacataagtttgactgtcctgggaggtttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaacaacgttgtagaggtcgaattgtgtgccgggacgctcgaaggtgccttggaagttggcgatgaagtggtcgcgtaattcggcccaagatccaatcgtaccacggggcaatccatggagccaagatcgggcggaatccgctaaagccactggtaaatagttcgccatggccttgctatctcctcctgctgcgcggatcgcgagaccgtagacggtaagccacgattctgggttggtggtaccgtcgtacttctctattccagtcggcttgaagccggctggccaatccactcgacgcaggtcgtcggtgaaggctgctactccatcaaggtcgtcgtcgtggcggtccggcgaatgatgatggcctcgagctgctcggcgctgtatgatt

SEQ ID NO: 33031 - DNA, 1501 bp, Oryza sativa
ccaatgacgggtagtaggagcatgaagaaactgacaaactttatttactgaataagctatgtcaggtctagtcaaggtcaagtattgtaaagcaccaactatacttctatattgtgttgcatcattaggtcccaagggtgatccttcatataaagttaatttttcactgacagagagaggagtactaactggcttgcagtttgacatattaactctttttaataaatcattagcatacttctcttgagtcaaaataataccattggaaactttagttacctcaattccaaggaagtaatgcaggtcacccaaatccttaagtgcaaactccttgtttaaatccttcagaagtgctgtagttgccttctctgtagaactagctacaattatatcatcaacataaaccaatacaaacataattatccctcctttgttaagaaagaataatgaagtatcggcctttgaagcttcaaaaccaagttcaacaagtttcttactcagcctggaataccatgcccttgttgcttgttttaaaccatacaatgctttatccaatttacatacataattaggtttagaggatgactcaaaaccaggaggttgttgcatatagacttcttcttgtaagaatccatgaagaaagacattttgaacatctagctgtctaagactccaacctctagaaatagcaatagacaggatgattctaatagtagcagctttaacaacagaactaaaggtatcctcatagtcaataccatatctttgtttaaagccctttgctacaagtctagctttgtatctgtcaagtgttccatctgcctttcttttaatcttatatacccatttacacccaataatattttgtcctttctcatacggaactaggtgccatgtattattttttatcaaagcatcatactcagcttgcattgcagctatccagtttttatctcctagagcctctctattattttgtggcctctctatcattttgtggttcacgagtagtgtggagattatggatatctcatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattttctccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacagttggcgcgccaggtaggggggcgtcaagcttttcgccgatcagtgcaa

SEQ ID NO: 33032 - DNA, 1501 bp, Oryza sativa
tgtccgcaagagaaaaaaaaaaggtcaacccaaccactcggagaaaaaggtactccccccaaaccggaggagatgacgcaaatgtgatcaaacttttggttcgttggttggtcgttctccgcggcggaagtgaggtagcgagcgaggcgggcgtgcggtagcagtaaaagggaggagagagagagagagagagagggggggggggcgctgccaccgaccaaagcttcgtcctcgtgaactctgatcaaagcatcgcaaccaaccaaggctgtgttcgcatgtggatgatgggaacatagtgactccgcacggaaaacggagcaatccattagcacgtgattaattaagtattagttaatttttttcaaaaataaattaatttgattttttaaacaacttttgtatagaaactttttgtaaaaaatacaccatttagcagtttgaaaagcgtgcacgcgaaaaacgagagatttgggttgggaacctagaggtccgaacacaccccaagtgaccaacccctcctcctcctcctcctcctcctccccgatgtcgtttcacttcaccgcacgctcgctttttctctgaagcgggaggcagcaacagcaagcacatggccgtcggcgcgcgcgcgcccgcctctgcctttcccccgccggaagctttccccgttgtccaggcgcgtgggagacagacaggtggggccggccgaatcgttccctctgatttccattccataaagtcggcgcggttcgtggaaaggaaatcgttcacctcatcacatcaccttcacctcacctgctcgatctgcaccttcgcgtcaagtggcattcaattcctttcctattcttccacaaggctcgtgacggacgggaaagagagaattgaagtggcactgtggcagctgcagtagtgtagtaaaatacaatacggagtactactattctactccgtactctaatctactcgtactactagtacagtgcagtggtacataggaactatctccgttttaaaaaaaaacaaattacaatggtgcacattcagtgctaagttggttttttatgaaatagagggagtactcggctaccggtagatgctaggggtcaaagggagcgtagcctgggagaggctgtcgtttagcctgcactgtgaaactgtgagtacgtctgctctgctgtccttctagatttggtcatgactgtacgttgtactgctagtattctttaattgccgattgatttgtttttgtcctcgtctcgttgacacatcagaggatgaatgccttttctgtttgcaggtcaagtgctcgtagtactacgtataacatcattttactgtcttaagagcctatcattttacggtgtgtattttgttgaaatagtatgtgattgtgcataagtacatgtttgaaagtttatgaggttcatggttctaccatgaaagttcagtggtcatttgataaaaatatgcttccaattgattttggagaattgtaccgagt

SEQ ID NO: 33033 - DNA, 1501 bp, Oryza sativa
aagaataattaacgttgcatgcttgctctatctgaaattctgaatgaaagtagctttatgcctggtttgtctctctctcatccgtggttagaactcagaacaaaccgctgcctgcttccctagcttgcttggctgttgctgattactgtgagcacctttgatcatacgttgtcatggactcctgaagcctcatctttccgcttatgcttatgcctatcaaccaaaatttaaatttttaaccttaaatttggagttgatttcggggttttttcatcgaagtttatttttaatccttgttttagatagttaaaaacacacatatatataaatttattcacaaattatttttcatttacaaatatgccgatggtagatgttagctagctttgttcatcggggagggcaggtctttggtacgtttccgcgtgttccgtttcacagcaaatcactgtgaaaactaaattgtacacagaatgatgcgaataccacgttttagatgaagattttttttcccggtttggaaggttcggaaaggaggattagtgaggactcagtgaggtgttggcatgttgccgtgttggagcatttgttcctggatgccaatcgtgaatattgatgtcgaaatgcacctgcggccactagtatgttcttccgttccgtccattttgctgctattgcgcatcagtttcatatcacactagccactgggtctcatcgtattcgttgattgacataaccacgcgacatctagccaattgtttgatgcttcaaaacaaaaaacagtttaaaatgcatacatcaaactcattgttcaagccaaattctgtgcttaccatccgattaatcaaccaagagtaaaatgcaccagcggtttttaaacttgtcataaggtttcacttaggtccacgaacttacaaaacgcacatcgagatctctaaacttggtttattgtatcatcctaatccaaagtctcgtttgaccgtggtctttcctacgtggcacaccatgtggacgatgacatggcccttttttttcctttttccccgttttctttttcctcatcttcttttatcttattcctccgcttagcacgacggtggctagggtgtcggcgacgcgcggccagaagacggtggcgagagggagcggcatggaggatgcgatagagggtacgatgagcttggggagttgggaaaatggtggaggggagcaggggtggacattatatccttgggaggctggaattgtgcccagggtgagcagatttgaagcgggaggggaaggcgggacaatatctcgggcggcttgggtcagccgccggtttgtgtggggaagtgggggaggtgggcgatgaccgtgtcccctgcacgtgcggacgagtcgggaaggcgcgaggacagtgacgtcgtggggagcgacgtgcacaggaggggtgtccatggcggttgccggtcggaggaggaagaaggccctgacaggtcggcggcggaagggagaaaaa

SEQ ID NO: 33034 - DNA, 1501 bp, Oryza sativa
atcggccctgaattgtagtaaaacagacagtttgctccacgacgaaaaagtcgggaaggtaataaagaaaggaagaaagcaacgcaggctttgttattagtattgtcattcgtgcagccttgcttcccggaaacttacacgaggtaaatggctatagcaactactaagtactagcagttggacaatttttatctcaaagcgttgcagacacagcttctccgtatcgtttcctcaacaacactgcctgacaggcggtccacaaaagaaaaataaacggagggcccacatgacagtctcacgtatacgacctaagggcaaaatctgccggtacatgtagccatagtaggacactaacgttttttctacagcagatgatgtcacgcccaacgttgttcaccatcaaccgaattaaactacgcaaagcatgttggcattagtgcgtactccggactttaaaaagcccaaacaaccagcgataacaaatcaatcatcctcggccacgccgtggatttttttcttcaccgttttctgtggctccccaagttgcgccccatgtgcacccgagagaatccttttaggcaatctagggcctttggcgacacaaaaagaattcccccgattccccctcgccacgttacgccttctccgagccagcgagaaccaacacgagcacttgagccgttgagcgagagacgagcgcatctcgccgtgtgccggtgtttcggggggtgcatcccgcacgcacgtgccggcgccgcgcccatgcgctgtggctgccgcgctcctgccccctctgctcgctacaaccatagcagagaccacacaatactatagctctctcaagtctcacccatgtggcgctagattaacctgcactactagtactaaccacgccaactgaaaacggtttagcgaagtcgcggtgaaccatgtggtgcatatgctactcacacacggcctgcgcctgcatggaacaatgatgcaggcacggctcgcgagagagagagagagtgttgctgtggcgaagttggctactgttagagcaagtttaatagtatagccaactaatagctccaattaatctatagtcaatctaatagcttatttatacaatagttacatactacactattaatatatggtcttatctgtcatacacacatcgcgttttggagtctgtgctacaactagctataaatcagtagccagctgttcttctctctccttatttatctccttaaaatatgtttgcagctggtttatagcctgctattgtacatgctcttacctcagctcggctggacttgggccaaaatgtccctctcctagcggaggaaaaaggtggatgaatagagagggtgattcttcccggtgagattagctagcggcacaccggtttcaaaaaggttgacgtacgctgttgctgtcgtgtcaatagtaacagacgccagtgaaggtgacgagaaatgttttcttcttcagagcgttgttgtcaagaaaa

SEQ ID NO: 33035 - DNA, 1501 bp, Oryza sativa
aggcaggaaatcccacacagaatcatgggctttggttgtattcctttaacaatactcgggagcatctaatcctacgcatctaatggaacttttaaaagtagctataatgtcagtttggcacaaattatatatctgtgtttgcatcatcaccggctccaatttgccggtcagtttttttattctgttgtgtttttctttctatcattgttgagctaatcctgttttgattgtagatcgatctcatcgacatgtatgtatgtagtagtttatgggattcctgattgctccgttccatccttgatctttcaatatgactcaggttgccatcagtgagattgcaaaggggacaggaaatcattcatttgagactcggacgttgccggatcgacagcatctcaattctgaaactgtggcaaaagctagcgaccaaacctgtaatttgcaggtaaaggatgggttacagctaaccgtatcagacttttcctgctatagagacccgctagtctgttgagatgttgagttgtaacggtggcgccactggtttgatttcctacccctgaagttctgaaatctgaacttcgcaagctgcagcactgcgagcgtgcttgtaatgttcaaacctaggttgcacctactagataagcgtgcttattatgtgtcacaactcacaatgtcacatacttttctctcattcggcacagtttcaatagaaagcatactaaggctgagttcggatgggggagatgggaacccaacttctgcgcacggaaaacggagcagtccattaacacgtgattaattaagtattagctaatttttttttaaaaaaggattaatttgattttttaagcaactttcgtaaagaaactttttacaaaaaatgcaccgtttaacagtttgaaaagcgtgcacgcgaaaaacgatgaagagaggatggaaaaggtgcatgcgaacacagcctaagagtcagcctaagagtgttcataaaacttgttgggtttcacacgcttacagttgagcccagcaaaagcaaaagtagggaagcaacaagtaaagcaagcctcttcggtttcaaatatgttggaaccggggttttcctctctgtttctaaagaacaagtaaataagcttgcatcgacatactaaagacacaactctgtgttctcatcataaagaaatctactccatgctaacatctagaaggaccataaccttaacttcaagaacttgtttttctgtcaggactccttgggcacttagattttgcagcttggcaaagggacaggcccttgatgacctccaaatccccctaacagcttcggcgaaacaaacggcttccactgttgcaaaaaagaaaaagaaaacgacaataccttgtaagccagctgcaaaactttagtaaaaacatttttctttaaaaaaaacatgtccatttcgctgcctataaaacacctaagaattgctaagggaagtaacaaaatgtacatgggggacagttcagt

SEQ ID NO: 33036 - DNA, 1501 bp, Oryza sativa
gatttgatgctaattgttgtttttttaagtagaaaacgccacgtaaactgctgcttaagaaaattggattatcagtgggcgaggtaacaaccacttagacaactaaagaaaagaccaaagtggaggaaatgataggggctccaacgtcagatccattgaacgtttcaactcctctgctcacaccctactcatcaccgagtcacgctgctgagtccaaataaagcgatgcgtcacggctttggctggacctactgtagtaggaccgaacatgtgtccgattgctaccaggcagagcgtgactcggtgcggatgcagcagcacgtaacgacgccgcccacgcccatcagatgcagcaccactttttattatgtgatccccactcatcgcccaacatctgtgacccagaggcgaatacttccaatcgacaaactggagggacctgtcctgctaccgcgacgtagaaacatttctcaccacgcatgctgcttaatctgtgtgaggatagcacaaattatgctggttgtacctcactaatgaggattttagtagtacgggcgtatctccatcacgagatttacctcgcaaaccccgatgattacgtgcaatgcttcagtgctaagcctagtgcacttaaactaaacagcgcgcggatctcgagaaaagctgcctcccaggacgaagcctgcctgcctgaccggccggcaacgccatggatgccacccatctctcccgttttcccgggccgagggcagcagccgtaaactaccaatggaatctcgtggcgtgccaaccgcgagtctgcgaggtgcttcccccactgaccacttctaccgctgaaaaaaacgtgctcggttgccgaggcgaaacctggcgagatctaacggctaatgaaacagcaaatataatcatctgcctaaggggctctttggttttcagggacttggaataagtccctctcacatcgaatgtttagacactaatttagagtattaaacattcactaattacaaaactcattccataagcttggactaattcgcgagacgaattttttagtctaataacgacatgattttgacaatgtgatgctacagtaaacttttgataattatagattaattaagcttaaaaaattcatctcgcggattagctcttatttatgaaattagtttttttattaatctatgtttaatactctaattagcgtccaaacatccgatgtgacatgggctaaaaagttttaaccccatctaaacacccctaagtatatgcttctctccaaagggttcactattaaaaatcaccgatgctgcacggttcgcttgcaaagaaggggaattagtacgtagaatacgtgccaacttgcggagcatccaacttgctgttcacacggtgctacctggcgtgcatgcacgcgccacactcgcccaagattcccatggagcacacaattaaaaaaggagaaaaagaaaagagaaggccctgaatttccttttttttt

SEQ ID NO: 33037 - DNA, 1367 bp, Oryza sativa
aaatgctagaatgacttacattgtgaaacggaggaagtagatgttaatgaatctaaacacaactatgcgtttagattcataacatctatatgaatatggacaatgatagaaagtcttatattgttaaacggagcaagtagtaaaaaagctacgcaacgaacacagcatggagtactaggaaggaaatcgaccgaactaatgagaaatcggagagagctttttacgccactcactttttccatatcaacaggttgcattacaagcacacacacaatgacacaaaacgctgcaccggctgcacgcacgcaccatatttttttgcgaatttgcaaccgtgccaagaaagtaaaattcacacaccaaattgactcctcatctccttgttgcggagatcaggaggaaggaaccgaacaatttcatcgcgaaaagaaagacgcagccggtttgcttctgcttccccgggcttggctttcgttcccgtggaactgtttgatccgcgtgcgctcgactggatctttctccatccgcacacacggtcatggacaagctgtctctcgatctcctcctcgttttttcggttcttgagtttctctaagatctactgttccgtgaccaaaattgtttaccatgcccagaccgggatcctcgggtggctcgccttctgctgcctctgcctctcctgctctgccctccccgtctgcttcgatctctgctctctcgcctcgtcgatctcgatctgctcctgcctgcactcctcgctgcagaagggcatgtcacctctgcaagaacagaaggaatcacaacgccattagaaacacattcttccagagagatttaacctgtcaagagactgacgacagttgtgctgaatatttacctgtacatgaagatgtctctgtttcctccgaggggtctccggcagcggaagcagatgtcgaggtagtggtggtggccgaggaggtcgtcggcgtcgtcgcacgggtcgcagaagaggcggccgccgggccgccgaggcgacgccgcgggcttcacgggggaggcggagtggccggagaagccggcctcgatgtcgtcgtggatggaggtggggtggtagcgcgccatttcttggcttggtttgcttcggccttcggcaaatgagctctctctgttttctcgtttttccggttgggaaaggggagtgatggcggagcgggagaagcaactcgggttttatcatggagggagatggacgggaaggggagatttccgaattagtcctccactgttttgtgaatttctttatgggacttggtgtgttttggctttgtgtagttactgaaatctacatctacattgggctcttttgtaagatgggataattgtgg

SEQ ID NO: 33038 - DNA, 1501 bp, Oryza sativa
cttctcaaattggttctggtacttccagtagcaacagctagtgttgaaagaatattttctgccatgaattatgtgaagaataaattgagaaacaggatgggggatcaatacttgaatgattgcttggtcacatttattgagcgtgagatgtttttgaaagtcaaggagtgtgatattataaaccgctttcaagccatgaaggaacgcagaattaaagctactcttccaagccacgaaggaaccgaaatagaaaattagaggtaccatgtaataatttgtaattttatttcttagattatcggtattgacatactgtgaaccattgattttttttactatgaatttttttgttagacgggaatacccaactttcaaatcctggctccgccactgaggaataaataaaaaatatatagagaaagtgggaaacatcacttctccatgcatgggccctcttattattttttttttgagggcactcttagtcttatcttcatcatatagtagtgtgactagtgtcattgaattcaacacaagtaagaccagagtagacgtaagcaggcttagcaacaacacataaggcatggtccacaggccccatcgcgttgtattttgcaaagaaaaacaaaaagacaaaaaaacacacagaggaatattttttatatacgtaaatgacatattctctacttctcaaattgatcatcatagaacaaaatccaaaatttcttaaattgatcattatataactgcatgatataactgtatggacacaaattttatcggaatacgattaatataacatgagagaatgtgtgcatgctagggcgtaattggcatattgttttaattgatgtatacattgtggaagaatgtgtgcatgttgtcttgattgatgcgatttaaattattattggtcttggtgtataaatatatatgatgatcaatttagaatggcggaagtatttactttgaaacttataaggtatttttttcgcagtacacacgctatttaaaagtagtatataaaaatcaacttaaaagaggagacatatgagattcagagaggtagcaattacattgaaaaaagtggctgaaatcaaatagtatatgatgtcgtatttttttagcaaaaccgttttcttattttacatgtaaccttttgttttgtttccccctaaatttcccttattttatccacgatcccttaaaactagatcgtcactccagttccttgtgatatttgtacctttttttttacaaatattctttcaaaaaatggagaactatcagatgagaaatgataaagttgatcttttccgttgcttacattttgtgtttgagaagtaagcttactgatgacggtgacactaaacagccatgtcttctgtttgcaaacttatgccagaacaagagtctgaccatggcgaggacggctctgcaccaaaagccgccgccgtgcgtggtgggtcaccgagaggcggcgtccggtggtggctgtcgg

SEQ ID NO: 33039 - DNA, 1201 bp, Oryza sativa
ggcgcggccagcagcacgcgctcgccaccgctcccccctgcccccgccccagaccccgcgccgccccgaccccgcgccgccgcgccgacacgacgttcttgatttggttcggccgccgcaccgacacgacaagtgggctgccgccgccgcctcttccgccgccaccgccgcctattctgtcgcctgcctcagtgcgccaaggagcgagagagagaggggaaggggtgaagagaaggggagaagaaaagggattgggctgacaagtgggtcccatattttattttatctattttggctgactagactgccacgtatgcgtccacgtaggaccaaaaccgccctgaatcgatctagggaactaattcatccggtttacaaagtttagggtcaaaaataactggtattgaagtttagggtggtaaatcggacaaccgcaattgttcacgagtgcaattcgtactttttcctacaattaaacagctacatgtccctctatagaatataaataaataaataatgtaattaactaacagtgcaaactatttcaaataacaacacctaaaaaagattcttcgttttaaatcgttatagttatgattcggttacttttttttagttttgaaccttttgaagttttaatttaaaaataaaatctccaaagttatttctaaaagtaaaccttaagctggtgtggcaagagtttcgccacgtcagacatgatggtgtggacaaaagtttcagatttaaaaataaaatttgagagatttcattttatatattaaaaattaaaaaggtttagaagataataaaagttctaattcagtgtctttgaaacaaaagaataaacatattctctccgttttattcaggtaggaatttgctcggtgtacaattagtacattaatttttagactgataagttgaatcataatatcagtatgcaattacactaaatttgatttttcttatttttgttttaaggccaacttaaacacaaagatataaaacacccgattgtccagttgcaaaaccgcatcttcgccatccagattacttggagctccacactgaaacgacgtcatccaacccgcggggtctttgcacgagccgtcgcctccattatatattttgtacacacctacagttgcaaacaatagcagcccaagcatcctgcgcgacacagcaatggcagatgattact

SEQ ID NO: 33040 - DNA, 1501 bp, Oryza sativa
gctccggctgcacccgccgctgccgctgctgctcccgcgcgagtgccgggagccgtgccgggtgctcggctacgacgtgccgcgcggcgcgcaggtgctggtgaacgcctgggcgatcggccgcgacgagcggtactggcccggcggctcgccggaggagttccggccggagcggttcggcgacggcgaggcggccgccgcggtggacttcaagggcgccgacttcgagctcctgccgttcggcggcggccggcggatgtgccccgggatggcgttcgggttcgcaaacgtggagctcccactcgccagcctgctcttccacatcgactgggaggcctccggtgtggctgacccgaccgagttcgacatgacagaggcgttcggcatcacggcgcgccgcaaggccaacctcctgctccgtccaatccttagagtgcccgtgccgggcgtctaggtcatcgacgtcgccggcccagccggcgctatatttacaaggataaaattcactgtgggagttcacttggatatatatatttttaggaaatcattagctgcactaaggaatccgatcgtctcagttagcatgcgagtttttttaaacatatttctcatataattccttctatattaccatcttaaaaaccgactgaaatacgaatatgtatttctaaaagcaaacgaacttaaaaaccgactcatacacggatgacgtaccaaaataccggcaaaaacatttttaatttttataatagtagagatagagatagagatagagaagagatatagactaaaactaaaacataaaattaaagttgactcaaacacgaatgacgaactgcggaaacatcttcaatttttataatcgactcaaacacggatgacggaccgcggaaacatcttcaatttttataatatataatagtagggacagagaagagataaatcatgtatcagttaaagtaacacaaataaacattactgttgatggctgttaagtatcgaattaacaccgttaataccagcataagaccataattgtaaacatccaacatagtggtagggcttatttataataatttccacaagtgttggtgtatatttatatgcaggtgacaaactaccaaggttgagaggaaatatacatgaaggaggatgagaatcaaactcgtatccgaacttaaggagttttggacccataaattaaacacctccatatgggccaaacattcataccaatgaattgagggccccaaaatgagtgtccaggacgaaaaccggagcgaacggagccgtcccgggttcggccgaacccctgagttcggctgaaccctagcagaggccgttcgccccagcccaagttcagttcggtagcaatccgcctcccaatgacagttatggccgttttcaccggtagaaaccgtcattagcttgaacgcttggcaacacaagagagatgatgctctttggatgcttggagcatctccacactcccaaggcactt

SEQ ID NO: 33041 - DNA, 445 bp, Oryza sativa
acatcacagattaaatccaatgaatcacatattaaaaaaaatccggcagcagaggggagggcgccgccggcctcccgtcctctcgcctccgcgccagcacggcccgccgcgcccagccgcctggctgcctggccgcccggccgtcgccgctcccgcccggcctcccgccgctcccgcctgggcgctcgcccgcccggccgtgccgctcccgctcgcctggccgctcgccgcgctcgcctggccggccagccgctcggccgccgccgctcccgcccggccggtgctccgaagaggggaaaggggcgaacgggaaaggaagggaaaggggagaggaaggatcagatagggaatgaaggggagaggaaggggatgaaggggagaggaagggatggagaggaaatattaatgagaggggagaggagatcgagaggagagcggataaaga

SEQ ID NO: 33042 - DNA, 1501 bp, Oryza sativa
accatgacaaaacaatattatcacgccggtctcgctagtgtgatagaggtatttggctacgccggtctcactggtgtggtagcgttatttggttacaccgcttttgctggcgtggcaggataaaactgttacacctacttcaggtgacgtgtcagtgttgttttgccacgccagacgggctggcatggtcagaaggtttagattttggaaattagttttgaaaaggtttacttttaaaattaaaaattaaaaaggttcaaaaaaaatccagtcagggatcccacattagtccacttttgagtatttttgttttgcttttaaccaaacacttttagttttacttgatgcaagatgcaaccactggttttccaagggaatgatgaggctacaaaactttatttcagtgccgtcattttggactgcaaatggttggtaattgctataccaagtactaagattgttgaaatactgtctcaggcgcaacatattattattccctacttctccatccttctcgaccatgctgtggtgctatcatttgtgtggtaaaaaaaggttgctagttgatgaaagattcagtgattcactttgtctatataattgaccctttgtttccacagcaaaagatggtaaaatttgatggcactaagcaaggaaattcagaagcagagcagagttacattcagttaatagtaactcagtaataacagatgatttgatttgacatagtcactattactaacttaagtagatgatttgacatccaactgaacagctgaacctacaccactaattattaatcattttgctgattttgtgccctttcctccctgaaaagctgaaagccaaaccaaagaggatttggttatctgaagatttggtatggtccaaaaatatctaagcacacttgattgccttctaaagagctctggactaaagcctctgtctgactgtcagcaaaggaatcctagtactattatctctctattttacttcagtgcaacaagacacaacaatctgactagattactgagctactatcttgttatgataagaatttgaaagaacttggctgctccattttctgcaagatttctgcatctgtggccagcaatggctccgggtgccacactctttcgcatcagttctctgcttgtacgcctcatttcttactgtaatgacaaactaaagcactaacaaacaaaaggcattagcaaagacaagattatgtacagaactcttcaatgctaaaaatgtacgtttagcagaaaaaaaaagagagtataataggtttgcacttggactcgattacatgagcatggaaacacctgtttaaattactaattaattagctcaaattaaagattgtgttcccatgagcagctgacaaagcctgaatcctcaaagtaaagcttgtacctagttccaactcccaatgaatacgaggctatgagcaaagtacaatggatggcctgagacaacattgtcatacatagtactg

SEQ ID NO: 33043 - DNA, 1159 bp, Oryza sativa
atcaatatggcatcccttcgcgttctcaacagccagcggtaatgcagggtcagtagttctcagcgtgagggtaatctcagagtttatgcgggtctctgaggttgttgcatcgtactcctcgctagctccttgtgctgcttcctttattgtgggtaggtaagtcatccttgactggtatcaagtatcagtcatgatatgtctagggtatcatggctgataccaagtatcaggcctggtaccacggagaatcatgaatgatgcccacaaatatcagccctagtacctaggtaccaagatttgatacctaggtactagccggtacccataggtaccaggtacgaaccgagtgtgagagggagcacacgtcatcgccgctagaccgaccagtgagccccttgctgtcatctcctatcctcttctcccttcctctccttaacatgccccttcccttcccttctgttgatgtagctgacgagacaagggaaaaaataagtgcatttgctatccgcttgcacgttaaagctcagctagacataggaaaggaagagggaggagtcacttaagtatcccgtcctaactggatcctatcgtctagtcgccctctaaaaaaatgactaaggattaacaaacggataataaatactagatcggtataccgttggtcccaaggaacattttaagtgatgatatcacacagacataagtatgatgccttaaactctagtacctaccatgttgatgctgatgataccataggtaacacacttagtgccgatgataccagatacgatacctatacgtaacacatctagtacctagataccatactaacatcatgatgatgtcgacaaacatactccctccgtctcataaaaaagtaacctaggataagatgtaatattttctgatacaaataatttgtacagtaggaaatatcacatctcattttatgttggttttttatgggacgggaggagtgatcggtgaactaatatattgtgaaattaattagtgggcttggcccaaacaagaaatagcccaagcaaatagcccatgtggtcttcgtagtgaggcaccgccgtcgcctcgccctcgacccctcccgccgccgtgggtttccgcctcgttctcgagcgctctcgccgccgccgcggcgtcc

SEQ ID NO: 33044 - DNA, 1501 bp, Oryza sativa
ccataatataagggattttgagtttttgcttgctgtttgaccactcgtcttattcaattttttttttgcaaatataaaaaacgaaaagttgtgcttaaaatactttggataataaagtaagtcaaaaaaaataaataataattccaaatttttttgaataagacgaatggtcaaacagtgcaagtaaaaagtcaaaatcccttatatcatgggatggaggaaataacttttagtatgggtcagtttgcgttttaatgatgttgtaaattacttgtatatccttccttttttttttcttaaagagaaggaaaaattttatgcctcatgagtcttgaattacatgtttttcttaagatataagaatttagtccggataagttccggtttttatattttgagatcgaggaaataacaagctttatttccaagtaatattcaaataactgtttaaaaaaattaaataactcgaaaaaggaaatgaccaaaatgccctcgctcccccctccaccgcttcccctccttcccccggcccccgcttcttctacagttctactccacacctcctctctctctctctcgctcgctcgctctcctctcctccctcgcgcgcgcggccggcgagcggagcgggtcggcaggtgcgcggacggcgtcgtctcctcccccgactccgccgcagcctcccaccctccctgtgccgcctcctcgcgcgcgctgccgccgccggcgagcaggtttggagttggggggcgacgtggcaggcctgcttgctcctctaaccgaattgaaggtatccgtttctcctcccctttgctacttcatgagccgtcatagattggagatccatccgggcgaacaatggattttgtgcggtttcttccattccacacccaatttgttaacccgtacaggttactagatggcagtttgcttgaagagaggattggggaattaatcggctgaacaccgattccccggcgttatgtcctcctctgctctcgtgccccattgactttttgcgttattgtaatggccaaattggccgggttgagtgagccttactggttactgagctgttcttgcttgagcttggagtgaccacattccccggcaagcacggttaaatcctggtgcccgtgaatattacgcatatgcatgtggactttcaaaaggattttagtaagatcagggatgtgcggctggtgtccgtctcttagagcctatgttaagtggtgtatatgcgggggtgtgagtgtggtgtcacgtgagtagtggtgtgtgtgcgtgtgtctgccgtgtaattgcaaaaaagaaaagcttctagtactttaccccactaaaaaagttttggatttctgatgctactagtttcagccacagaaaattgggttgagtttcatttggtggagtgctgtgctccagaaacaagaaaatcttggtgagaacatagaaagttgaatgttgcctgagtgcttaatggcgaaattgtgttggcaggaaa

SEQ ID NO: 33045 - DNA, 1501 bp, Oryza sativa
acctatggtttcgctgctggagactgggtacggcttagggaggatgagaagaagcgatctcaggttggaattcttcatagcattgaccgtagtggtactgtttatgtaggtctgattggagtggacaccctctggaagggtgaatactctgaccttcaaatggctgaagcctactgtgttgggcagtttgtgcggctgaaagccaatatttcaagcccacagtttgaatggcagcgaaagagaggtggaggactggctacaggccgtatttcgcagatactaccaaatggatgccttttcataaaatttccaggcaaatttaaccttggtgaagtatgcagttgcttggcagatccctctgaggttgaggtggtgagctttgacaagtgtgaggggatcgtgaagaagtacgagcacctcgaggatttccattgggcggtcaggccgctgttcattgctgtaggtttcttcaccgctctgaagctaggcatctttgttgggaagggcattgctcggccaagaagtcgaaaggttgccagcgtctctgatcagagtgatcatcagcaactacagcagcaagaagtgcaaaacaatgccaatgcagcatggctccctccaactgtggcaaacatgctgtttagagacggtcctacgctttctggataaaatgaaaatcaaaaccagtgcaagatggagagtttcagaactactggataatgcaacgcccaagcaaatcgtagttcatacttagacctgaaacttgtcttgccacaagacctgtaaatatttccaccttcactctactatcatctccatgttcacaaaaacatgttctgtgcttatgtctgtaaattgtaggcttgcagtccaaatcctgatactgtcttttgcttttgtcattacactgcaatctctcagtatccctggattttctgttcccgatccatcaatttgcagttgcatctgcaacgtgatgaacggcatgcgaatatggatgaaaattgccataaacgctggcaacacaatcaacataggaaattatatggcatcatctgcaattctgcatataatataccttctttccgaaaggacttcattcctagtacttgtccagattcgttgctagaaatgaagtctttttggacagaggtagtacaatttcaacctgattaacaaaagagtttgtatagcagaagtccacaactgaaccatacatgggattggactggctgatactatccaccaaattgcctaatttgtaaagaactaaacctctacaaactacatttttccagagagcaacaattacacaacaccagaaccttctgtgtcaatactttttctgagcatcctctcagctgaaacatgaaagctactagtcatcaagtgatactgtgaagctcgtgtgaaggccttcccatcttctcggagaccaggttcagcatctgaactagaaatcaagctgtgaaccttgtgaggatgaggagcaactgccagatgc

SEQ ID NO: 33046 - DNA, 337 bp, Oryza sativa
agtttcctagtaggagtcctattaggtgtctttcttttatccccgatatatacttgtaagccgtacgggaaggggtggcgttctcattgtgattcccctacgtttgtaatcatcacctctatagtgatcattgccggtcggcgcccgtggttttttcccgcaagtgttttccacgtaaaaattcgtgtctccgttgtgtatctattttcataacaagtggtatcagagcattgaagatcgatctactgcagtcccggctaccggcgatttttcccgatcgaagaaatcgatctaatcggtggcacgcgtcgtcgtgttcgtcgttccgtcgaatcaa

SEQ ID NO: 33047 - DNA, 1501 bp, Oryza sativa
ctcaatctcttcgtgggcagacctgtggcaacagttcgtcgccaatttccaaggaacatacaagcgccacgcgatagaagacgacctacacgcgttgactcagaactcgggtgaatcattgagggaatatcttcggcgcttcaatgagtgcagaaatacaatccccgaaatcaccgatgcttctgtaattcgcgccttcaaatccggtgtcagagatcgctacactacacaggagttggcgacaagacgcatcacaaccactcggagattgttcgagattgttgagcgatgcgcccacgcagatgatgcgctaagacgcaagaacgataagccgaagaccgggggagagaagaaaccagccacggacggatttgagtcaagcaaaaagaaaaatcgcaaaaatgggaaaaggaaagctcaagtggaagttctcgcagcagaatatgtgaaccctcccaagcgcccagacccacaaagtagcgacacaaagaaagcatggtgccccatacacaagacggacagacattccctggaagattgccttgttttcaaaaattcgctcgagaagcacatcgcatttgaaaaagcaagcgagtacgcgtggtcgagaagaacgaggaggaggttcctcacgaatcggatccagcgtatccagactccgacctccacgtttcacacatctttggcgcttccacaacgtactcctcaaagcgagaatacaagaaagtggaacgtgacgtttgttcgacatggcagggggctgcacccaagatgaagtggtctgagcagaagatagagttctcggaagaagaccaccccaagaccgccatcatcccaggacgatatccgatcgtggtcgaacccactattcggaacatcaaggtagcgcgagtcctcatcgacggtggcagctcaatcaatcttcttttcgccagcactttggaagcgataggaattccgcaaagcgaattgacaccaaccgatcaacccttccacggaattactccccaatcatcgtccaaaccattgggcaagattacgttacccgtgattttcggccaagccaacaacttctgaacagagcagatcacctttgatgtcgctgaattcgacacagcttacaatgccatcatcgggagaactgcacttgcgaagttcatggccgcatctcactacgcgtatcaagtgctcaagatgccgggactgaatggaacaatcactattcaagggaacgcaaagctagcggtgcagtgcgacaagcggagcctcaacatggtcgagcaaacgcccagcccactcgccacgactacgccacccaagaaagtgagtaagacaaacaagacgccgaaaccagacggcaccatcaagatcgttccactctccagtgccaaccccgacaagaccgtcaagatcggggcgacactaaacgagaaataggaactcacgctcatcaccttcctccgcgataatgctgacgtgttcgcttggcagccgtccgaca

SEQ ID NO: 33048 - DNA, 188 bp, Oryza sativa
atatgtatgtgtgtatatgtatctccctttgtatgtataaatatgtagatataaacagtgagagtgtgtccgggtgagtgtgttcatcaagggacatgcatgatcttagaattataatatttatgttttttctagagtgtttattcgagatatccttttttcgctttgcatatgtatcccagtgtaat

SEQ ID NO: 33049 - DNA, 1501 bp, Oryza sativa
cgtacgtgtaaggtactctttgagttctatttggaaaccaagacatttaagggtataaatacaaggctcccagggggtacgggatcatcgaatcatacctttgccactagccatagcagaagcaatccgaaggacttaaagccaactcgttgattgatctcgtcgggtcattctcgacaggggtgaactcagtaactcgatggttctgtggttctctattataatctctgtggttttcttcataatcccatataaacaagattgggactattaccttacgaggggtctgaactaatataatcattgttttctgtgtgcttgatatcgtttcgtataaatcctcgtaccaacgtaccctaatacctcagaatacgatctacatgtatcccccgttgacaattatatcgagagtagtttgaaggtgaaacttgggtaaaaaaaaatctttggcccaagatgtaattattataaagaaaaacaaagacatacatgaataaggcaaaaactcatatgcatgaaagaggatgaagtgaagacttgggggcataaggaactttcagaaagtactccctccattttaatttacttatcattctattttttaaaaaagatacttattgttttcacattcggaaaaacttttagcggtatctttccattcctattgtttatgcatgcagacatactaatactactactacttacgaggaattttaatgtttgctttaggaaccacatgaatacacgacagctcaacggtaaagtcctcgttcctttcggattatttagataattgaaatggattgtttgctcctcgattcggaaaaatacattttatcagaaaactttcttctactcagtattgtgttttgtataattctattactcaataatctgaatcaaacatgttaaaaaaaacaaacaaaaaaaacccacatgtttggcttggtaaccatttgtgaaatgcatatcaacaaacattgatcgcgttgcggcaacaaagttaattgtcttactgttccatttcactaaagaaaaaaatgggcaacctcaaatttggaaatttaatacggagtactgtattaattatcatgggcctaatgctacgtttgggcagtcacatcaaatcaatgggcttatttcagcatgctatgtcgggcccaatctgctcgccggccggccggccgtcgccggcgccattgacggcgtcgctcttcctcgccgccgctcgctcgctgccttccaaacccgccgcctcagttctttcacctcaccacccgacgacgtcgtcgtccacgatgctatgcgtgtgcatgccagctgcgcgcatggcgatcaatcgagctggacaaaaaccgagctcttccaaatggagaaacctaagctctctcgccgccgcgcgcgcgcgcgcgccgccttcttcgcccgcccataaatcccttacccagcacagcatcctccgccttcctcgcgcgctctcgcttcgccatggcgtcgtccg

SEQ ID NO: 33050 - DNA, 176 bp, Oryza sativa
cggttcgagtactttctttatcctgatgacaagttgagggaccttcggtgtactttttcctttccgatataagcttattcctatgaggttcaccttctcgattccgtttcagccgggctgggccgtactcgactcagaccggcccacatgaaagcccataccgctaaacaaatagc

SEQ ID NO: 33051 - DNA, 1501 bp, Oryza sativa
tagatctttacagtaagataaaaattcactgatgttgaaagcaggcaggaccatatatactactgtacatatatcgacagctatgtgttgtcaacaacaaagtagttacagtaacacattacttgcaagaaagaatataatgtagtactacacatactatacattgtttccaggcaacaatggtatagaactgttccaagctagggggaaaaaataacactgaaacatgagtaccagctagcagaggagaaaataaaaaataaacaaaaaacaaataaaaaagaaagaaacagctccaatcataaagcaatggattgcaaaatcattcagtggtccaatgcatgtccccacaaacgatgtcattcacaatgcttactttgtcggcccttttgctcagtatctgacaaaggagagggccaaaaaaaaaagagaaaaatgtttgcaaaaagaaggaaaagcatgggttgtagtactactaccaccagtacatgtacaccatcaaggaaaaataaataaaataaaaaaatgtgacaaatgcatgtcctgtgtaacatccctgtgtgcatttaaatgatttgtccggtgtgtcaaggctgttttctctctccgtggcactgtgcgtgtgcagtacagcgtctgggggcgctacgatgagatatgctactagtacatgtttcgaattggccatttatttgcatgggggccttttggcaccgtgcagatgggtagttgcactgatttggaccactgtctagtctactgctgcccattcatgtctgtgtaacctacagctaatcatatctaaataatggttcctaagttgattgcaacgggattgaagaagtccactggttttgtaacgttgaactttactttacgggaacatatcctatcctatttacacgagcttcctgtgcacaatccgtgcacaccacctagcaaatgtcatagaaaattgtaaaaaaaattggacgcatacttctaatagtattaaaccaacctatgaaatcttaacttcaaattcattatattttagctgtaacaaaaaggataaaattctgacagatttttacgataaaaactgtcagatttttcacttttttgttacggataaaatataatgaatttgaatatgagactttgcatatatgtgtaatactattaggagtatgtgtctattttttttctagaattttctgtgatatttgctagttggtgtgtatggagtgtgcactggaagcttatgtgcataggatatattcccgaactttaccaacggtgtttaaggggaaggtggcaaccagggctaaccatcaacggcaatgacgacgatgagctcctcacctatcctttgccgtcgctgacaattccctgtctttagtagagaatctatggatgaaggttatggttttgggtaggagtacgacagagggcaacgaggcgggggggggggggggggtgttgctgaagccccgtgatggaggtcagcagtgggtagggc

SEQ ID NO: 33052 - DNA, 584 bp, Oryza sativa
acaatttagatattttttctatggatccttttgtgttgacatatcatggacaatctttttcacacagtaatgtgcacaaattgccaaaagaatttatgcatgcagggtcttgttgctctcagcaaattgtcctctttttatggtggtaatggtcgaacttcttcagcacacttggattggattctcctcttccacatgcttgtgatggaaaagtaaaaccagaggcatggggtttagaccagaaaggtgcatagtttaatctgttgagttttaccgtactgttcttctacctgttgttgataaactaatccctgcttaacctagttagttaatggaagacagcccctggtacctttccaatggcaccggctgttgactgctcttctgtctgtacattaatggctgtctcttttcagttcacatatatacacacattggaagcctgcagaggcaatcaacccaaccccaggagaagaagagaacacaccgttcagttcatcctcacctcttgttctccacaattgcagataagttgcttcctctttttttgcagagaggagtggtggttttggtggtgcagatga

SEQ ID NO: 33053 - DNA, 477 bp, Oryza sativa
agtggcgaagcacgggtgcgtccctcggacattggataatccggtattgcagtcatgttcttttctccaacaagagttggattaagattaagattttcgtggcacgcggtgcgtttcgtgcaaaaactttctatatgaaagttgctctaaaatatcatattaatatatttttcaagtttgtaataattaaaactcaatcaatcatatgttaataccatctcattttacataaaaaacttaatcttaatcttcatcttcggacaaaagaacaccatgcaaaagtgaaaactcgacgtaaaaatagagaaaccgaaagtgaacttattttattttatttatgggctagaactgaggacaaaatgggcccagacgaagagagacggcccatttggattctggactctgcgaaaccaaaaatcccacggagaggagggcagaggtgggagcgaaaatatccgaagagagagctcgcggaaa

SEQ ID NO: 33054 - DNA, 1359 bp, Oryza sativa
attatgtaggcatataattttacatatttcacaaaagttttgaataagacggtcggtcaaacatgtactaaaaagtcaacggtgtcaaacatttcgaaacggagggagtattttggaacggagggagtatcatctaaaacaaaggtacaatgcatcgatcatgattttaactcagtggtgacaggtgaattttaggtgcagaataaatatctaatgtatatgtaaatcaccaacatctgtttactccctctaatttttagtatatctctaatgattgaatcacacatgcccccacaggtctttctcattccttccaacctcactatctctgtgttgcagccttgcaggtccccagatgctacctccctcccctgtttccacatagtttccttctgatgaactccgaaatttctccatctgccccagtaatccacagtacatggcaacaatttcatattacataatagaaatcatcatagagttgcaaagttttgaaagactgataaatatagattggtgttcctaaagaagtgacaatatatctaccctgtagatatacctaatcttctgtgtcactcacacatgagcctctcatgatgacatgaccaacgcaaagagctgagctgaccacaagcccaaactactcacattgaaaatagcaacacgatttcgattaaagtaaggcaaagcatgggtttgatctaatagagtactaaaagtcacctatcgtggaccacaaacattcaactcaaaaatgtgaacgttaaaacatttaacacaatcgtgtcagctactctgtcgctgccttcccaaacttactggcatacaacttcatcttaaatccctacacttagggtgagtttgaggagaagtggattgagaagattcggaagatacgcaaaataagatgagccattagcgcatgattaactgagtattaactattttaaattttaaaaatagattaatatgattttttaaagcaactttcctatagaaaatttttgcaaaaaatgcaccggttagtagtttgggaagtgtgcgcgcggaatacaatgggctttctcacccaatcccccaggaaccaacgcacccttaatacttctggcataaaagaaaaacatatacgggattactgggcacatatcccaaaaaaccagactagagaaaagattatgtgaaacgccttgcttccaataagaaaaccaatctaagcaagaacaagacagaatctattgtgacatttatcattcagaaaatcaagatctggtcaacagaacccaagccgactttcactgaagctaatagtcaaaatggtggtccagagtgcaacaaataaaattatcaaagtggcaatta

SEQ ID NO: 33055 - DNA, 1501 bp, Oryza sativa
aacgggtggctcccattggcctggccaaattttaaaagagacatctcggatttttgttgcgtttattaggacacatgaaatttctttcgccagaatttgcatggtttcaattttctttttctgaattgagcttttgtgtttgtggccgtgtgtgcagagttgcagattatatagtaaccatccaaaagcctatctcactggatagatcatacttttctggtgtaatagatggataccttttgtgataacgtatgataatattattaataatatggttgttgcgatagtgaaacagtgacagttcggtctgccattgacatccacaagaatttggtttctgggtgtcaaaatcgaccaaaacaaattatggttagacatttttttgtcgaaatggctacgattacgacaaacgaattgccatggaatggagtttggctttaacttcttgtctggcacagctagtgctggatctagagtttgtaagttaaattacagtggattaaaattttatatttactttaaaacaagaaaaaaattattcatctaaatactatcaatgtaatcatggattgtaatgtaatcatgtaaaattatcaatgtaatcatggatctaaatattataaatgtaatcatatatatttacttgtatgaactatcatttgaccctttatacaccgggggatgcaatcgaagcacagaataaaaggataacttacaacagaggtatatgcacaacacaaactggaggcaagcaaagaaatcacatgttctctttttcgccgggccagcaaaagaaaccggccaagttttgtattaagaaggagagaaagttttacaacagaccctagaccagaaaaggcttaggctacagaaaaacttcacatcgatttagacaacaaacaagcacagctgctaaaacctcagcaaattagctgccagcgaaatcacatattcatgtgtatagaatttggaagaatagcatcagatgtaagtattatacatgcttagtgtaggaaaagagtacacacttcctttgtatacaaactgtaatggtcgccaaatcatctcatctccaatctaaagttcaaagaatatctataccgaaaacagctacccttttcaggggaaaccaaaaaaatataactgtagtagatgagcttcttgctgtggtaatctttttgtaacttaatgtctctgtgttttacttgatcatgcctgatctagttcacttgtattttgttttctctataaactctacattgtggcgtcagatccacttgaaacacccattggttatcaatctgcatacatcagaaaaatcattgacgtcagaaagcatttgggtgcgaaagcaaacataaccatatttatgcaaaatcacaatgacgggtgcaagctaaaacacagggtagagaggtgccttgcatatatgggtagaaagagggagcttatgccccaacagtgaggccttaaggggaaggaccctatctacaatgagcaa

SEQ ID NO: 33056 - DNA, 353 bp, Oryza sativa
agtcatgcttagaaccataatctctaacctgcttattgattgccaataagggtttcatcggggtttcagccggtgagttatctggacgttgcatcggctcataaggattgcatatacatataagttggatttagccgatgacaacaaatgtttcattgtttaatctaatcttgtggatttcatgacatcggacctccagctgatgggtgctttaaccttcggatcaatacttgttctactatatcatattgttagccgattggtttctactggattatattactatattacatcatcatcagccgattgcctttatatcattatctacatttgacatatagccgattgcttaa

SEQ ID NO: 33057 - DNA, 508 bp, Oryza sativa
gcatccgggcatgcatcgaccggtcgtcgttggcgtggcgctggttctcctcctttgcttgtctctacccgcgggaccgcgcgcggattgagaatttgagatcctcggtttccaaagacaccagcccaacgtttgacatacttatacttcctccgtcccaatatattaaaacctaggatagtatgagacattttttaagtactacgaatctggatggacagacagtctgtccagatttgtagtactagaaaatgtcccatcatgtcctatgttttaatatattgggacggagggagtatattataaggctttctagcactgcctgcattcatatatatgctaatgagtctagacatatatgtgtgcctagatttattaacatctatatgaatgtgggcaatagtagaaaagtcttataatctgaattctttaaaacgaggctcatcaaaatgtaaaatctaagactactataagactactaataaaataagaaaaaacattcgaacga

SEQ ID NO: 33058 - DNA, 419 bp, Oryza sativa
tcttatattgtattgatttctattatatatcttagattcacttgtttaaattttttgttatgtttatttataaaagtatttttttcctataatcaagtagatataccgtagtaacaatcaaacatgcacacagttatatttgtgttgtcttctcctttttgaagtgtttgttgcatctactttaattttaatttgttggaattttcgcatattttaaacaatggaaaattgctcatttgccatgaagtttgttcattttgtgaagaaataccacaaactttagggggataactctcttttactctgaatgccatgtaccaaaatcactcatgttttcttttcttactaatattcctcctctcaccttgcctcaacgtccaactcctgccaccatctcgcccaactttgaccagcacagc

SEQ ID NO: 33059 - DNA, 1501 bp, Oryza sativa
tataagggattttgagtttttgatggcaacgtttgaccacccgtcttattcaaaaaattttgaatttattaattattttatttgtgacttactttattatctataatactttaagcacagcttttcgttttttatatttgcaaaagaaatttgaataagacgagtggtcaaacgtttcaagcaaaaactgaaaattccttatattttgggacggagggagtatttacttacacaacaattttatcaaaattacaatgcactaacatgtcatattaactgaatttacaaatgtaattgtagttatatagtattgtaattttatattttaaagaaaataacaaatagatatttacttacacaacattgttatcaaaattacaatgcacttacatatatatcaactgaatttacaaatgtaattttaattatatagaactgtaatcttatattttaaagaaaataacaaatagatattcacttacacaacattgttatcaaaattgtagtgcacttacatgtcatatcaactgaatttacaaatgtaattttagttatatagtactgtaattttgtattttatttttattttaatttcaaatgagagaggagagagagcatcatgcatgtcgatttttcagagcaaaaaataaaaataaaatagtgactctaaccatccgacgctgttacacgcgacccaactgaaccctatgcgggttcccagcccaacatatacgcacggatcttggcacatatggaacggcctaaaaacgacaaatctgagagaaaaaaaatcacatgacaaatctatagcaaaatcgagtactttttaaaaaaattgatccattctttgatatgcaagaagtaatatttctccgttgatttcggaggcccatcatatgaagcttttatggtgatccgataaatattggtgaccatatgcattccgattggtttcgttttcatatctggattttagagtattcgtttcggtttttaaataaaaagatgaaagcaaatatagtagaggtagctttcacagtatccgagccgtacgttttcattcctaatggcagtttatgaaaattcaatcaactgatgaataaacactcctttacgattgctaagatcacacttaaaaattattcttaaaacatcacagtttaaaattatgcctttttttaaaaaaaaaacagtgctgagcaatagtttgatagctaccgtgttgtatattggtttatcttaagctttgctttgtaaattataaagaaatgacagaaaagatgctgcaatggaacgatggtctctccggcgaagccgacgcatccggcagcacagcgctccatttcgcagcctcagcggagggaccagagatcgagctcgagaagagctcactcctccggcggctcgccttgcgatggccgtgctcgcgcaatggccgccgccgccgccggacatcgactcaagttctcctgaaagccgacccgtccttagcctgccggcc

SEQ ID NO: 33060 - DNA, 280 bp, Oryza sativa
cttggtcggtacgttgcagatcagatccatttcaagttgggagtgaagtgcttcaacgttgctgacctaggtgtatttcagtcaaaaagagatgcaaagatgataaaatgaatttaaaatgaaagaaataatgaaaatggcaaagtggtgaagtgtactcaattgagaatagtattctagcgaaacccatttgaatgatgatatttttgcgaaaccagttttataccatggtacatatgcaattttctccttttccttatctcgtcttatctaccccagc

SEQ ID NO: 33061 - DNA, 151 bp, Oryza sativa
ggcaagagtacaaaggcactgaggaaggatctgtttccttcctttcgccattattccccttgtcttcgccgcttgcgccctaactccttctttcctgtgccctaccttcgccacacgcgctcgctcttaatcttctcttcctccggcgcca

SEQ ID NO: 33062 - DNA, 342 bp, Oryza sativa
tttaggattgtagtactaaataaggaagaacatgccatagctaatcgcctgccttacaggcttctattatgcgatcccacctggtattgatgcactgaatgaaatgcaaaggaattttcaaacgcattgtacagcctataggggtccaagtgtttgaggctacataatatgaatgataaagataaatcaaggctatcacagaacacagaataaggtaattatcaagtcattgtctttgagcacaattctgtatgtgctattcattttacaagtaaggtgcatgctagctagtactcaggatcactgagcaataagtaggctatctttcaaacatgtgccaac

SEQ ID NO: 33063 - DNA, 1501 bp, Oryza sativa
gcaattcttcatcaaagtcaagtgcaatctcagaggatgactgaagcaaactaggatagcgacttgacattcctgcccacgtatatattcagttcgtgccctgctttttgcctcatctttttgcgggttatttgtttcgctttttttcatctatccctgtatatatcttgctataattttctcctgctctattaatatatacaaggcaaagcttttgccttcctttaaaaaaaatatatattcagttcgtgcttatacaacaggggatgtttcttgactcttgtagaggtaagaggttaatatgaagattagtaggactaagaagaattcctcgttgatattttcaggttgctagatttttcatcagtacacgaccctgattgtactgcataaaaaggaagtaataatataggagttttgattgatggactttgacctgaccagaaatttggtctagtttgaggacatctttgttacaacacatgtgcttccatggaatttgagttctggagactggtggcatgttttgtgtagatttagatgcttttttttagcaggtggatgctactttttagggtgaccagtgaaaacctcaggacgtttaactccttgccacttttaagatgtggcaaatagttaattattccaaaaacgtctgccataattttctacagccacgtaatcccattctgggccacaagcgagtgagaaccccttccggtccaaccaaagcccgtaaagcacaattcatcaggcccataattaaacctgcactatctggggaatgctgggccgttgtgcagttttcatgggcctcaacaatctcccttttcaattcttttcggcccaaagtaatgtgcaggcaccacacgcagcccaccaaaagctcgccatggtactgtggcaggtaaaaactgggcctaagggtttgggccttcatcaggaccgtgcaaacggaattttttttatttatacttttttttattaaaatatttacaaaaataattttttgtttcgaaaatttacaaatctaattgcctgccgcccttaagaagggcgatttttaaaaatcgccctctcaaagggcggcaagggacctaaatacaaaatttttatttgtgttcaaacccttcccaccggttttaattacttaaaaactaataatgcttattcgatactccaaatgattttaaatggaaaagtgataaactacaaagttatagatctcatcaagatctacaacttttatataaagtttatctccatccaatatcgtttgaaatatagatctgagattttttaaaatgtgttttatattttgtaacgaatatttggatatctaaaacatcttaaatgaaaaagttactaactacaaagttgtagatctccttgagctctacaattttgatataaagttttatttcatctgactttatataatataattttaaattgtaaaattatagagctaacaagttatgctggaaaatttacatttagg

SEQ ID NO: 33064 - DNA, 1501 bp, Oryza sativa
taaaatattcttttcccatgaagcatctccaccatatagagtggtgtctcaaaataatctgatgtttggctcgttttgccaattatgcatgcccaaaagatcaagtccataaaaacaatgtccgcaatccgatttttgacatgtgcagtagtggagaatggttcttcacgaaaaccactgcaaggccaatgacatggtagaaaaaaagtcttaacaacggtaccaagtatttacttaaaaaacgattatttatgggcaaaattaaactaagataccgaaactcaccgaattgaccggtttaggcactgcttgattagctcaaatgcagtcggatgatctaagacaaaaggaaagcgaacagagaatcccttcctcatcaactcagcaaaatattggtattttttaccactggcaggagtccaactaactggaatcatggccaagtatccgcaagaaggctcaagattttccataagagcgtaatatggtgcgacattcagcacatagacaaatgaagagctcgtgttctggcaatccacatgtatgtacttgttattgttcttcactgcctgcgaacaattgacaaaggtcgcccaccatattccctgaagagtcaattccctggtgtagcttggccctggaatcccccaaatgaaaggacgatgattggagcgaggaaaaaggcagttgctgtttgcattcctgcaggttggcgtccacgacccagaaggacgaatcgttgtagttgatgctagtgacatagtatgttcctgtattgatctggatggtggccttgccactgctacactctagctcatatgatgaaacaccgcacctgtgagggtcgcctctccgccagaaaggatgacttatgtttgagagatggccgcaggagaaaggctggcaccactgctgtccctggacaactcctgcgagaactgcaagtatagcaaagatgagtaaggcttgcattgtaatggtagtagagggggaagctggcagagttgctcagtccacaggctggttatagtagactagcagcttgctgcacctacatatataagaatagtttttttttggctgatacagtttggtcctatgcataagattcatagtaagggaccgaagtcagttcgtcaaagaaaaccttaaattgttatgttgacatggactgcatatcagcataagattcatataaagggacagggtaacaacacagaaggatgttgcacttacgtagcaacacctagttagactaagcctagtcaaatttggacttttacgtggtggcctgctatatatatcaccctggacccccttcattaacgatgagatactttaaccagcccccttgtaaataagcttttttttttggaacgaagcttataaataagctagggttgattattagatacacacacttgcagtatattgattgattaattgcatatgtttccaccttaattccctgtccatctctggccgtttcagtgcacaaaga

SEQ ID NO: 33065 - DNA, 1364 bp, Oryza sativa
aactcttgttcctcttcttgcatctcctggtgtcttcgtattcttcgtttgatgataatgatggaagcgatgataatggtgagtactgaagtagagccgatcacagagaccacgatagtggcaacaagccttcctcctcttttggatgaggaatccaagcctgaaggcccaatagcaataggtgcaggaggaggaaccggagatgaagacgtgagatcagttggagggcagaagatgatctggtagtttgtccctgacgggcaagtgaatgtagtgctggagctgtcatccaaactgtagctatatgcgtcagggcacatcctgacgaatggcagtgagaaggtggtgggttcgcaggttttggtgccagtggtgccagtgcagcagtatttgtcttgcttgaacacattgcaggcgctgttgcagcctccaggcgccttgagctcgctggggcactgcgacgtgatgttggccgggcagcgtggccccttgctgcacggtggtgctccgtgcctctgctccggagccggcacggggaggaagtccatgggcacgttgaagccgtcggtgagggagatgtcgaagaaatcctgtacgctggtctggtccaccgtgaactcagcgagcgtctgaggtggcttgccgctgttcttgcacttgagcacgccgccgcagtctcccgtctggcacgatccgttgccattggcatcgaatgagcagcctgtgcgcgcccacacacgccctgcgccgctgttggcgggcacgtcgagcgcccacgactcgcctgggtcgagccgcatgccgccacccaccggcacggcggccggccacacggtgaaggagcatcggttggtgatgttcagcgtggctccggcggcgtagttggtgctggcggcaacgaggagcagcagagtcacaaggtggtgagtgcggcgactagtactgatggtactccccgctgccatttgtgttgtgattcgattgcctgactccgtttgtagagcggaagaaggagacagcagatcgatcagtatgttgtgtaagttcacatggtctgcgtgttgaattgttcaacggtcttcggtcaacgacctagcaattgttttgatttgcctgcaagcatatcatagatcctgtgattactacgtggttgcgtgctttcctcatctttttcagcgttctatgacgccctttttgacttgccaaccatgcctgccgtcaacagtgtggcgcccaaaatgtctctttctttcaccttaactgttaccgtgtggtgttggaatctctctcttaaggtcgtgtatatttctatcatccaattatgtcacaacaaattatatacgagagtttgacgagataccgta

SEQ ID NO: 33066 - DNA, 1501 bp, Oryza sativa
attttgcaagacaatgctgcaaggaaattgtaaatctagtgttatcaaatggatgcattaaattgggtttgagcacgctttatgtttaaaacaaatgaatagcaaagcaaagggatcaccattaccattgtctatttgtcaatgacaaatgccagtaagaagtttccttttgttgcatattcctcctatccatgcgccattgaaagagccagggcctgaatatgtgagggaaacgtgagaagacaacgctgtagggcagaaaatcaaccatgccatgatactaaagcatgtcgcaaaataaatacctccatcatcaaatgtcagggagggggaagcaatctgccgtggaaaccatcgccgggcgtcgtggtggcgtttctagagatccgcggcggagcgcggggtcggggcagggcgagctcaaccgctggatgcgctcagagccagggcagccacgcgcagtggcgctgggagcctggaagtcgggttgattttggcgccggcaccggcggcgccgccgccgtctgctggagcgccgccgcagcccgcaggtcgatggggaggggggaactgtggggactgggttcaagcccaacacactatcccgttcgggcccaagctcattcaatgttattccgtcctggcccatcacagaggcaaccttgctgaatccggcccacagctagacgtaggccgggcttaagttgacgcagatgagcagtagataaaatgcatacaaagatcgaaagtgagatgaactcaaggcattacgcaaatgggcgcgctgagttcctgtttcaaacccttcaaacataatcagcatgttttctggaagtggccccgacaaaaagaaattgctgagagcgacacatctatcagatatattggagagcaaattgttgcaagatatccaaatcaccacagaattactacaaaaaagttttaacacatcatgccggatagtccacaggtcgccgccggtcagggatcaacaacatcaactaggagatcgtcaccgacctgcactgcaccaggattgcaccatcgtcacctgcaacttttgggcagacaggtatgaaaatcatccataggtagtagaacaagtacggtatctcgtcaaactctcgtatataatttgttgtgacataattggatgatagaaatatacacgaccttaagagagagattccaacaccacacggtaacagttaaggtgaaagaaagagacattttgggcgccacactgttgacggcaggcatggttggcaagtcaaaaagggcgtcatagaacgctgaaaaagatgaggaaagcacgcaaccacgtagtaatcacaggatctatgatatgcttgcaggcaaatcaaaacaattgctaggtcgttgaccgaagaccgttgaacaattcaacacgcagaccatgtgaacttacacaacatactgatcgatctgctgtctccttcttccgctctacaaacggagtcaggcaatcgaatcacaacac

SEQ ID NO: 33067 - DNA, 431 bp, Oryza sativa
ttatggaatttttcatctttgcgaaatggcagcaaaattagcacaataataatatactagacaattagaaaaaacccgttgcaatgcacggacattatgctagtatgatataacactgttctctgtatttcagcaaaaacaaaaaaaagaaaagaaaaacatatgtacaatccatttgatggacctgaatttatgtgacaactccaataacttataagacaagttgaaagttaatattactacagtaggaaacaataatgtaccagtatcatatagactatgactctatgagcagagagattatatggtgccaacagagtagagatctcacttgataatgcagtgataaggggtatgtggtttcaaccccgaggtcccgtgttcaatccccagtatgctcacaatttcttcttaaaaattttttggaggga

SEQ ID NO: 33068 - DNA, 177 bp, Oryza sativa
gtctaatttaggtcccaagcagtatagatggctagtttcgctgacgtggcatcctagtcagcaaaaataataaaataaatatgtggggcccatatgtcagtgagagaaaataatgtgggccctacatctcttttttcttttctttttctcttctcttctcaacttctcacgcgcagg

SEQ ID NO: 33069 - DNA, 1325 bp, Oryza sativa
cgaacctcccgtggcaccgatggatgcagggtttggatggatagctgggattgatccccaatgacggttggagggtattaccaaccattccaaccgtcacaaccgtcattacctgcctataaaaggagctcctcttctcacttcacacacacacctcaagcaagagctctctcatttctctcaagtttagtttagtagtatctagctggtggaatagaaatagagtagaaatcaggagtccggaagccttcggaagagttcgggtatggctctagtagctttcctttcctcttttgtaagctttgtacttttattagaatactcttctatatacatttatggtattgaaatactttctgagtatatgagtacctactttacattatgttcatgttatattgaatatatggctagcttatctgggagatgctttggtgcgggtataatatttgcttatgcaattactctatgtcatgacgatgatattagagtagtatctggtagtttagacatggtgtctagattacgggatatcattatttggggttatatgctacagatgagaggtgggccgctgatgatgacagctcagtacgggtattcctccgcgcctgtatataatcctaagttaattcctgaggagggtattcctccgtatttagccccgattgtatggtcatgacgggctgtcgtaaggaactcggcagtcaggggtggcttctcgaagtaccaggagggcatcggatagagggtattagctagtatatcggttaactagaatgcatgtatactatgtatattagaagtataggaatagattttctttctctcttcttcccacttagcttagataatatattatgagaatgagtagctaatgcttgtgtgtcactctacccttggattatcttaaccctgcttagaatataattatcacaagtaatatataaaatattaatcaagttctctctacatgatctttccacgggataaaataaatacgatacccttggaatactctcgggtgaaatgctacaatggtatatccgtgcgcttgcggatgaactctgtaaccataatataccagaggtatttctgcgccattgctgggaattatatttctagtaatgacgttaagaaataccaacaagcatttctggcgccattgccggggaagattcataatagagattacctgaactaatactttatatttacctgtgtgtaatcattttcctttgcaggctaaccttggttgttttcacttttgttgtgaaaacagggtagtgcatgactagtttcaacttgccggaaaacttcaaaga

SEQ ID NO: 33070 - DNA, 1501 bp, Oryza sativa
ttacatctccaccaggaaggtttctatttttaactgatcggatgaagttaaagtctcccatgaaaatccagttctgattcaaatccacttcgaggttatataaccaggaaacaaaattatttcgtaactcacccgcacatgggccatatatatttgtgaggttccaggtttcatgtcgggatgaggttgaaaaaactgcatggttatagcaaaggggagacaagaaattagagtgctagtaaggacactactattccagattatgattaggctacctgaagcaccagaggatggctgaaaaacaaacttgtcaaagcgtctagggcaaaatttttgcaggtaggaatggtcgaacacttcttttttagtctcttggaggcaaataactgaacaagaggattctgcaattttttcagataaagccagccacttgtgggaggagtttattcctctgatattctaacaaaggatgttgcaggatctgttgatattgttattcatgggggtagaactgaaaagagagatttaccgacgcagataactatgaccccgcaccacaaactccactgaacattcagagaaaaccctttcatcaaaccgagtaaaacatcagaagcacaacaggagttatcagtagacaaatagcagcaacaagagttccaaagccatttcacatagcagtagttccataaccacaaataataagggctccagcaaaagagaatagctaccctattacatagcagagtagcaaagctccacagagcttgattattacaaccatttggaaaattcattttttgggctgagagagtttgtcttcagctacttcctcaggaagcagcccacaataatccaccccaatcttctgcagctgttagaacaggaatgggaggggggagccccttgccggcttcaaacttgaatttcttgatgggctgcactttggatttctttttgggcacatcaaaggccaggtccatcttgtcttggcccaggaatcttgggcttctcctaaggtttgcagaggtgattggcacctttggtctggattttcttggcttgggtgtgattggagctggttgagaagcctcatcaataactgaaaactgaagtgctctgacaacagggttatcaatccttgaagtcttttgtctcttggctgggctaggactgtcaccaagagcctggaacaatgaaaggttgactgagatattccagcgagtagagacaagggaccatctttgaaacatggctacagagcggcatagggggctgacatgacagcagaaggggcttaaaatctccatttgctactgccaaacaaaagacctcaggtagcttaatgataggcaaagtaggaattgggagagcatagggaatgatctgctagcccaagtgctgctgctggtccaacagaaatgttgagattgtgccctcagaggaaaaatcatgcactgtgatggagtcttgctgttccccagggataggttccactaac

SEQ ID NO: 33071 - DNA, 1501 bp, Oryza sativa
tgtcgctgagtttgaattgaaccataataccaggtatagcccatctccaaactcgcaaaatcgtgtcaaatttcatcccaaggcagtatagctcccggttccatccgacgtagcattttgactccggttagctgtgttgagtcagcgtgggacccaaacaagctccacatatcattagccaactctttcttcctcatctctctccttctctttgccatcctcaccaggtcaggagtcaggctgcgggcaccatagataggggcagtggtcggcatccggcgatcagtagggagaagggcggttggccgctggtggcatggacagggaggcggtggggtccaccttgagccagcggtaggtgatccaagagaacagtggcgccgccaagcaggcaccccacttccggttgggacgatgttagcgatgtcgtcgccgagggggctagggtttctgacgggaatacatgttacatttcaggagccagaggtttagtagaggaggtggtgtttgtgttgctgctacaggcagaggtcgattctgtgcttgtttgtccgacgtccgtgtcgggccatctcgatcacctcacgccgccttgtgagttgaaattttctctctgtcggccattcatgttttgttttggaatttttgctcgatagttttttgtgatttctgatttccctgtgttagcgatactaattgctttgaccatataactgaatggtgccatcaacatctagttcgtatatgacatttttgtttttgcgctcatgtggtcgcttcaattaagtgaaagcagggatgtgtccttaacaattgtctttcatggcatttctttcctccgaaagcactgcataagaaaaaaaaccaaacttttgtcccatgtgatgtgttagtatattgctgatatggtttgatcgatgtatggcaactcttggcagtgacactaataaatgaataatcaatgtttgaataagatgcacacgcgggtaaggaacggtactgtagttgtatgcagtacttatctcttgtactttggacttgaactaggctggcttcttctggtatcatcacttagtttcatgtccactactattagtcacatggtgcattccgatgtttgttattttcgcaatgtagttttctgagcattgacctagaaattaaacaatccattatcatgtagcgagccctggattttttttacgggtaaaacagcaggagaggctcctactgcacttatattaaaaggaggaaattcacatagagaaactataaggggaaaatataaggggggaaaagaaagaggagactaaggtcccattctttttcctaacaagagttgaattgaagattaagattttcgtggcactcttttcaaactgctaaacggtgcggttcatgtgaaaactttctatatgaaagttactctaaaatatcatattaatctatttttaagtttataataattaaaactcaatcaatcatacgttaatatcacctc

SEQ ID NO: 33072 - DNA, 1501 bp, Oryza sativa
taagtttataataattaaaactcaatcaatcatacgttaatatcacctcgttttgtataaaaaaacttaatctccatcttcatcttcattttcagtaaaaaagaacaccacccatgaatccatgattgccaagatggtttatctgcttcctttactctatgcatatgcagagtaaaattaccctagtttggttctgtaaatgtaaacaaaggagaacccactgctttgagatatgatcatggttgttcttgtcttccctaatgaatctactacacttgtatttgttaggtcggaaagatgaggaagggactacatcctcagatgcagtatatctcatatgtgacttagagtggcaggctgatgaacatcatgatgaccaagatcagccacaccggcaaagtgcaccacatgagagcgaagcatcggatggctcagagcctagggcagattgccaagttcaagcgccgatatgagctggaagcagaggaaaacaatggcaggtagggagaattgcgtgtggaaaataatagtagatgttgttggtggtaggcgtgtagcatgtttccgtgctatcaacataatgtgtgatccccacgtttactttgttatgctttacaccatttcgggttgaagcttgaaatttctgaatttcagttcgccgccttctgctgtaaacaaaattaagaatgtagacattttcctacaatgaaatccatttctactgatacatgatggaatgactattgtactggtgtttggaacccacattttccattcagtgttttggagtatttacaacgctgtggctttagcttgtggcttcaatccccagttatgctcgaatgcttggagtagctcttcaaatgtttatcaatgtgtcttccacaagacacaggtgtgggtgtcataagagagaggtgatccaaaggagagcaaaaatggaagtgagcgctgccatggatctggttcgccctgctgatccaagatgaaagggaattgaggaggatagggctccgttggcggaggttggcaatggagaaaaagagtgccggttgcattttggtatgggaaggagacgtagccggttgtgatgagagcaaaggtctcgctcatgaggtgagaagaggaggggataacgaagaaataagggagaggttttctatgcaaggtttgctttataatttctgtgctaaaacttttagtcagaagtcaaataaaaatatataagaatttgatggaaagtagaagagctgaattacaaaattatgtagggcctatctagagttatccaacattgtaagagttatatctctctacatgattttacctaagtagcgcgcctttttctcgtgagggctacaccacgaaaccactttaattgtaaatattgtatactcttcaatctcaaggcgtatggtccataggcaataaaaatatctacatcaacatccattgaacatattctatctccttgatccatatttctcatgttagtgttaat

SEQ ID NO: 33073 - DNA, 1501 bp, Oryza sativa
atcaatttcttactgtggattgaattaatgggatgagtaatattgtggggtctcgtctaattaataagatgcatggttatttctttctttttcccccccttatctatagctcattattcttatcaaccactagattctcaattagtacacttatatatgtatcaaccaaaatttctgacatgacaaaaggatggaatttttatcataggtggaaccttacaaaacatagagaacaaaaattgaaaagaaaggtagcagcataagattgtgaaattttggtcatcactaaatttcaaaaatatttagttggaaaatttttaaaaaatgctatgcatatatttgtcttaaaactactttgatattaaaaatttattatgtttcataagtgtatcctaataaaaatttatttgttttatagaatcgattttccagtcaaaactcccactaggtaggggtgaaaacggagcggatacgaacggataatgctcataccatattcgtttttatattttttatcggatatgaaaacgaatacggaaacaaatacggattatcttgaatacgaataagaatcgaatatgatcggacacgaatacgaaaatatttttttctcggaacacgaaaaccaactcaacttctaatagaaacaaatatcaacatatataattagctcattttatataaaataaagtataatttataaatattttttaaaatttaaataatattaatagtatggactagtgttaagagataaactactattaaaatctataaaggtattttgaaggttatagagttagaaagaaatgcgatatgtctcatggcttttacggatatccaaatagcactgttcaccggatatccgaattattatccgtatccgacggaaatcccaataccatatctgtatccgtatccggtagaaaatatctttattcgtatctgtatccgaactatccgagaattatatatccgatccgaaaggtatttgtatccgtttttgtctggagcagatggaaactatccgctccgttttcatccctacctctaggttgcaggcggactataactatcttcgtatacaaaaatttctcccctaggacgattcaaggatcgcgtgcgaaaatcaattttcgcaggtagatttgtgaagaggcccgtcggctgcttgtgggaacgggtatacaagcttccacatattattatatattaggccggatggcctaggtaaatatatctagtagtaatctgagttttattttctatttatgtcctatttctgtttatcattgcttagatgaaaatgtgaagctagtgcttgtcctaggaactagtttcacatgagtatgagtttagagcatttgagatgttgtagagctccagcgatttggtcaagtctcctgagatgtataacacatctggtcgccatcttcgagtggtttgtcgggcatgtctcaggctgaagttgactggcatgctgagccccagcaatatctcc

SEQ ID NO: 33074 - DNA, 232 bp, Oryza sativa
tctaaacacagcctaaaagtaagctagcttagctaggctgtactaccacgcacgcgtgcatgcacgattccaaaagcgttagttaacgtgtcatcaacccgtaaaaaaaggaacatatagctatagattaatgatagtaacaattaattaatatatataactggtactactgttaattagtacactggtactactgttaatagtactattagttagttgaccctacaaacac

SEQ ID NO: 33075 - DNA, 1501 bp, Oryza sativa
tgggggcacacatggatgagacagtgcttactgctcagggatgatgcatgacgaaatgagttgaccctagataataaacacatagatctagctagctaatatagcaattaattgtagtaaattaattactccctctgattcaaaatacaaggcacaactagatgtttcataatataaggcgtgcatgcatatatgacagtaattaactatgaccttctctctactaaattattgtattttaaatcccccacccttaaaatctctaattatattggatacatggattctatttatcggagtgatccaaacgaggtgatgataataaatatttcttaatctttgagttacgggtggttatgtcttatattttgaaatagaggaaatataagtactataagctaattgaatcaaaaccgtctgcattaattatctctttatttaaaactataagaacaatagacctacaagaaagaacaaaaaggatctaagctacctcttctctcttctccaactaaaataacaaaagaagtggatctaaaccatgcatctccctctcttttctactaaagtaaaatatactccctccatttctttcacttgtatataaaggacatatatagtcatagtccccgattaatgattatatttttttttatttttataataatatatttataaaactataaaaatagaattgcatgaaattattttttaatgaaactaataatatcatatttcacacatcaatatcttaatattttttaaaaatattattagcgagtcaagattttgaggtttaataattaaaaaaaaatacaacctcgctaagatgtaatcttcaaaaataaagtaggccctccaccaaatctcctaaccttagatctacaaaagaatatatggaccaaattaatctcctagctatctgcaagcctgagcttaagcagctcaaaacagctctaacagacaaatcagtggtaggccgggctcctggtctcgagttgtgtaataatgcaagacagttttttttttttttgcttagatctgcatgtgaatcattgctcacagatttgccaaagaaaccatgaataggagtatatattactggtgacgtttagtgcaatatatatatggtaatcgctccatgcctttctcagttgatttcgtagagagaaattatcactgcagagagccacatctgtttatttttagtactcacatttgttcatgtacatccacttctgtccctttgactttccatgtagaagacagaaaataaattataaaaatcaattataaaaaagctgtaaaagaagttcatcggctcagtatagaaaaccatttcctaaaaaacttttaacggtgaaagagatcttttcttcttagaaaccaacttgaatttccctcgcaaaaaaaaaaagaaaccaacttgaattctaggaattacaaaagaaatgttaaaataattagaaatttaaactcaaaaactcaaaaatttaaaata

SEQ ID NO: 33076 - DNA, 839 bp, Oryza sativa
cctgcagccctttttttaaaaaaactaatacttaattaatgacgtgctaatggcatgctccgtttttcctaatggagggaagtgttcccaaccaggaggtgcgaacacacagtctgatctgtttctttgtcctagggaggtctttttttatttatttatttgtacaaatcatagtctgctctgtttacctcttgatcccagaccttcctgactgatgcttgcaagtcctagcctaggttaaaaaaaaaacggtggtgaactggtaatttggctggtgtcgtttgaacccaaaataaataggtagaaatatattaaatttcaatttaaaattagctacattttgttaggcctagatatttgatatatgaacttatgtttgataaattcaggccaaggccagtatctctgcaataccggctttctaaaacgttgggcctggctcgccagaattaatcaacaggccagtgctacaacctagaagaggcctaagcaaaatacagtcatgtataaaattatcatgtgcattttttgggggatttagaataaatttttctactatatggaatacacaataaacctaatgattctacaccaaggagttgaaaggaaatgacatcaaacaatttgaaatttcaattctaaaacttaattttagaattaatttagttttttttctgtcgctcagctcatgctagacttccaagagaaaaagtatgaaaatcttagtctaaaactggttttccgtttgctttgatcaagtgttcttggcttataagctgcactcgcaaaaagaaaaaagcctccctaatgcctacgtttttcgatatttttttatgtgc

SEQ ID NO: 33077 - DNA, 210 bp, Oryza sativa
ggagaggcaaaagagaggacaaagacggtgagaagaccaacaacaacaagcccaacaactacaagtcgaagggttctaaccaagggaggaagatggagaatcttaggaaggtttttcaacaagtttgcgccgccttcgaaccactaagtgatgtagatggtgaaagtggagatgatgataagggaaagaacgtctcggatatttgcttca

SEQ ID NO: 33078 - DNA, 1501 bp, Oryza sativa
gaggggagctcgctgcccgcaaccggggctcggctcgctggattcaagggtcacgatgcgcttgggcttccccggtggggtgatggataacgtgggattgctcggtgggcccgccgtctactcatcagtagtaagatttttccttccgggagtgtctctatttctttttttcgtttttggagaggtgtgtctctctgtactgggggcgtcgtgactcgacgtatttgctgctgcttttttttctctatctgggatccaaatacaaaatttatagaagtattgttcttttatactccctccgtcgtataatataagaaattttgagtttttgcttttaacgtttgaccactcgtcttatttaaaaaaatttaaaattattatttattttatttgtaacttactttattatctacagtattttaaacataacttttcgttttttatatttgaaaaaaaaattgaataagacgagtggtcaaaagttgtaagtaaaacctcaaaatcccttatattgtgggacgtcttatattgtgggacggagggagcagtagtatttttctcttgaactcaagtgttcttcttcttgtgtgtttttaccgagatggagtacagataaagttatttactcctcagatcgaaaatattaccgttgttatggggatgctatagtgctatattagtcaatgtattaatgattttcggcttgtatatgagcaagaaatctacggcgggatcatgacttgtgaagttaatacgagactgttatttaggtctaaacttccccctgtaaaagcgcgaggaaaaatacggcaatgcttaacatctatttgcccccaaactaatcgcacacgcatgctcaagttttttttttaatcctgacacatcacgtatgcttatcttttcagttcggttgttttcatcgtggagcatgtgcagcgtagtatcatacgcatggtttgcttcattcagtaaataaattaagaaatatacaataaatttctcgcaaaaatacagaataaataaacgagcgtacaagaactccacgtatgttcagttgagattactcatccggtggcatcacaccatgttcatgaagtccatatatgacagaaaaggaatacgcaagggctgcattttttttcctccaagctactgtatttcgtcgtttggtgcgggtcaggtacagagccaggtgtatcgcacgaaaagaaaaggaaaatgaggaaaaaatatagaacaagaagaaaagaaaaaaaaagaaaagggaaatgtgtcattacgctgtggctcttgagagaaggggagagtagaggggcaaacggcaaaacgcaaaagacgtttcgaatccaaactctagcccaactgcaaacacgcggcgcgctagcactgcaagcggcccagccagatggcagcagcaagtcacgacgaattgggcttacgcagctgtggtccaacacaagcctggccagtgagcaagtatgtgttgggtttgcgtggtcgg

SEQ ID NO: 33079 - DNA, 238 bp, Oryza sativa
ggcggcaacgggtggtgctaccggctaccggcgtgggctcgttaggagacacgggaggggacggcaaatggggaaaacgagagagggagctcgggagagtgatttaatgggcgagggaggggaggacgtggccgggaaccctcccgatttagccggcgacgtggggaggagagagagaaagaggggtgggattcgaaatcgaatcccgccctctcgagcgcgcgcacgggccgggaga

SEQ ID NO: 33080 - DNA, 1501 bp, Oryza sativa
ttgggctagagtttggattcgaaacgtcttttgcgttttgccgtttgcccctctactctccccttctctcaagagccacagcgtaatgacacatttcccttttctttttttttcttttcttcttgttctatattttttcctcattttccttttcttttcgtgcgatacacctggctctgtacctgacccgcaccaaacgacgaaatacagtagcttggaggaaaaaaaatgcagcccttgcgtattccttttctgtcatatatggacttcatgaacatggtgtgatgccaccggatgagtaatctcaactgaacatacgtggagttcttgtacgctcgtttatttattctgtatttttgcgagaaatttattgtatatttcttaatttatttactgaatgaagcaaaccatgcgtatgatactacgctgcacatgctccacgatgaaaacaaccgaactgaaaagataagcatacgtgatgtgtcaggattaaaaaaaaaacttgagcatgcgtgtgcgattagtttgggggcaaatagatgttaagcattgccgtatttttcctcgcgcttttacagggggaagtttagacctaaataacagtctcgtattaacttcacaagtcatgatcccgccgtagatttcttgctcatatacaagccgaaaatcattaatacattgactaatatagcactatagcatccccataacaacggtaatattttcgatctgaggagtaaataactttatctgtactccatctcggtaaaaacacacaagaagaagaacacttgagttcaagagaaaaatactactgctccctccgtcccacaatataagacgtcccacaatataagggattttgaggttttacttacaacttttgaccactcgtcttattcaatttttttttcaaatataaaaaacgaaaagttatgtttaaaatactgtagataataaagtaagttacaaataaaataaataataattttaaatttttttaaataagacgagtggtcaaacgttaaaagcaaaaactcaaaatttcttatattatacgacggagggagtataaaagaacaatacttctataaattttgtatttggatcccagatagagaaaaaaaagcagcagcaaatacgtcgagtcacgacgcccccagtacagagagacacacctctccaaaaacgaaaaaaagaaatagagacactcccggaaggaaaaatcttactactgatgagtagacggcgggcccaccgagcaatcccacgttatccatcaccccaccggggaagcccaagcgcatcgtgacccttgaatccagcgagccgagccccggttgcgggcagcgagctcccctcctccccactccgtctccgtggctccgtgccttccaaagcgtgggaggaggagaaaggaaacggaaaattattcacaacgggaagccttcaaaaagccaagcccttcctcgcccattttccagacagcgtctctcggttc

SEQ ID NO: 33081 - DNA, 360 bp, Oryza sativa
taaacaaaaggttatttttgaaataagttttggcggcggttcatttgtaaaaatagtttttgcaaaaggtcaaattgtcaaaatttatgaaactaccatgtatatcttgttgcataaatagatcttgtcatcatttgttaggccctgtttagattttaatctttttttttcaaacttctaacttttacatcacatcgaactttcttacacacacaaacttccaacttttctgtcacattattttaattttttcaaacttctaattttagcatagaactaaacacagccttagcgccaaaatccgggcaaaccttggcatagtcaaaattttgataggtgcaatttgttgttttcaaattt

SEQ ID NO: 33082 - DNA, 604 bp, Oryza sativa
ctaaaatgtcataatgttgtatatcgacactatcaagaatttcacgcgaatatagaatatataaattctaggttacattcgaagcatgaaagtatcgtgcaagctagctactcgataaataaaatgataactgccgacgaaatagcatgatttctcactttgtgatacgcactttggagtgtaccttttgtcctgtgctgcatgtctggatcccaagcaccaaaagacctttggggccaagcaaagggcagatcagaaatcacgcacgtatgtccactggaacctggatgctgccagcggtgtgcatatcatgttcacacagcgcccgtacagcatccatccagctgccgatgctcgttcatcgtgtatcacgtcgcaatcccgcgcgcgccgggcgtcaccgccaccgatgaggcgatgatgctcgacccgctggaacacaacatcaactcgtctacttcatccccggctccgactaaaaattgaactcgacatctaaattctctggtgaactgaacacctcacaagcaactgtcacattattagagaggaaatcactagaatatacaacgaattaagcaaacgacaagcacaagcaaaaata

SEQ ID NO: 33083 - DNA, 252 bp, Oryza sativa
cgcattttctcgtcctgttgcaaactcctatctacatgtcagcatcaaaattatgaataaaatcaccgtgtcccgatgatatttttgcttgtgcttgtcgtttgcttaattcgttgtatattctagtgatttcctctctaataatgtgacagttgcttgtgaggtgttcagttcaccagagaatttagatgtcgagttcaatttttagtcggagccggggatgaagtagacgagttgatgttgtgttccagc

SEQ ID NO: 33084 - DNA, 1501 bp, Oryza sativa
gggcttagcatattcgcaactgagttgatgtcgggaaaaccagcaatctagttgctgctctctgttactctgtatgtgtaggtaacattggctaggtaaaccttacatcatggccagagttaggggcgcgagaggaagcagggaggaaggtggatggacagctaataagctgatgaggatgtcatccggctggtggtctggtggaggtggcagaagcggatgccgtcaacatattttgcatcaagatgtgctttgctgcagtccttgctgcggtgcacagcacggatgacccttatagcctctttggaggcctataatctgagagcccgttgtgtatagctcttatcgtgtcctgcgttttgtctggtggaagcgaaattaccatgtttccagaactccggaattgtctctaaattattgtgtgagaatgggtgtactgataaatcggtgtatcgattccattattcgatggtctcattgcattaatgcaataatgttgcattactgatcatctttttacatcttgtgcacagcgatattcatgaagtaccacttgagagagcggcatccatgaaaagtcactcccagagggtgattatcacgatactccctattgtcacgatgctcctcagagggccgttggtcctacaatttgatgtcaagtttgacattccttttgcacattcgagtttatcacctgccttgcctcgctcaatattcattatcgtctgctttgcgtcgctagcacttagaaattgaccaaaatgccctcgttgctttgtcccttttttctatttcttaggacggaggaaataggtgaataaatgaagggtatcatcttttcgcttatgcttatcagctagaatttgaattttcaattttaaatttggagttggttttgggttttttcattaaagtttatttttcagtctttacttttagatcgctaagaacacgtatataaaagttttattcacaaattatatcccgtgtgtaaatatgatgtttggcttattctacgaataagcgaagcaatgaagctggaactagactatattctgactatctaagcggttcaaaagctatctgagcggtccgaaagcaaaggttaaaagaaacataaagcaataaaaatacccctgaaattaacagaaagcaataaaaaatacctctgaaattaactacaaaattaagtaaatggtacgtagtcgaagcggtatattttgggatagaaaatggtgtttttttttaaaaaaaaacttattattactcccttgactattaaattgaaacatatgagatcacttgaaagctaatgagtcatggtgaatatacaactgcctcgatctacaagacacaatttataggacacacaaaaaaaactacaacatgctgacttagaagccttgggcctcatataaggtgcaaatccttcgcttggctagtacacaaaactcaacatgtaagcatataataataatttatttcattctaaaactaa

SEQ ID NO: 33085 - DNA, 322 bp, Oryza sativa
aatgtccacatcagatcagaatgctgtttggaaggcattctgtcctagcacggccctgccgccgcacgtcaccactctgagaacactgcttgcatgacttcatacttttaaaatatatttggttaaaggacttcataggggctgggtcaaaaagaatattatgtatatatccgggttggctttgtccagtgaacaagtggcggactgatccatcccatctcatctctcgcgtatcgcgtgtgctgtacacgcgtggagtagggtaaccctatcgcgttttctcaccgtatcgtgtttttccaattcacatcgagagaaaaga

SEQ ID NO: 33086 - DNA, 164 bp, Oryza sativa
ttatttctgggtctcacactactctcactagatagtagagcttttgattacactatattacttcatgtcggaatacactttgttctgatggacccccccctttcttatttccagtcgaaatacagcacaaaacaatgggatgaaactatcgttcttgtactagg

SEQ ID NO: 33087 - DNA, 521 bp, Oryza sativa
tgcgaaataactgctggagccggttaggtcagcgcggacaagtgtctggccagctgcctgcctgccacagcacacatgatagacagtggacatggtggctccccatctggggcgatggtggcactcgccccccctgcatgaatgatccaaatatataaatatgtcttagctaaagggtagtggcggccaccacattatgtaatggtatcatgtttacatgtaacacacaaaaattgattctacaatacaaatatttaatgaacaaggccatgatacactatcaaagtttcatttaatgcaaatatcttattccaaaaccaacaacatgacatctaatcaggagaaaaggaacactggaataggcatttcctgtccctaaaatccagcttcacaagtagtatcacataccaaacagcagttccaggtgagaacggagagggaaaaatatttaggatttataggcgaccaagcgagaaggtactggcaccccacctaagaggagaggttggcgacggtgaaga

SEQ ID NO: 33088 - DNA, 227 bp, Oryza sativa
agaaagtgtgtgagagagatagaagagagagagtatgacatgtgggtcccacattttttaaaataaatagaatgatgactggactgccacgtgtacgccacgttatccaaaaccaccgcggattgggtcgaggggggtaattcgtccggtttgcatagttgggggtgaagaatgtccgattttgtggttcaggggggtaattcggacggccgcgatagttcgggtgt

SEQ ID NO: 33089 - DNA, 166 bp, Oryza sativa
tgatttgtgaatgaatcggataattcactcgttccgtttttctccgattgatgtttgcatatggagacggtgcaaactgagccgccgtacgtcgtctccctgcccctccggcgacacctccaccagttcggcttaggcttcgagaaatctgcgatttcaacaatgc

SEQ ID NO: 33090 - DNA, 1266 bp, Oryza sativa
gtgtaaaatttatcacaccataaatgctccatgccaaatttgccttgttattgcaccagtgaatcgtaatgaggaaagcgatgtcatatgttaattcttttaccgaaagttgttgatttcgtttcatccttctatatccattagaaatggcggtgtagaaagatattacagaaaatgaatggtttgggagatgcctctgcgttcctatgcagctgggctctggttgcatctcaacatggcatagtagtgctatatatctctctccttgtattttaggtggttgtgttgttgtgttgttgctattcgatcatttcaacgcatcaaggaaatgagacaactcaataattagttgctcagagtgcagctcttttcttctcatatggatagcccatgttccattattttctacaacaaagataggttttaacattccttttatacatataatcctagttcttagagggcaagctcttactaatgtacccaggaattcatgtcaagagcatttgcagtcaggcatcataggagattaaagaatcatgcattttgggtgtaaatgtggttggaaataggtatcagtatacataattaaggttatagatttagactaagaaatatcaagtttccggcttatcggaacacaatagttcagacatgcaccggcaatacagctttgcaagaggtcacatggggatttacaattgccttgtcattatttgtgtactttgttgttaagaaaactgtagtttggaaatgaacaccctgggtcattgaagattgttgtgactgctcatcatctttatcaccttgccaaattcttatgcggttgccataggcttactcatgctttccatcagtattcattaggattaaagtgtcattcttttactaaaactgtaatatgctcattatttgtgctttactagcatttgaattcttttctgggtagggaagatttgcactgcaaattgtttacactgtttcagttgttcttaggtttggttgttgtaggcttgtagcaggaggattgactatatctggccatcatttcatagttattaacaggaaagatgatgcaatggttttatgatttgtaataattggatggggctgattggacattatccttatgccatctccgtttaaactcatttttttttgtgatttccattttgctctgctctataatttgagtatttgactattggaattgatatctaagctattgtaacttactttgactatcatgtctattttttattatag

SEQ ID NO: 33091 - DNA, 1217 bp, Oryza sativa
gtttttgtttgtaacttttaatttgatcattcgtcttattcaaaaaattatgaaataattatttattttgtttgtgatttacttattatcaaaagcactttaagtatgacttatcttttttacatttacactaacttttaaaataagacgaacggtcaaacattgcaagaaaaaagtcaaagcgaccaataatttgagaaagaaatggtacacaaatcatcgtgataaacatatattatttgctgcacttgttttctatatatatggaaattccgtatggcttgtgtcgtttttgtacaacatctagttctgttctatcatggaactacccaaagaaatatttcggataaattaaaaaaataacgcacgtctgacaaagtagttaacttgggtgaaaatgaagccttaaaaaataaattcttcataaagaagactggcgtcatgaatcaggaattattaattcctgtattgcctttcatttgcatcagctaattattaaaatatgatattgtccttgtctatgttacagcttcatggctagtcaaagaaattcccatagactcgtgatgaacgaactcaagagtcaaccaataattgggaaagcgatctcaacatcagttgaaaactggctcgtttcaacatcagttgcagatatatagcgcacatgattattcagtggaggatttcctagcagcttcgctaattagagaactattattcctgaattacctttcattagtactatgtcacttcttggattgaattccccgcagttgaatgttcaaagattacgtagcaaatactccacggatgatgagccgaagcaattgatctctcagctcgtctgacaaatcaaggtttgagatttattatctctgcttcttaatcattgatggatacataggttaaaatataccaatgtcaaaatgatattggaagtttactgaaatattcagacgtatgcgagtacaggtaagtccctttttttttttttatgttcgtgtctcctttgaaggttggaactagaacgggcaaacgctgctgttttgacgagagatgtaaccgggttatatgctagtattaattagtatgtgaaactgttaattacatgtttctttaacgttggaacttagaactccaactaatcggcacatgcatgttgactgtcaacatcaacaggttatatatatatatacatcagctacaggatgaaaaca

SEQ ID NO: 33092 - DNA, 1501 bp, Oryza sativa
caaggtcaaattaatttattgttctaccctccatcttttaagcacacgttaatgggaagagctgtacttgcgagttctatattctatatatccatccacaaatattagcatttacctacaaatataaatatttattaatatttttcaactactccccatcctacccgataggggaatccaccacaggtatcaaagtaatttcatcacaaccttaacttccccaaaaactcatagaaatgattatatttatggatggggtatacatttttgtgcttgatggtgtatatccatgtgagtctttggtgtaattccaatattaaaatgtgtcgaaaattaagaaatactactacaaaacatatttgtacagacggctagatactccgtgtgcgatcaaaggcatctaaaaatcgacaattttcacaggtaggccttcgcccgtctagaaaaatcgattttctcaagaaggcactctaaagacccgcctgtgaaaattaagtcacccacatacaaaaagggttttgatcgaagaaaaaaaaaggaaaaaaattgattttcacaacatgcaagtatcatatatattcaaatccatattagatccactattatcatactcaaatcaacatcatatacactacattgacatgcaaacaaacatctacaagtagttcaatatcaacaagcaaataaacaacatttgatgggcatcgtcgttgtcgtagcagtgtgtcatcaagtcacggtcaaggtcgttgctgctgctcccgagctcctgccctcgttcaccattgtcgccccacacctcccctcgccaccccgctcttaccgtggttgccgtctccatcgttaagcacttggttgccagatctacaaagttgttgggggtcctcctcgtcaccaaaccgccgccctcttctctctgagtcgtcgttctgtggctgcttctgtgtaaggagagtggcaagaggacggtgatgaactcttatgcatgcgcggcatcgctctggtgattggtgagagatggagaaggagagagagatgataaggataaataatgagtgatagtaatagtctggtagaggagaggataaatattgatgggagttctttttttttttacagtagtcgatggtgtaaaatttttcaaacgaccatcttaacggtttacttttaaaaatcagatttttacaaatgaaccgtcgagagggccgtctaaccataaaaacaaagttatattcgcaggtgaccgcctagaaaattttctttacaaacgagcagtggcaaaaaatatgtccacgcagtatattttgtcggcaggtaaaaatgaacaggaaatgttataaaaatgatttttttttctgatagtgaaaagaactgcatcttgtggtgaaaattgaagggtagatcgaggcagccgcgcgtacgatctatcgcgagtgaccatggtgatgcacgtgcagtgcaggggcgtgtagctagcatccaggcgcgagcggcggcgatt

SEQ ID NO: 33093 - DNA, 265 bp, Oryza sativa
atttaagccaacttatttaggttggatgcttgtcattcattatatgatctcatctcataattatccttgttagaaggcagtaaggtttctatctccattatctcctcacttgcaatcttttaccgtgctttaaaagatcactgcatcactgttttagagtctgattgttggggaaggtttccagtacttctgattctccactgacatggctgtgtggtttgctgattaaatgatcaggtggcattctgttctccaaagagcagaa

SEQ ID NO: 33094 - DNA, 230 bp, Oryza sativa
aaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattaccttcttagggttttcttttgatttgcaccagcattttcttaggatcatttataaattaaa

SEQ ID NO: 33095 - DNA, 1501 bp, Oryza sativa
ataaaatatacgccttacattttggagggaatataataatatatctgtgtcaaattaaggagaaaaagatgctcgatcgatttatatcaaagaaaaattgagttgtttattaaattcaagatcagttaatagaggccgtgaactgtggcacctgacgtcgtgaagtcatgattcattaacaaaccagtaatcagaacgtgacaagttgcttgcttcttaattatggagcctaatcagggatcaataggatattcgcttaattgcatacatcatcgctaacgaaagcgagcgttggtttatgcatgcgtgcgtgcgttcgtgcgtgagactcacttctttttttttctgctttattatcgctagccgcatccatcacatcaatcgttcccttgcttggctaacagcatttggaatgacgtgaaaataaactactccatcatcccatgtcatagcaacctaaaatcggatatgatattcataatacaacgaatctggacatgtttttatagcacaacgaatctaaacagaaaacatgctcgaattcattgtaccatgaattatcccatctaatcgggactaggttgctatattatgggatggaggaaaatttttttataatgtcatttaaatactaaactctccacgtgcttagaagaaacttggagtgctagattttctttttctgattcatatgagaatataaactgattgctgcgaattcttatgtgtacgttctagggatgcttaatttgtttttttctcctaattaaggaaactagctgtaagctgtagcctgtagtcagggctctatatttaaatatttttaatttcattcattctgaacaggccttcaaccatctgcagcaaactagccaattatgagtttatgaccctccataatatccatatctccatacggatgatatctgaaaatatttctccctcaatacttcccactctaacaaactattcatgtttcactcttctaatatatttctaactattcctatatttataatttcattataactactatatttctaatggatataatcatctttttttacgcgaagaaagggtattaacttctaaggtttattctaaggttaacttctaaggtttaacacgaagaattgataagctattcaaattcttaatgtttgaatagcttcccaattcttcgtgttaaacattgggaagctattcaaactctccattttcttgaaatacaaccacttcaatggaaaataaatccttagaagttaataccttttcttttccccttttctccctttctccacaacgtgcccatctcgtttacagccccggacctcgtcttgatgacaagatgggtggaacggactgctccccttccccgtttcaccctctcaattacctctgtcattctcgagttgatcagatcgccactctcgaagggcattagctacaaccgaccaacacgagatctttcatgcaccgttatttttgattccccgaaccc

SEQ ID NO: 33096 - DNA, 153 bp, Oryza sativa
cacactgttcaccaagcaccagaaatcctagaaaaagaaaagtaaaaagagaaaataaacatatgcgttctcagcccatccactccagatcaaaggaatggaaaaggaaaccatcacctcgctgtggagctgttcgagagggaggcaaaacca

SEQ ID NO: 33097 - DNA, 626 bp, Oryza sativa
cacgcagtcgctgacgcgtctcctccttggcatctgacaagagagaggggtctgagaggcgaaatagataatgaggagcgaaatagataatgaggagagagatctgaaaggtgggccctatcaactttttaatagaagaattgttgactggactgccacgtaggatcaaaatcgcttataaagctacccgtggtggttttttatctggtattgatagttaagggtgaaagatgtttggtttttaggtctagaggggtaagtcgtactcacccaaaagttcaggggtgtaattcaaactttttcttttttttcttaggtagtattgtgttttatttgtaaatttcatttgaggtgaaatgtcaataaatatactgggaaaaaatggaagccaaacagaccagaagaaaaaaatacataaaaaaaaaaagctgagccgacgggaagtggaaaaaaggaaagcagaagtctctcgtttattccaatcttctcagtctctctattccccacgctttttacaagcgtcggctcacctttccttttactttctctatcgacagctctatcccaggaagccacaaagccagctagcaccaccatggttttgcctccctctcgaacagctccac

SEQ ID NO: 33098 - DNA, 251 bp, Oryza sativa
ttagtaggacagctaacttactgtcccacgctctatatattgaatgaagtctctctctgtagttaatttcattccgtagcgtagcatagactaaagcagaggcagcagaggctccagccgggttgtgatcatggatcagtacatgttctccgccccacggccctatatatttatattgaatgaaatccgtctccgtagttaattttgtttcttagagcgtagtatagactaaagcagaggctccagctggg

SEQ ID NO: 33099 - DNA, 193 bp, Oryza sativa
tatgagtggtggtggctacacaagcatgagatgagacggtgagagtctacaattaaggagtttatgttatctgatgaattgggctgttggataatccaatgggaactttggataatcctcatccgctggattttagcgataccacaatcgttggatttatataaacccctaccatattctcatttcaaacaga

SEQ ID NO: 33100 - DNA, 690 bp, Oryza sativa
ttaaattgtcagtttgtgtacctcggctgattcctggacgaggattttgtgcacaaataagttcggaaatcactagtgaatttctgggcatgacaagttggtatcagagccatctcaactgtaggataagccaaatggtcaaaccttaaggacaaattttccgaaaacatgatttgtgaaaaattttcctttcttccttctttagaattctttgcaaattgagtagttgttaaacttgatggagaaactcgaagacgtcgatgttgtcaacttctgcaagtccagtggatcgaggaataagaagatgatagtcgaatcaaagtgttccgctgtcaagatagagtgaagtttggaacctatcttagcacctataccaccaaagtgactttgaagaatagttagtagggtaaaacgttgttgcttgttttgtgtgtaggtacggttgcattcccatcattggtgtagttcaatgatgagcgtgtaattatactaggttgcttgcttaatcaacttaaacaatataatgaactacacacatcagatcagtggtaacttggttaaggtcttgtctttagtgtaacccctctcctcctaacttttccaactctgcaacgaaaaaaaatgcaagctatagtggaaacaacaacaatgctagtggatcaggaagttggaccaatggagcaatttagg

SEQ ID NO: 33101 - DNA, 306 bp, Oryza sativa
catattcatttttatttgcctaaaataacttgatagaaactttcataaattgtaaaggtttaatttggctaattaacacaattattatttatgttagcatttgttaattagagttatttgattgggttaattgaatccatatctctataaattaacggttttgaaaaaataccattacaatccatctaattaaaaggatgtcgttataaatttgtttgaaatcggaaatatgtaactacttaccctttcggtatattgtcattctcttttggaccaaattgtcccttatcactagggatgaaaacg

SEQ ID NO: 33102 - DNA, 921 bp, Oryza sativa
cgacccccagacttggagggggcggccgtcgccctgcctcgggcccgacccccctcgaggagagggccacgtggctaccgggggcagcctcctccctatggttctgatacccccggaaccatatcactaacagatgtaccactgttttataaattctaaaatgagtaaagtccatcaccggtccctaaacttgtaccgctatgtcatcccggtccctaaactcgcaaatcgaccgttcaggtcctcaaacttgttcgactgtgtcatcccggtccctaatctgcaagtttagtggccgggatgacacagtcggacaagttttagcacctggacggtcgatttgggagtttaggatcctggatgacagagctgtgcaagtttagggaccggtgatggattttactcttctaaaatcattgcttaaatttatgaatttgttatcaatcacataaatattacatctgtttttaaattttttatctataagtatatcagaatggttaacggtgtggttttgtaaaactttaggatgataatacctgagattatgcgtcgcgtgctaaaattaatgtggttttgcgtaatttgcattatatataatatgtagtgttttatgaaaattattattattcttttgaaaaaaagaatagtgttacacacacgcgtactccgtgccttcccgtcggaggaatccccggtattcaaccgagtcgccccccatctgaggattaccaccacctccacggctccacctccgcggcggcgtaatccatccaactcgcaatagatatacagtccccccaatcgacggaaccctaattctctcccgcacgcgcgtcggcgatccgaggggaagtagggtttggaggaggaggaggggagaccaccggaggtaggcgaatcccccaaggccgggcaaga

SEQ ID NO: 33103 - DNA, 173 bp, Oryza sativa
gtgtgtgatatttgagctgccactacctagtagttgataggagcatgcatattattgtgtgtttcttgtttggtactaaccatggcatgattgcgtaatggaatacgagaacatcaacttctacaccttccacgagatatgacgacttctccaaatgatgcatatgaggtaca

SEQ ID NO: 33104 - DNA, 488 bp, Oryza sativa
tctcccatacagcccccgagtctactcccgttcaacttcgagcacctgacgctacgggctacgggggtcgcgacgacgtcgcgtgctgctgccgtgcccgcgtacgtgccgtgctgcggtgccaccacgcatcacgcttcacgcttcacgcatgcccgccgcgcgtttcaggcggcgtcgggattaccaaggcgcgggcgatcgaggtgtagggccgctactggtggagtcgagcgagtgcaacatatgatgatttctttttcttctgcccataataaaggttgggcattttgctagtgttgtgtatatatgaacaagaacgcgcccagagatccctccattaattatcccccctctctgctccgtcagtcggtttggcggtcgatcgatcggtgacgccgtgacggtgtatgtaggccgactggtccacgtacgtgcggtgcgattgctgttgtgatcgaggaaccgcgaaatgggtcgcgggggcg

SEQ ID NO: 33105 - DNA, 1501 bp, Oryza sativa
ggaaattcgatgtatattttgttcgtatgtgtcatctacgttcccataatctcaaaaatacattattagctccttactcttgatttgtcgttcattactggtccctacttaaatctgtcatttgtgtgcttagacgctcggattttccgttgttaaatctgtctctaatctctactaaattgttttgacgtgattcttcttctcttaacgatgactacctgagcactgatcttcctcgtccttcaatcgtttgagcacttcaactgtaaatcaaagagggtctcttgtgagctgagctgagttgggttcttttttaaacacagtataaacggagacgattataaggtgctcgcacttacctctatgtgagaacccgtgtctaagtctagaacttgaacatatgtgtgttggatctatcataagaaatttaatcaagagttacactcactttgctaagttaattcatttgaatttgagctgagcgaatatatcgtctatttggagcatatagggatcgatttatgagaaggaagaaataaagggattcgttttcttatgctaatgtatgatgaaacgaaaattattttatataatatgatagaatggtatgggaattatgtttggataattggatctatcgtcgtaaatgaaaattttagagtaaaaagaccacctaaaccgtactcctagctagcttcttacgaatacgtccaaatgataatcagcctaaccgagctgacccttgacgatccatcgctatccacttaatggatgattgcggccaccttcagaagtccatcactgccttcacgccctactccttttcccctctggaacctctctggtagtcctaaattgaaccaatagatagggtgccctattgtaatttactaatttggtttggttggacaaaccgtttgtgtgaataaagaaagaaaaaggagtgcccagcttttactatgtgactggaattttcgagtacttcagtcatttttttcctcctgaatgacaatctaatactcactccctcccattttaaatacaaccataagtttacgtgcttaactttaatcgtccatctaatttaattttttttataattagtatttttgttgttatgagatgataaaacatgaataatactttgcttgtgacttactccttccgtttcacatctatatgaatgtgggcaatgctagaaagtcttataatgtgaaacagaggaagtatgtttttattttttttcaaataagacaaataatcaaaattaggcgcggaaaactatggctgcacttataatagagcagagggagtagttcttatcactccctttattacttatttaaacaaagtctctcttttttaaaattgttgatgtcgagggaagtccctcgatagcgggaggtcgtgagaccccccccccctttcgtgagttcgaccggaggaaggagctcgcctcttagagatcacgtatccgcccctagggctactagttagcttg

SEQ ID NO: 33106 - DNA, 408 bp, Oryza sativa
cacataagcttgtccccgatgtacaactgcaatcattgaaacaagctatactattcagttctaaatgtatgcagagtgtagcggaggttaacgttctgatgagttgctagtcttgtgggtctatggactatcctatgttatcatgtaatgtgtgaattctcaaacatgggcaatgtttccaattatttttaagataatctgcaaatgcttttgaacactgacggatctggttttcacagtgaggagcaggtgcaatgcagcactggttatcacgtttgtcttttggggctatttttgtcagatttggtaagtattaaatactatttgctgaaaaagttgcaataaatattcaaacaaaatatgagtaaaaaacaaatttgcccatagtttaacagttaatggcccaaa

SEQ ID NO: 33107 - DNA, 1351 bp, Oryza sativa
agctctcctccaatggaagctccaggcgtcgaagacgctctgctgcctctttctgccttcgcctacatttgtgagagaagaaggggagagaaagatagaaagagaggaggagggagatagaagagaggaggttagggagaagaggagatgggacgaaaatcgctaatatgtgtatcccacgtgctgacttagcaagtcaatcgtagttaaactgccacattagcagaaaatcgcttctaaaacatcaaaggagtagatttgcactggaggcgttatatcctggttttgccattaaggggggcagttcagccaggggcaatacgtcatggaggtaaaatagacttattcatgtccaaataaaattgagggctggagagattcctcagtaaataggcccattatctcatacaactagctgatctggactaaataggcccattctcttgacagcccaaaaatgcttttccttctgtttcgagatacttttgggcttactccggaggccctgatgatttgggctaatccaagagtacgaagaatatctactgctgtactgtctgcagcaaagaacaataggatactacggtgccaaataatgttgaccgattagggctcctctagaacgcctaaattttatacgattttcatcgaaatgaatctgattcccgtaagtcctttgaaaattggaatttcattcgttccatgcaaggccttaccctggtttctacctaattaagcatctgattattactagtagtattagcctaaccaagtcttattgagactattacacgcttgcatgcatgtcacaggctcacatctccggcttcagattcatgcagtgataagcaaattgaactttttaaattaattattgcttgctgaaagatcaaagatgcgtgtacgttgggtatctgacgaggtaggcaggcaggcaggcaggcaggcaggcaaggggtggctggctaatttgcttgatgcttagctacgcgtgcagatatttctcatccttaatttaattacttggcaaaggcacctcataaaaaggttaatttgcgtgtaaaccgctcttaattagcaggaaattcacaaagcttttgcgtatatacttgacttagctttagctaagatcatgactgtttgcttttgggtgacgtacacaccaacaccgtcacccaccccttcactctactttaatatcttatctccctctcactaacatatagtccactccaattatacattttttttcttacatacacgagcactttgcacatacatgtgtatacatcattaattatatatggtttgtatatattgcagatataattaattaattacaagaggttta

SEQ ID NO: 33108 - DNA, 487 bp, Oryza sativa
cgatgctatataaccaattctgccttatattttcctctctttgagaggatcaaatttccatattactattataagatgatagtctacttttcctttttgaaaaagtgtttttttcctgtgtgattttgatgtagcgttgactgctttatgatgtagtcatctgccgttattcaaagatatctactacactcttatgcgcatgcacaatccaagtgctccatccgttttaggacatgaaatatgcacttgagttagccaacgcatagtttacttatccacatcccactgatcaatgaaataccctccttgttttcgactcatctagaattccatgtgatattttgttgctaggcaccgtaccaaaaaaaatattcatttttggttgaatagaagagagaaatagtgtaaaaggtcataaataccccttgcccttcaagtcagggtccacatctcccatctcctatctctctttctgctatctcttagg

SEQ ID NO: 33109 - DNA, 1501 bp, Oryza sativa
accccttcatttcaaaatattgcaagcatttgattagatgagacctaatttagtactaaaaatcttaacatagatttgtttaaatttttaatattatgttgtgtctaatccattaatagcttacattttgaaaattcaatcggtttgaaaacgagacacagttgtgcttaattaggatggtaattaaaaggcctgatattttatcctacaaaatttaagggtagagtttaatatagggtgagctgactaggctgtggcggcgatgacacggaaagacacagctgtttgtgtgccaaattttttttatatacggacacacatttacattacagtattaaatatagactaataataaaataaattatagatttcgctggtaaactgcgagacgaaactattaagcctaattaatccgtcattagaaaatatttactgtaacaccacattgtcaaatcatggtgtaattaggcttaaaagattcgtctcgtaatttacatgaaaactgtggaattggtttttttccatatttaatgcttcatgtatgtgtccaaatatttgatgtaatggaaaagttgaaagtttgaaaaagaaagtttaaatctaaacacggcctgggtttattcccggagaagcattctactattcatcactagcttcgacgtctgtctttcatcttcccttttttagttgtacatcagacagatcagtggatgtcttccaggtttaaaagttaagtagtacgtgtttggctcaaacgccatcgattttgtcaaccaagatgacgtgctgcttcgacgacattagtttatcagaagatttagagaacgaaagaatggcaattggatttgcactgcttataaactaatcaatctcatgatgtgtaatctgtaggctcatctatcgcatattttattccaggtggtattttttactccagttctgccattacatgagatgcgataaaacctcggcaagaacagttggataaccgaaaactgcagaacacaattgcctccgaaactgcaatttacagattttacagtagtagtgaactgtcaggtacttgttccgttcaagaataaatgtagggatttcaagatttctatattttttgagtaaatatgaatgaaagttaaataagcatttgtaaattgtttagtaaatatgaaggttaaaccaaaagatttttttatgtcacttcagctgttaaaatttgaattttaaattgcttatattccttttctaagcatctgatcagttttagaatcatttgataagaatccataagccataaggaatctctatatcacgtacaaatttaaatcctacaaatccttatgttaacagagggaatatacatcacataggaatctctatattacgtacaaatttaaacccttatgttaacagagggagtatacatcacatgatcacaccaatcgaactgttgttatggacaatagcagcagatgcagagatgctgctggtgccaattcattta

SEQ ID NO: 33110 - DNA, 1501 bp, Oryza sativa
atgttcgactctgtggttgagcaggaatgatttggtttttgacaaatcaccatctattacatatatgcagggaattttcagggcaacatattggctccggtgttgggcttagctacaaaggtgtgatgaagatgacaagtttatgaaggttgcatgccgtaggcttgagacgacagttatgcaactttttgccaattatggttggagattcacaaatagacttcaataacatgttctccttattttagatgggttattttttatttaaagtgtgtgttctcaatgttttgttgaactacactatttttttagtgtaacttgtaataattggctgtagctcgttttgagcaaagaccgggatattttattccattatctaaaaaaatttatccccgcaaaaaaaatgtcaggtcacttgtggcaccatgaggtcaccctagctcatcactacacttgctgatccgagtgccccacaactacaagccagtaaaattggagaagattggtgacttggtgacagatgaccatggttttcaattttgattttgtcctaaattttgctcattttggttctcccgaaagttcagaattttcggcatattttggatcgaccttttttgaaattttagcataatttagctgaatttgactaaattttgaccaaatttgtaaaagattgagaaaaaccaaaatttttagccgagataatcacttgctagggggtccgaaattttgaaccgaaaacgcaatccctggagacgacctataatggtggaaatcggtcgagagaacgatttgcacaacagggttaccgaaaagcagtggacaaaaggaataaattgtgatttattttaaactgaacacaaattactaccaacaaaaccaagcgtttgagcataggagagcatcacaactactaatgcagatgatctgtgtgcctatgtgccatatttagctcttcaattgtattcacaccgtccaatatcagaagatgcaatgatagaatcattctatatgtctcctaaccctaataaaagctagtaaaactggagaagatttgtggcttttggtacgggtgaccttgaactgtggagaacggtcaatagaaaaacttgctcaacgaggttaccatgtgaatatcgttttatcttcttttgtgtgtttgctgctcctgtaaaggacttcttttaagtctcttctcctaatatgaaatggcagagctcctgcccgtttcctcgaaaaaaaatgatggttaacagaaaccaaggacttgagcataggattgcatcaaaactactaatgcagatgatctgtgtgcctacattgtcatgtgtagctcttcatttgtatccgcaccatctcatgtcagaaaatggaatactggcatcattccagatgtctcctaaccctatttagcttgtcatagcacttgtttgtcattctcattattggtcgcttattttcttataacagtatatggttgtcttaaggtgtggtgtgg

SEQ ID NO: 33111 - DNA, 608 bp, Oryza sativa
aacaacaacaacaacaacagcaataacgatgtgttaaggtcacaaatcaatggttcagttgaaagctgcaaggtgccccaatgccagaagaacccctgctcgtcatcaatttttggtgtccaagattaggtgttggatgttgatgcaggagatgcaaagctcaatgcaaggtcgaatgcagcggaagaaactccagcagtagtgtgttgcggtcagagtcagtggatcagttcaagacaacaagctaccagcttagttagagcacctcgctctggttagccaagattggaagatggatgtgccagatattatgtagcacccacagagtccgatgcaacagatgcaacaacagtgtctccaacaacaagtacaagctcaagatgcaagcgggattttggatcagagccaaagccagttttgttttccaagagcaagcacccggaacctcagacagtacaccaccaagttctcagcagaccagcacagccaagccaccactaatcctaggagcaacaagtgctacctacaatggttatggttttcaagggcagttctttcaaggtgttcaacattaatggaagatgtacgacatgtcactcctccgtagg

SEQ ID NO: 33112 - DNA, 212 bp, Oryza sativa
catgtgacacatatgactttgatgatttattattgatcatacttcaattggctaagtgttgtgatgccatgatgattattttttcaaaagccaattgaattagtattcatctagacatattagttggatattatgatttttcatatgtctagaaaggagttttggttcaataatttgatataccaagcatctggctattatgtgaagaaaaa

SEQ ID NO: 33113 - DNA, 340 bp, Oryza sativa
atctattcatgaacctgcaaggcaaattgctttaggctgtgtttagatccaggggtgaaaatttttgtcgtgacacatcggatatacggacacacatttgaagtactaaacgtagtctaataataaaacaaatcatagattccgctgtaaactgcgagacaaatttattaagcctaattaatccatcattagcaaatgtttactgtagcaccacattgtcaaatcatggagcaattaggcttaaaagattcatctcgcaatttagacataatctgtgtaattagttttttgtctatatttaatattttatgcatgtgtccaaacattcgatgtgacagga

SEQ ID NO: 33114 - DNA, 254 bp, Oryza sativa
gcgcctgctgcgagtcgtatgtatgaagcggtatttcagccgccagcgctaactatgtgtcttacaggagtagttggttgatgtttgctgggcaattagcaaccatcaaacaggtatacagaacaacagatccaagtcagggcagtttcttggggtgtcagttctcaaactggtgtctgcacacaacactccatctggaaaactggaaactaatactagtaagttcaggatacggagtacgttttatctggcaa

SEQ ID NO: 33115 - DNA, 1501 bp, Oryza sativa
ggccgctgaacttaggctaggctgcaagcctactttgtgatgggggcccaaagaattgggggccatgtgcggctacatggccttcaatggtacgaaccacaatttttttccttagcttcaatacctgtagtgtatgatcggatcaagcttatttctccattttttttccgattttgtgatattttggagatggcctaagggctaaggagtgccgtatttatccttttcatgatcatttcactttttaaagcacataaacattacatggcgttttggtttgataccaaaatgtgccataccaatttttaggtagtttgaatagtaaatgtaatgatttggtttaaagccagatatttggtaatgcttatacttaatttggcacaattctaaaatattcttaccacaatttgaaatttggctctcaattgacataaatccaaacacatccatttacaattctaccctatcaaaatattaatagtaccaaaacttgcatagattttggcactaccaatattttggtagggtactagaccaaataagccctacattacattatatgagtgctaggcagttcttagagatgtgttcgagttactccctccgtcccaaaaaaaggcaaaccctgggtttccgtgtctaactttgactgtccatcttatatgaaatttttttataattcatattttcattgttgttagatgataaaacatgattaatattttatgcgtgacttgtctttttaatttttttcataattttttaaataagacggacggtcaaacgttggacacggaaaccagggtttgcctttttttggatgaagggagtaggttgtaactggagtaccatgttggcaacttaacatactttataaactggtgtaaagtacacggcgtgacgacaaacccatgtaaagtttgaaaattgaatcactcacccgattgttaggaacatatatagtatcatatatatgtttttctatattcttcttccaccgtcaatgagaggccaagctggtctaagctaggttccgttcatcgtctgtatttcaatacttcttgacaaggtgataagtggcttcgcgtgttttattatctcttaacttaaaaacgtggaccactttgatgaaacctaaatccaagcaaagttacacgtgccacggacggcaggtccaaactttttctcatgcaccggtgcggcggccacgagagtggcacgaacccttttccggatggaagcaaacacatcaccgctccagtgtgtgcagaaccccgcgagtgagggaacccccatctcctacaaacgcggaattattttacccattcaccaccgcaaacttgacccaaattcgaaacgcgtcctcgcgtccgcggtccaaaagcccctgcccctcctcgctctctctctctctcttgtgcctcctcccttcgcaatcgccgccgtgtccgtgcagccctcgccgcgatctcccttcccctcctcctcccgatccccacca

SEQ ID NO: 33116 - DNA, 1501 bp, Oryza sativa
ctaggtgggtcagtgggtgataagcagatttgttctttcacggttttaccaaattatgtgtggttataatagagcatttttatctagggaggacaaagtagatggattatgctctgcaaatactgatgggcctacagcacttctttactctccgtaccatgtgacactccacagaaagtaaaggaatattaaaatgtgggtaagaaattgatgggtttgaatcatactccctccgtttcctaatgtaagtcattctagcatttttcacatttatattgttattaatgaatctagacatatatatctatctagattcattaacatcaatatgaatgtagaaaaatgctagaatgacttacattgtgaatatatatctatctagaatagtttgttgcattatgatattcacattgcaaatgcccttaaacaccgtaataataagttaacaaccacaactaagacatggcctaggctcaccacccttggccatataggcgaaggggcaaaggaagggcccctctggctggccatgcagcacggccgtgcaccacaacgtcacaggcagccggccgcagcaatcctccatcctcacctccacctccagcgacacgcgctcgcgccgccgccgctggctctccatgcgctcgtacagctcgccgggtatccccaccccgtcgctggtcgccacgatcggcacggagccgaccgcctgccccggcacgcagaacccgcccgggaggtcggcgtgcgcgagctgcacgccagcgtacgacaccgccgcgctggcccggccggcgcagaacgcgcggcgcgtggcctcgttgtcgacgcggagggtgagttgaagacgggcgccgctgccgccgcgccggccctctcgagcccctcgatgccgggcaccttcacccagaagtcgggcttccggtagccgtacatgctgttccactgcccgtacgctatgagcgataagagagtcgcgatgaaggtcgctagtagaaagtatcgtagacatgggcgcctgtccaggcaattgccgtggtcgtcgtcatcttccgccatgtcggcgcccatgactctaaccgctaaaacgatgcggcgagaaattaacagtatcaggaccggacctggataggcacgtacacctgtacgttacttataaaagactggtcgtaactcgtaacggaaaaggtaagactggtcgtacccagacttcgggcctccggtagccgtactcccgcgcagcgtcgtcgtggccggcctcgtggatagcagcagggcagcacagttggccccagcaaacccagtgtccacaggaggcaagctcgcgaggagcgacgactaccacaggcgcttcttgttcgcgcggatcggcgccctcgacagcatggtacgtcgctgccgccgctgcttcgactggtcttgatcgccatgagcccatgagctgccatgcatgcatgctttaatactagctagttacgttcgacaagatctccaatggatc

SEQ ID NO: 33117 - DNA, 1501 bp, Oryza sativa
gacggcctcccccttgccctcgccgaccttcgtccgcactcctaccacgaggtggttcaagggcactggcgacaatggagactcgggactggtaaggggaggaaggttccaacttgcctcatggcttggttttcaccaccatggatgccagcgatggcgtcgggttgaagactctgcccacgctacggctcggggcgatgcctgtggcggctacggatgaaaacggagcggatacggacggataatgctaataccatattcgttttcattttttttaccggatatgaaaacgaatacggatagctccaatacggaaaaaaatacggattatctcgaatacaaataagaatcgaatatgatcagacacgaatactgaaacatttttttctcggaatacgaaaaccaactcaacttctaacagaaacacatatcaacatatataattagctcattttatataaagtgaagtataatttataaatgtttttttaaattttaaataatattaatagtatggactagcgttaagagataaactactattaaaatctataaaggtatattgaaggttatagagttaaaaagaaatagggtatatctcatggcttctgcggatatccgaatagcactgttcaccagatatctgaattattatccgtatccaacggaaaccccgataccatatccatatccgtatctatatccaaactatccgagaattatctgatctgaaagggaaactgtgacatcccggctcacggcttaataggattaatagaataatcgtaccaacaagttgcaacttctttttcggaagtcgatctcaaaggaactctaaagttaagcgtgcttggcctagaacaatttcccgggaaattcttgtgttgttgtgttggtcttgagcaatttcgggatgagtgaccgaccgagaaattcttgtgaaattcttcccgggtgcgcacgagtgacgataaagtgtgcagaaaagacttgcgggatgatacgtaaaacgaggtgagccattagtgcatgattaattaagtattaactattttaaactttaaaaatggactaatatgatttttttacagcaacttttctatagaaaatttttgcaaaaaaacgcaccgtttagtagtttgaaaagcgtgcgcgcggaaaacgagttacaatcttccctttctcatgtgaacgaacacagccatagagtggttttgggagttgagggataggttatacccgattttacggttgagagatgctattcaaccgggggcatgagttgaaggaggcaaaactacttattccatgacaacatcttgggccataattatgcatgggcggatgggcctatccaagtgagacctcaacgacctgaaaagaaccctggcctggcatcctgtcccacacactgacccacactttggcccttgaaaaatcgagctccgtccgtactgatcagccttcagctcagaattcagtataatgagccaagagacgc

SEQ ID NO: 33118 - DNA, 341 bp, Oryza sativa
taagacgagtggtcaaacgttacaagcaaaaactgaaaatcccttatattgtgggacggagggagtacaccgctactacaggattactgtagggctcatttcttttcgtcaatttttcgtggcacgctgcccaacgatacagttctgcagaccgcgaggcagagccagcgactctctagtctctactggtcgtcgtttcatcacactgccggggacctgtcatcaccgcattggctcacatcgcatgccttcgctggtgggctcgtttcacgtgcggcctcatcaccagatcgagccgcactcgtgcactctactgcctgctggttcttgttcatcataca

SEQ ID NO: 33119 - DNA, 408 bp, Oryza sativa
tgttagttcatgattttttcctgattccatgtttatatgcaataattcttgcctgatttctgtcaggcaatttcaaaccggttaaatgggatagcggcgctatagcccgctatagcctttcttagcctctacagatcccagccggtaaaagccatagccagctattttgaacattgaagtggagttggccaatggagctcgaagcggtgcggatttgggtggcataggccgacagagctcggggcttccaaccgccgcctcttgttcacaccgcctccctactcttcagtgtgccgccatccaccgtccccctcctcgtcgccaaggtgctggggcagatcaggatgccgtctccgccgctcatcctctaaagagttgccgcctacctccctcaggcacgacacgaag

SEQ ID NO: 33120 - DNA, 184 bp, Oryza sativa
ctagcttgccctttccaatttcaaaatgagtgttcctttcatgaaaagggtaatgtaatcatatgcgcatatatgcacctttgcagcgatagttagtaagaaatctttcatcaaaatgccgttaattaactagtgaatctgtggaaagatgaaatggtaatgtagtagtacaagctaggttgag

SEQ ID NO: 33121 - DNA, 1501 bp, Oryza sativa
gtgagcaatattagaaagtcttataatatgaaatggagaaagtagtattttaagtcaggaaccacgtggctggcccgactgctacaatggcgcaactactcgtgctagcacgttagcacgtaaccgtctcccacacacaaatggacacaatagttctctctttcgagggaagcgagcataggggcacagactgttatgaaaatagatgcacaacggagacatgaattttacgtggaaaatccttgcgggaaaaaccatgggcgccgaccggcaatgatcactatagaggaattggatacaaacgcaagtgatacattgggctgtcgcaccctcccggtgtggcttacaagggatatatatagcagaaatctaggagccctaataggaaactaatcctataaagtagagtcctattagataactaatctgaatatattgtgggcccgaaattcggatcacatatttaacaatctccaccttgagacgaatttcccttgtagcataaaaatcttcaatctccaaagaacctcgtgatgataaaatcaatgtgcgccaaatagtcacttggactataatccataacacccttaatccagaagaggtagaccatacttcaaactcgccattggaaacaaatcctgaatctgttggtatgacattgtggaacccagcagagacgtgaaactgatgcacaaacttcaaactcgccatgggaataaaatcctgaatctgctggcattaatttctggaatccaaacagaaacgcgaaaaattcttgtgcacaaaaacgaagtacttagatcccctgataacctcctggtatgttggatacaatggtagcaaaattcaccggacaatttgatcatcttgtgatctagacaggagcgaggctccctctcgacgacttgaatgtacttttttttaatctcaggtgcatgacttatcctccttgaaacatgcgccaacttgcatcttcacttgccataacgagattgcatctcaatccaggagtggtagatcaaacttctaactcgccttgggaataaaatcctgaatctgctggtacaatttatcaaaccctaacagaaactcgaaacactctgggtgcataaaacgaagttgatttccatgcagaacctcctggtagactggcttgtgaatatagcaatttagaacgtgaatttgtgttcccctgaacagaaccaaaacaatgcaaggcttaaatccctggtgcgaagggcgtgtgcacgtaacaattccaacgtgaaatttaattcacatgaacagaaccgagaaagctactgaaggcttggacttttctccttcctcgggatgcgtgcggaatagatcaatggcttcaaccctgctgctgctgcttctgattttctcctgcgttgcttgatggacgtgattcatatcgatgtgttggagcacctgcttaaatcgatctggtcgacaccgcttcgggtttgcttcaccggtgattcaatctcaccgaatt

SEQ ID NO: 33122 - DNA, 431 bp, Oryza sativa
aatatgcttcaaagtgaggacgcctacgcgaaaaagggttattttttcttgacggattgtcctagccgccatttcagttgcagataacggaaaatggcatagtgaaagatgattgttcacgcttgtagaagtgaggagacgtacgtccaagaaggaaaagttagttgcaaagctgtacttcctccattttaaaatatagcagacgaagggagtagtattcatgtagagtagtactttctagtttgatgtgatcaattaatacgagtagtaacacaatttcagaaatctagccaacttattttggttggagtacaggagtatttcggcaccctcgtttgatgtgatcaattaatacgagtagtaacacaatttaagaaatctagccaacttattttggttggagtacaggagtatttctctgaccacaattt

SEQ ID NO: 33123 - DNA, 278 bp, Oryza sativa
atttgagttgaggattaatatattggagggtatatggttcgacgataggaattgtaaggttgacataactcgagaaattacgtccccttttggcatggaggcattttagaggaatttcgtaggaaacaaactaatttttgaatttctgcgtttcaaaggagtcttaagatatgatatcaattaatcgtagttagtcctgccatacatataatttattttccataaccatcattgtggtagcattgtgaaaagccttgaacttgtacgaacaaccaaca

SEQ ID NO: 33124 - DNA, 280 bp, Oryza sativa
cgctgctagcttggtgtgcttttttgaagtgcagacctagcgactagcagcaagtgacgccccaacgcattttcaccactagcagcaagcgacgcagcagccaggaagcagtagaatactcctgtagtgactttttacagtctcgttggacaaaaaagggagagaaaacagaattgacccaattgagcgaaacgtcatactagcttcttccagctcttactgggattaattctggtcgtgacagaaaaactttagttcagaattaatttttggtctaaca

SEQ ID NO: 33125 - DNA, 1501 bp, Oryza sativa
aatgctagctgagtaccatgtgtgtagagttactgtgtaatgtaatgttttcaacttggtgtatttatgatgatgaaaacaagtatgcaatcagggtttcttttaatttaaagctgtatcagattttgactttgtacaatgttttatttaaaagagtgttcttttgtgctaatgaaacggaatgctgattgtatgaagtatttgtgagaattattcaagggcacaaaccaatcgatggactattaaaaagttaaaatggatttaaagcattatctagttaataagaaaagattttgtaaaaatcgcaaattaataacaaacacgccgccatgccactttcctagaacaaataaaaatttttacagtcttcgagggataacaagaggtacctaaatatggaaccttctagtaccggagtttacattagaaaatatgataccttccaataacttctcaatgactgtaaaaacttttaaaacaaacaggttactactttgaactacccctatatatttcaagtactcccttcagttacaaataaatacatcatttaaactccataccgttaataggagataactttgactgtaattatatttttaacatgggttttaggcatatgaaaataacatgaccaaaaatgttgtaaccaaagcttttgtaatattatggtttgtttatgaaactattcagatctataagatatagttaatggttcaaattatatggggaaaaaatatgtagtgaaaaactaagaaaaatggatgtctaagattcgtccatatcatcatgagagtaaatctacgagtaaaatttttactcgtgatgacatggacaaatctcatatgtctatttttatctaatggtagttttcaggttttcaatatatatatagtttctaccacatattttttcccaattatgtgttaatgacgtctaaaacatcacttattagtgtcttgagtgagcatgttttttttaagaacaaatcttgtatgaaacaactcaaatttaatatgaacggcctcaatcaaaccctaattgaagcccaatccaaaaatttgggctttttttcttaaaaaaaaaaccttgctccaatcgtttccttatatgtgtctcaaaattggaatccccttctccttctttctcgttcttcataagtgaggaggcactcgttcacaatttttgcacagcaaaggaagaggatgacacgtgagaagagatcgtgcgtagggaaggtatggtggagcgatttctttttgtgtttctgttgatactaatgggtgggtcttttttaagttaattttaaaatatcttttggagagattaatattttcacatctaaaattatgtttaggattaaaaaaataaattttagggatggaattttgggtgctctcggaaacaggtcgagaggacggaattgcgacttaatttgccaggctgtgtatgggctgcctgccaacctgctgttgatgctgtgctgcttggttcctgcagc

SEQ ID NO: 33126 - DNA, 1501 bp, Oryza sativa
atccttgagtaaaaatttttgtgcaatttttcatactacctagtaccaagaaggtattaaattttacattaaaaaatgtgttaactcctgatatcttctcaaggaatataaaatcactctagaactaaattgttctaccccaaatgtcgcaaatctaaagtatcccaaagtaaattttacccaaacttactccctatcatccttccacttcccaaccacccataatttaacgatggacactacatttttttttctcatcatccttaactactaagcctatcagacagggtaataactcggctcattgggacaattatcctcaaaggcttttggcttattgaccacaaccaaaatttaggttctgaaacttaatttcagttaattttgaggtttttaatcttaatttattttctaacattcgcttttaaaatcgctaataagaacacacatatatacaagttttttttataaattagtttttttttctttatattttcacggcttattagtcatacatcaaacaatcaaacaatgacaacgtaagagggtgaaaaaatgtacatgaggaagcgacgacgatgaagagaaaaaattggacagttgcaagcacgcctgtccaagatgcagcagccggcaaacataggcccaaagggggaggcatatacagctcagcccacaaaatgatgcaacaaaatcgtttttaatcgaagcagtttctctatccttattacaagtagtttcttttttcaattaattaaactgtaattttataacccgtaatcgttcagtttgtaatctctataataattagctaaaacttatgtgaaacaaaagtcggaatgaattccattattgaaaaagaaacaaacacgtttttcattcgtcaggtttctttgcattctaggatctgattgagaactaaagcatatacttttgttcttcaattcatatgctcaccttctctgaattggtaatactgtaaaataccggtaccttcaaagccgctgaaagatacagatttttctttgtttcgagagataaatacgtattactacataatgcacctcatgataatgaagcccggaaataatactccttgtagccggccgatggctcgacctacttgtctccacacacgaacatactccctcattccctaaatgtttgatgctgttgacttttttaaatatatttaaccattcaaaaacttttgtaaaatatgtaaaactatatgtatacataaaaatatatttaacaatgaatcaaatgatagaaaaagaattaataattacttaaattttttgaataagacgaacggtgaaatatgaaagtcaacggcgtcaaacatttagggatggagggagtacatagcaactctgacaggccggctgcacacttataaatatacagttcctatgccacactgtcttgcaaaacccaagtgaaagaaacattcaggtttcagcaatgaaggttcagacttcgtcaccttgcttgctac

SEQ ID NO: 33127 - DNA, 611 bp, Oryza sativa
tctgaccggccttctgtcggcgatctgaccggcctatacacggcggtcagaccggcctaattagaggaaaaccggcagactttcaaactttggcaattttctctattttatttctaggtgttaaatttgggtgtaaacactaacctcactttagtttcaagatgacatgaatcgagcggtcaagtgtaagcaggcaaatccgcaaacatatttataatacaaataagcgggtagtataagtatgtttgttggtctgcctacttgcaccattgagccatgtcacaggctcacagcataagctattatgaatctatgaaacatgagtagattttgttggaaatatagtcattaatcggcatattttaatccaaaaagttaaagcaatgatcatggcataagcagtgtagggtgatcttaacataaccagtagcatactatgcgcatcatgaatgtcaggaacaggaacataccagtaacgcaataacatgctagaggcatcatgtagaacaggaacaagaacatagcgcacatagtatagcgatagcgctaacaatgggaacaagaatagcgctaacaacagtaggcaggaggagaagagtataccccgagaa

SEQ ID NO: 33128 - DNA, 1501 bp, Oryza sativa
tcggctcgctccctggcctcctcacctcctctctctctggcctcccccgctccggccgccctgctattgccggcatgcttcggccgttgccgctccgcccgtcccgctctaccactgctgcttcgcccccccgttctgcctacggcttgccaccacagctgctccacctgtggcttgccaccaccaccgctctggccatcgctctgccgtctcagggaggccaaggaggtgcccgctgccgccggcgcgcgagccgcagccgcctgcatctaacgggagagagagagaagggggtgagagggaaagagatagagagagttgatatatctgacaggtgggccctacccttttttcattaaaaaaacttgctgatcggactgccacgtagaccaaaaccgcttacaaagctgctggggggttcattcggtatcgataattgagggtgaagaatgactggttttcaggtttaggggggtaatttgtactcacccaatacttcagggggtaattcgtactttttcttttttttaaacaactttcgaatagaaactttttgcaaaaaaagcgcaccaaaatagtagtttgaaaagcgtgcacgcaaaaaacgagaaaaggggagttgggaaaaggggaaactaactgagcctaaggtagtatagtatgactgcattgataaatgttaccaagtaaaaaaaaaatactttaatacgagaacgataataatttaaatgctaaaacgacaattgaattgaaactaaaaccgacattctccctctgtcgcaaaatgtaacaacttatagcaaggtttgtatcaaaatataataatttttttcaccaacattcttttctcaatcaataacaactctccaccatttaattttttttacctacctccacttctgaatcaattgtagtttttttttctatttaattttatctatttctcatacggatggagggagtatatacgaatctaccgaagcggaagtaggattgaaaaaaaagatggtctctcgcttgagggtgcgtggagcctagagagaagaccgtgggttgacctcggcaagcgaacatgccgcgttgccatgtgatgtgtgtgatgcgaagccgaagcctgtgctctgctctaccggctgctctccctccgtggacgtggacttggtccggtcttccttcccttcccgggcggcctcgccagaaaagactccactccagcagtccagctcctgcgcccggtgggcccactagacttggctgatcgggaccgggacccacccagacgtggacgcgctcactggagtcctcgactctagtctgactgtgagttgtgtgactcggactcgctctctcacccgacccaactcatcagtcgtcgctttcagaaatctttcattagaaaaaaataaaattcatcagtcgtctcctcagtcttcactatactattcctattactaataacaatctcaaggaatattttgtttttctctatactattaggagt

SEQ ID NO: 33129 - DNA, 379 bp, Oryza sativa
taaccccgagaacgcaagccgccataacagtttacctctggttgaagatcgaatcgatgcagttcaacccgaaagtaagaactcgtcgaaataaaacgaaagtaaaaagggtggcgatgcgccgagatgtattgaactgtgttaattgattacatgggttcgggctctatttatacccgagatacaagatatgcccttgccggacacgacacttatctctaacaaactctaagatatcataaatctttgcggcagacttttgccaaacatatatataaggaaattatacaaaatattctaattaatagatacaattgcctatccgagagctttatctccattatggcaatcctcatgaagcacaccaactgattctaga

SEQ ID NO: 33130 - DNA, 1501 bp, Oryza sativa
gattcgattggcaatgtagttctaggaatttgctgctcgcctgctcggggccacagagggttacgggctgggctgggctatgtctgggagcatagcagacaaggctgcaggaaccaagcagcacagcatcaacagcaggttggcaggcagcccatacacagcctggcaaattaagtcgcaattccgtcctctcgacctgtttccgagagcacccaaaattccatccctaaaatttatttttttaatcctaaacataattttagatgtgaaaatattaatctctccaaaagatattttaaaattaacttaaaaaagacccacccattagtatcaacagaaacacaaaaagaaatcgctccaccataccttccctacgcacgatctcttctcacgtgtcatcctcttcctttgctgtgcaaaaattgtgaacgagtgcctcctcacttatgaagaacgagaaagaaggagaaggggattccaattttgagacacatataaggaaacgattggagcaaggttttttttttaagaaaaaaagcccaaatttttggattgggcttcaattagggtttgattgaggccgttcatattaaatttgagttgtttcatacaagatttgttcttaaaaaaaacatgctcactcaagacactaataagtgatgttttagacgtcattaacacataattgggaaaaaatatgtggtagaaactatatatatattgaaaacctgaaaactaccattagataaaaatagacatatgagatttgtccatgtcatcacgagtaaaaattttactcgtagatttactctcatgatgatatggacgaatcttagacatccatttttcttagtttttcactacatattttttccccatataatttgaaccattaactatatcttatagatctgaatagtttcataaacaaaccataatattacaaaagctttggttacaacatttttggtcatgttattttcatatgcctaaaacccatgttaaaaatataattacagtcaaagttatctcctattaacggtatggagtttaaatgatgtatttatttgtaactgaagggagtacttgaaatatataggggtagttcaaagtagtaacctgtttgttttaaaagtttttacagtcattgagaagttattggaaggtatcatattttctaatgtaaactccggtactagaaggttccatatttaggtacctcttgttatccctcgaagactgtaaaaatttttatttgttctaggaaagtggcatggcggcgtgtttgttattaatttgcgatttttacaaaatcttttcttattaactagataatgctttaaatccattttaactttttaatagtccatcgattggtttgtgcccttgaataattctcacaaatacttcatacaatcagcattccgtttcattagcacaaaagaacactcttttaaataaaacattgtacaaagtcaaaatctgatacagctttaaatta

SEQ ID NO: 33131 - DNA, 172 bp, Oryza sativa
cccttggtaaactgatctgccagatttctagccgtttggacatagtccaatgctatcactccggagtttttctgctttctgacagatttcagtcttctcatgatgtgtctagatgacttcatgttgtcctttgaattgttcactttaataatcactgtttaattatcgcagt

SEQ ID NO: 33132 - DNA, 1501 bp, Oryza sativa
cttgcgtgatagttttttcaataacttgatctaaaactatgaatttttcattttattcttaaactgcaattaatctgcatatgtattatttttttatcattttcatctctcatctcatccccatctaatatcaatagaatccaactttctgtctatccatcgaactgtttcttctccatgtcattgctcatttacctgctcattattcagtgccaatctgctccatctctctccttcctgtcactattgtgccttacagattcatgtgaggaaactacactaatgtagtggaaaaaccaaagacctaaacaaactgatggcatgaattttaaaaaagaaactaattcatatcatagtagacaaatagttctacattggaaagactatttctcttaggaaaaaggcaactcatgaggtggtagggggatgacagactcaccgccaccaccactaggtcctttttatatactgtagtggagataaatttaactgaacctcggtaagaaaaaaaacattcagtgatgtctgagtcaaaagaaaatattggtgtggcatctctagttactatgtgacaaagtttggagtatagttatcactgaaattgctagttgtagttctttatcaaaatcatagctccacgaacagaaaaaatcaagcatggtcttccaattgtgccagactttgtatcttctagtttctctccaaaccaggttcatcaaataattactcagaccaaagagtgacgtatgctctatcaatccatgttgctggggacacaggtcaaagatctcttgtaaagaactaaaaatggtttcatgtgtcttgagtggtttcgtttgataagttttgcaggttttaccttgaaaatggttgagctgcacatctgaaacctaaatttttgggttacattataaattataaaaatgttaatgctgcttttgatatttgatgcagtagaaaccacaccagctagtcagtcatgattaagaaagaatgacaagagcaatgatgactagatgaattgcccaggaataataaatggtgtaatatatgatattcattattgcagtttcatatctaggataggggaactgaaatttatgttagtgagctcaatagttaagctatggtcatgacggcgtgtatacagatgtcaggtgaggactcctttatcgtctgcaccagatcaaatgtggcaacaatgaggcaccacaaattcaggattagattgagttagttttatctttctgggcttgttagttttcagttgagaataatgtggctggcaacagcattgtataagctgaaaatcggcctattttgcttagcttggagattaggttatgctgagcttgcgtcctgcctcttccacgcagtgcctatgatggctccgccacgccatcgaggtccagggccacatcttgtaaccagcttcaaatatagtttatgttgcgtttcctcatctattatactagcccgtgacaatagaagccataatgag

SEQ ID NO: 33133 - DNA, 227 bp, Oryza sativa
tctattccataccccatgctaatgcttgcctctggacgagcacggttacaaacatacttcttcagaacgcccatgtacctctcgaaaggaaacatgttgtgtaggtgatgtgcactagggttcccgatcttccgaaaggttctgataaacaatgatttggacggagtcgcgacacaaatcgatccggcttcttgaacgcgcacgctcttgagccccgcaatcgcagc

SEQ ID NO: 33134 - DNA, 1501 bp, Oryza sativa
tactcaaaattattatatagctagtgagccagccccatttccaccactgtgttttgatcaagaaaagattgactgtgacatgttactactggtttaactactgtaattaccttggttccatgcgtatggattcagctcaagttcagccacatctttcttcaccagaaatggccctagctcctgtgcctgtccaaacccaatggaagaacatccaggtcctacaaaatgcaatttcaaacagcacaaggttacacttttaagctaaaattctctcttcaaatttcagcagttagttttattaaccagaattcccagctgtcattaattagagatagatgcacttggtaattaacctccatttagccacaagacgagtggcttctcgtcaggcttgtcagtggcctccaagaaccagtagaagagtgccttgccaaggtactcgtcagtggtgacatagccggagtattgcctgaattccggcgagtaggccggctgcccgggcagcgacatcacgcggtcgagctcctgcaactccatggccgccgtggctgatgcatcgaggctgcccgtttcaggccgtgcagaagcagctgggccacacagtgtcagtgtaaccagtgcaagagagccaagtaggagtagcaagcaaggtgacgaagtctgaaccttcattgctgaaacctgaatgtttctttcacttgggttttgcaagacagtgtggcataggaactgtatatttataagtgtgcagccggcctgtcagagttgctatgtactccctccatccctaaatgtttgacgccgttgactttcatatttcaccgttcgtcttattcaaaaaatttaagtaattattaattctttttctatcatttgattcattgttaaatatatttttatgtatacatatagttttacatattttacaaaagtttttgaatggttaaatatatttaaaaaagtcaacagcatcaaacatttagggaatgagggagtatgttcgtgtgtggagacaagtaggtcgagccatcggccggctacaaggagtattatttccgggcttcattatcatgaggtgcattatgtagtaatacgtatttatctctcgaaacaaagaaaaatctgtatctttcagcggctttgaaggtaccggtattttacagtattaccaattcagagaaggtgagcatatgaattgaagaacaaaagtatatgctttagttctcaatcagatcctagaatgcaaagaaacctgacgaatgaaaaacgtgtttgtttctttttcaataatggaattcattccgacttttgtttcacataagttttagctaattattatagagattacaaactgaacgattacgggttataaaattacagtttaattaattgaaaaaagaaactacttgtaataaggatagagaaactgcttcgattaaaaacgattttgttgcatcattttgtgggctgagctgtatatgcctccccctttgggcctatg

SEQ ID NO: 33135 - DNA, 1501 bp, Oryza sativa
ataaatacataattacaacaacaaaattgactgctacaaacccatagcaattccggatcaacaaataaaataaaaaaattgcaaagggataaacaggtggagaaacggatgtgcatcgtgcacacgatgtccagcgcagcgtatcccagccgttaaaattcgactgtactcagtcacataatgtggcgacactttttcagcaaatccgtagttcattgacccgttatcttcctgacaggcaacagttatccacttatcctcccaagttccaaaatgataaagagtatatatactcccgacgacgggcccatataactggccggatccacctagtgccattaatttgcctgaagtcgccgtcttacatatattttgtttagtatctatgtattcagaaatctgttagaataattgggctaggcccaacttataatattaaatctcaaaggcccataataattgttgaggataataataccacctcaggatttaagcgagaaatatctcaacctaaatagggagttattggaggctccctgttgaccagttgaggtaggggtcggaatgccacgcgcgcgcgcgcgcgccgggccgtgggcgaggtcgcggcgcgcgtcacgtcgctatccttttgcaggcactaacccacgttcccacgattccctccgcaacagctcgtccacgttctttctcctgatagataaggaggccgcgagtccgatccgttttcttagcttctttcccggtgcgagtccgatccgttttcttagcttatttcccggtgttagtttcttcttctccgcgcctgagttgctctcgcttcctcgcttctgatctcttgcgcgcatgagagattggaaggagcagtgcctctgaaaccacaccttcgcctgagatctgcaccgggtaggcgggtgatcaggtttttggggagtgcctcccgcacgactgctcatcgccatgtctggagttgccgccgctactgctggcggaggtggtacgccgccgacaggagctggatctggagctggtgcgccaggaggtgccgtgaacgacaacaacaacggagtcaattctgcctcaccatccagcggagggccattctcggggtatactcttctcctcctgctactgttgttagcgctattcctgttcccattgttagcgctatcgctatactatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgctttaactttttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 33136 - DNA, 1501 bp, Oryza sativa
taatgtttcagttcactgcaacattagatctatacatagtgaaacattataagtacactaggtggaacattttttggtgaaacaaaaaaatgaaacgaattctcttaataggaggtttccaaaatatgtgggttttttgttgcaatgaaatatttcagttcactacaacattagatctatacatagtggaatattgtgagtgcactaggtgaaacattttttgcggaacaaaaaataaaccaaattcccttaatagagggtttccaaaatatgtgggtgatttattgcaacggcgtgttccactgcaacatttgatccatacacagtgaaacatcatgagtacactagctgaaacattgtaaaactactggttgaaacatcaaaagagaccgcatgcaacattaaaaaaatcaataaaaaattaaaatatatttttgaaatataatcatgtgtggtcttgttgtaaagatttaattgtaacgaatttagtggtgcaatcagatcgtagattagataaatagtttacgataaaaaatcttttgaagaaataagaaaagaaaagattctttacatgctgcagctgcagtggcacagcgtccgatttttctccaccccgccggtcgttcgggtgtgagcattttcccgagcgttgctggtggacacgcttgtccactctatcctttatctcacatgagcaacataagcaagtgaagagacatggataaaaagagatgtcacgtttactaggattattcacgtgattaattggatgtatgtcattgcaaaatcaattttcccgatgaagggtaacattaccagcgcactctctctatctagaaaaataaacataaaattagataactggatataatatattttaatacaaccatcaattctagatttgtttttttttgcgaggagagtagataataataaccttagggggtgtttagatgggactaaaactttttagcccatgtaacatcggatatttagacgctaatttggaatattaaacatagactaataaaaaaactaattttataaatgagagctaatccgcgagacgaattttttaaacctaattaatctataattatcaaaagtttactgtagcatcacattgtcaaaatcatggtgtaattagattcaaaatattcgtctcgcgaattagtccaatgttatggaatgggttttgtaattagtgtttaatactttaaatttaatatccaaacatccgatataatatgatatgtacttgaaataagtcctcaaggcaggtgaacgggctgtaaattatagctaaaattcatttaaaaattgaatccgcaaagaacagaaaaaacaaagccaggggtagaaatcggaaacgacccacggtttccaaattccagcagtctctcttcccatctcatcttgcttcccctcccctcctcactaccatctactcccatcccatccgccgccaatccgccgctgcagccggcaccggccttcttcc

SEQ ID NO: 33137 - DNA, 1501 bp, Oryza sativa
ctttctgctatggttataaacttacagtgccacagtgctttacattattaccttttgctctagggcaagaagtagtttctttcagtcctaaacagcaaatatcacaaatgcatcaaattttgattgaacaaatgtcacagaagtaacagtaaattgttacgacagaccatcctaacaaactattattactagtgcaaaatggagctgcacatatatctcaacaattaagtttcagacccaaccgtagctattaaagcaaaataaaaaagtgaattaaagctgatgttataaccctctggctcacttcacatgaacagaaacacgatgttgtaaccaaatagtagtacttagggtgaaaatacactgcaaatggtataaccatctactgaaataagaacaagtattgcatgcgggccccatttcatcgagcacatatatatcatgcaacatcaaaaattagcaaaaacaaaaggtcaaggcaacaataccagccaaatccaatgtcaaaatgtctgcgtccgcggtggtgtcaatggcaaaagcgtgcgacccaaagatagcccagaggcaccaacccctgctgggatggcataaagaggacatcacagtgagccagttgccatcatcgcggagatgggaggagaccagatccagatgagtattcgcactagggagcgcatcatcggcgcccaactgcagccatacaaaaacaaccttatcgtgcatagaaactcttttaacttagagaaatatccacgggacatgatcagcattatattaaatggaaacgatgtcagtaaaatatgatatattacctaaattaggaggatgtagatgaaggcatagcagctggtttttcaagcccagaacagcttattccctctaactctttctactgcaaagaccattatccccaagcatttcctctcatatggagaacacacagacacaacacacagctgcaaatttacaagggagggtaaagattgccatttatttattccattaagattgagccatttacataatcttaggggcaacgattgcatccatttagttaagattgagcaagttacaaaacgtattgacatcaagcctaatagggagggaggaagaagaaaaaaaagtaactgatcaagccctgaagcctgatagggagaggggaagaaaacaaataactacatgttctagttggagcatgtctcatgaaggcagtggcctggatggctgagctgaggcagtgactgctgggtaagctgaccgccgacagtgcatcgaatcaacattcatcttgtcctcacctctccacgttcgtcctgttaaggaaaatagaataaagacacttagttaggtaaaaaaacagtaaggaattcgcatcataaaacacaatgtaagaaagggatcagtgagaatgaattaagtgaataagtaaagatggaaaagggagttcgctcggatgtggtgcgaagttgaacgacggcccagcaaagtacggcacaga

SEQ ID NO: 33138 - DNA, 334 bp, Oryza sativa
tgaactaaacacagccttaataaattttgatataagagcctctcatttccagcagtttttttaatgtatcatcatacggattcgttgtttttctttccattcttattctgctcttattctacaagtattttttaatgtatcatcttacccccatcttaataaattatgcatctgttctttttttttctggtttagctcgagcttgcaaacaagcataaccgagtcggccttttagcttgttaaaataacgcacgagccagctcgatatccacctccgtgtgtaaagccttttctcatatgatgtcatgtatggtgagcgcgtggccggatatat

SEQ ID NO: 33139 - DNA, 325 bp, Oryza sativa
aacttgcggcacggcagaaacgacacgcgggaagtggacagcgtgttgcctgcgtgggcggtgttgtcccgtcccacaaggctgacatgtcgccatctcccgatccaccaccacgggcgcacgcgcggtcgcgcgggggccgcgaagcgatgcgccggatgcgtaggtgagctgagtcggccagtgcaccctccccctcctcctagtttccccaaaccatcccccgaccggcgaacagctcgccgtccgccccccgtgcctcccgccgcgcgaattcacttccccctacgccgggggctgttcctgttgctattatagcccccaa

SEQ ID NO: 33140 - DNA, 1501 bp, Oryza sativa
taatgctaattagattaggataagagagatttttgtttcctcatgcaaagatcagtactagtagttgcttatttgtactgctaatggattttattatgcttggtaggccgcacgttatacaccattagcccataattaacacatcaacaaccaagcgaacagttttactgctctagcacctgctctttggctgacgtaccttatattgcacttgtggtaaaatattgagcattagcttatattggctgggtgtcatcggggtcagatgacaacagtatatgtactgtgatccgcccctacggtttatgtaacatactgttaacgaccaaatttagtaaatcatgagccaggttcggctttagaatcgaagtggatttggcgaagagttagattcgaagaacagagtatgcatcggttgcgacgacatcggctggagtctgcatcggctgagatggatcgaacaggggacagccgatatagctgatacaaccgatacagccgattctgatgaagatggttctgagattgcttctagaatcgatctacgtacttcaaaaagattgccacgatagagataaactcttagaaaggcagttgtatctattaattaggatatgttgtgtaattttcttagagatatgtttgggcaaaaatctgccgcaaagacttatggtatcttagagtttgttagagataagagtcgtgtccggcaaggacatattttatatctcgggtataaatacgacccaaacctgtgtaatcaaacaacaatagttcaacaacactttcggcgcatcgccaccctgtcggagctcaaaactaattacttggatccaactctaattaatgtatcaatccctggatcagtagatattgatatatacaatataaccagttcttcattgcatacgttaaagtttacaacgctaggggttttacaagggtaggtacttacctaattagacataagtactaatattacacagcggaagttttagtacattctgactaggaaggtataacctttaggggttttctaaattatcgaggtcatcgtagtaatagtcataggggtcctcttgacccaaatctgaaaaaagggttatgagagcaagaatgagtattcgcaatactcagcaagttatcatgaaaatatgttatgcattggcatatagtggggttctttgcaaaaagcagtaataaacaatctggaagaattacagcaggaatttataaacatatagactttagatttctaaccagggtaccatatgagtcccggtactcaactccatgagtacggctattcgaatagtttcaaagatattctactgcagcagatgtatgctttacccgcagtccacgacttgctgataatcatcggctttagtcatggcccagtattaagtcattaacaattgtggcacctgttccatgaacttatatcctcatatgctctgaacgtattgttaacagcagcaagaagagttctggcgttccc

SEQ ID NO: 33141 - DNA, 227 bp, Oryza sativa
aggaggggccgtcgatgtagaccccagtgctggaaaggaatttgtaccgtacttatgtagggcggtagttcaagttcgcaccacatccgatcgaacttccttttccatctttacttattcacttaattcattgtccctgatccctttcttacagtgtgttttatgatgcgaattccttactgtttttttacctaactaagtgtctttattctattttccttaacagg

SEQ ID NO: 33142 - DNA, 1501 bp, Oryza sativa
cgcggccgctcgcggcgccggcgacgagtacgcgctcgtgttcccgctgtcgcgcgggtggtcggtcgtcgtcgacgtccgcgacacgtcgtgccgcctctcccacctcgccaccggcgcgacggcgccgctgccgaggctcaacgccgtccgcgccaccgccgggtcccgcgtcgtgcacctcgggtacgagcactccgccgcgcccgcgcccgcgcccgctcccgctcccgctccggccaagacgacggcgaggcgccaccggaaaaacttccgggtaaagcgcaggttccacctggcgcgcggcgacgactggcaccggccgatgcggcggcgctgggaggttcggatgaacccggcgtggaagcggagcttccggctgccagacacggagcacgccggcaccggagacgaacagttctggatcaagatcaagtttctctggtattccatgttcctcgaatccgacctccaattctcacacttgctccgcttcgccgtccatgtcccggcggcggcgagcacggacggcatgctgatcatgatgtaccacccggttctggggacacgggcatggtcttctgccggcccggcgacgccgcctggacgaagctggacaaccccatcgacgacgacaagcatgtctacaacttggtcgagttcgcctacctggacgggaaggtgttcgccatggacaggggcggcaccacggcggtgatcgacgccgccacgctcgaggtgctcgacctcgtcgacgcgccgccggggacgcgcaacgtctcgaacaagctgctcggcaccgccaatggcgacgacaccgtcatgtcgctcgactacctccaccttgtcgcgctgccgagcaagctgctcgtcgtcagggtgcgcgtcaacaagtcgtcgtcggagccggagggcttcgacgtgttcgagctgggacgacaggatcatcgcgacggcgagggcaagctcgcctggcgcgaggtggccggcgacgacgtcggtggcaactacgacctgttcctcgacgaccaccacgccacctttggcggcggcggcggcggcgccggcggcgattccggtagccggatttactacgtgcacgacgggaaggaggcgtactgctacagcaagcggcatggcgagctggaatgcgtgtactcggcgccggagggtagcgaggaacagtgttccaccatgcctagctggtttgttccatagatccatagattaaagttagatgatagagatttactccagcctaacaaaaattatctcgagatatcggtacctcatggtactgtgaggtaccggtacctaaggtactttttgttgggccaaatcaaatctataaatgatataaccccgcacgttgttgtgtgtctgctatgttagaaagtctaacattatgacgatgtcaaattgatcaatactctataagatacttgtcaagattacggataaggtataccctctatccatggatatacgttgtatactgata

SEQ ID NO: 33143 - DNA, 387 bp, Oryza sativa
tgcttaaaggtcccggttttatgtgttttcagctcgcagagaaggaaaagcactataggtgtcagttttactgttccggcacctatagtatctatagtatctatctctacgtgcttttttaagtagtgtatgcatcgacagtagccatcttgccatctcacctatcaaacattagttgtccagagtctagacgctagatgttatttttttcactactctcatccaaaacatgcaaatacgtattcagtactctaaatgagttcaaatgaagaaaaaaattatcaactaaaaaaatgtagatctcgtcaaactatataattttcatataaggtttgtctccattcataatctttacatattataaaagtttaagatgtttttgccaga

SEQ ID NO: 33144 - DNA, 1501 bp, Oryza sativa
cggcggccggcgactgtgctggggacggcaccgccgagccaatggccgcggacgccgtcgttcattgctgcctaccgtggatttgtggttctaattttcattctttggatgtcatgacaagtcacccggcaatctactcgtccaaaaatataagtatttttaaatcctgatacagtattcaagatgctactttgaccagcaatatttataaaagtaaaatgttttaaataaaaagagttgcatattataatagtttatttaataataaatctagtaacaccaattttacatgattgattttttttttgttattaatagtcaaagttaaaaatatttgacttatcactatgctaaacatgcttatatttttggaacggagggaatagatttgtagcaaccaacaggcaacaatgacgtgctttggtccgttgtcagatcattcatatgtctgttcatgtagagctcggtggattttgaggctgaaaatggaccttctagcctttgcagttcctatattggtatcttcgaccgttacaatgtgcttgctttaacttgggtgcttcacatattatcgcatcttcattttttcttttcatgtgcctttcagacctgatgcttggctctgtttacattagtggtcaacagtttttataaaaaaactttcaaatatagtgtaattatattataactattatgtaactactatctaattattatgtaacttgcacaaaagtgcaatggagcaactggttaatggaggttaactagcaaaaaccgttgacttagtctatagcattccttgtttttttttattttttggaactggtaaattcctgaaatttggatcgaacggtggtgagggcacgatgattgcgcagcgtacaagtcaaggccaagtcgtcgggaacgtggacattccgtaacggactttccaaacgccgtcgctgtcgtactactccctcccgcttctcacgccgtcagcgctcgtacaacccgaccagtagtactactcctagtacaacctcgcctacccgctgcaaccataccccacccgacatggacccacctgtctgccagagtagccgacgtggcacgagtaatcttaaccccgcgagccaacccgcagtacaaagtacataaacgaagaggccaactatcattttactatctaaaatcattttaaatgcagtcgtgtgtttctatatccaacgtttgactatcttaaaaaaaattataaaaaaaataaaaaatagtcacacataaagtaacatttatattttatcatataataacaataaaaatattaatcataaaagtttttcaaataagatggatgatcggatataaactgtctttctagaacggaggtagtaattatcagtgacagatgggcccccacgtcagtcttctcccgccttccgtataaaaacggcctcacccgaatcgcgtttccccaccatttggcgcacccgtcatcggtcgaacaccacacctgcgtcca

SEQ ID NO: 33145 - DNA, 211 bp, Oryza sativa
ccctcgctcgctgcctaaggcgcctccgttggcggcagcgaagatcaatggcgacaggcgcgaaacaaaggctaccaaaggcgaaaaacaagagaggctaaaaggctatggtggagcaagtgggggcgttccggagtagggggcaagcttcggttgtgtggtgttcgttggctgcgctggcaagccggcttcgctggatgaggacgcgcga

SEQ ID NO: 33146 - DNA, 1501 bp, Oryza sativa
tgggtggcgttttttttaatgggcggtgatttttctactgtgcgtgaattttttcaagggtgtcgctctttagtgcgtgctggcggtgagctaagtggcccgtcaataaaaatagggttattttttgcaagcgggcttcttaagcaaccagtagcgaaaatcagcgaaaatggattttcgctagtggtcctgaaccctccaccccttgttaaaattccgcaggtggatttctcatatgaccgtcaaggaaaaccctttttctagtagtgtggtcgaagaagacgttgtggaactcgtagatcgccgggaagagatttgcgcatgttgcatggtgaaggcgggggtcatggaggatgaggtcgcgccaggacctacagaagatggcgaggcacatgagcaccgagaaggcaggcacgagaggatgttgaactagatgacgtcgttgaggagttgtgccagcggcggcatcgtgactgctgctacgtctaactccatctaatctactactccctctgtcctaaaaatataagaactgatgattaaatgagacacatcttaaaactacgaatatggataagtagcattcataagcctaggatgtgtcatatcccatcctagattcttatattttaagacggggggagtaatttaagatggatgcaatgcatctagccatctactatatactgatctgcatatgtacgtgtgcctttctggaatggtatacatttcatactaggttaacttattttgaaatgaatggagtatttgggatgcggtgtgagaaagatctcaaatctcaatcacctagctatcccattagcatccaaacacgcatgaaaactattctaacccatttgaaattccacattggaggagcatattagcagcagcacagaaaacatgacatctcattagcgcctgattaattgaatattaattatcataaattataaaaataaatttatttgatttttaaaaaaattctatatagaaaatttttacacaaaacgtacataaacgtgctaacggagaaagttatacttttggagtagtagtcatcgacgcctgtcgaaactcggtcgatcgatcgaaagagaaatatgcaaagcctgagccttaaactgaccaaaaagtcgggcccaagcttggcaagcctggcacttcttcgggctgttttttcttttaaaaaaaaatatatttttccaacttttctcaagcttgtttgattttttttcccggctttttaggcagcaaaagagccttgcctggttcttgggccgacccgagctgactgggccaaccgccaaaggcgagcaaacaggtttcttagcttggccagatcgatttcgtagttttaacacagtactatcagctcagcaaaggggaaagtttgacatatttgcattcgattttcttctcatgtgtggctctcaagtgtttgacaatctgcattcgaacttaaattttggtcaatttcttacccccaaaatccatggaa

SEQ ID NO: 33147 - DNA, 1501 bp, Oryza sativa
cccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcattcctagtttagcttaatgaactggtgtagttcaggtggttggttgggcctgttgcaacgtggggtagcgttggacagtgtttggttaatattgattaattactacaactattttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcatcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggatttttttttttaaaaaaaaatgagctcagcctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttattgatttgagtcttcttttgctttgtttaatttggatttgagcatgaattggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcaga

SEQ ID NO: 33148 - DNA, 168 bp, Oryza sativa
gtcacgccctgaaaatcgcctaacttaataattcattatttaatgcttttttagaaaatattttaaaagcctacaagttaaactctaataatctaggaaaaatttcaacataaaattgagctagataaaattttattaaacactttgcttgtttatctattttctaga

SEQ ID NO: 33149 - DNA, 224 bp, Oryza sativa
tctcccatgtccggcccatggttgccattggccaatttccctcaccggagcttgcaaagccaaacccttgcgccaccaattccgcctcacggaggtgattccatttttcccctttcccctctccctccatcttaagataaaccgccaccaccactttttcttatcgccggagttgagctctcgtcgccgccgttccggccatctccttctttcccttggctagg

SEQ ID NO: 33150 - DNA, 897 bp, Oryza sativa
ttggaaataattttaaccaattaaaaatcaccaaagtgcaatatttaatcccaggaaaaattcttagaaattctggttcgtgaatttctgggcgtgacaagttggtaacagagccagccttgaccgtaggacaagccaactggaaacctaagagccctctgaaccgcttttcatctgcatatgccttttgcacctggatttgtttcgggaaaatttggggttttgcctctttggtttgcgggaaaaatcttggtagttcattcggatcggatctttaaaattagctcagtctagggttttagtaaaattttatttgaggtttattcgacagtcagtcggaaatctaacgggtgatatgcactaagtcgtgtctctgttcgatggggcaattttatgcgtatcattatagctatgcatctattttatgcattaatttattgattagccagttgcatcagtatcttcatttgagttcacgaaaaatgttctatgcataaaaatcagccatgctaggttatttatttgagtcatttgttgctttgtttaatttggatttgagcatgaattggttcctatcccttgtccatctttagatgtcagacctgttctccgatcgcaagcgccgctccgagcttcagagtcgccgcccttagctttatcgtctttcttagtttgttgtttgctagtttctgtgtttaggtctgctgcttgtgggttagtcggcggtcgatatcatgtgtgagtggtatggctgccttaattaggagttgtttgcttccttttcggtgttttaatcaaaattaagataattgtacctaaatttataagaaagattagattctgagccccctgtttttcttccttttctcatatttctacctatcccccttcagatgg

SEQ ID NO: 33151 - DNA, 159 bp, Oryza sativa
tcaggtatacctggagtggacaaactgacaattgcaactgattttgtgatggtgaatcatccaattgctggctgagagagagacatcttcttgtcttttgcttgtattcagagccatccagccctgtgttaggatccgatccgtattcgccgttgcagg

SEQ ID NO: 33152 - DNA, 443 bp, Oryza sativa
ttaaaaccactcttttaaacatcgaaatatgcaaaaccaccgtctaaaatcacctcatgtgtaatataaattagttcggcaaagtttagggggtttggtctctggttttaaagtttaaagtggtagatggtttttttttctctatataatttagtactaggcgtgttattttgttgtgctagtgtgttatctgaatgaagatatcagaaaagaacgaaagcaaagtagcagcaccgacaccatctctgcaaattccaaccgttatttttgcaagtagcactaatacatcaatcatgctgattcatcagattgacgatttttattgagaaacatgcatgtatgatgtatccttgatggctagaatggcttggatgggaggttctgattggccaggaagtacttgaacagctcaagcgcttgctctggcatgatggatggcacca

SEQ ID NO: 33153 - DNA, 1287 bp, Oryza sativa
tttattgatcaagtattccaaggtttgaataaaaggttggatttggcctatagtctcaattttgttcttttcatggtttaaaacatgaaattaattaataaatactttactattctcaaataattggcatagttgattatggttatctcactttaactataaattacgtttgaaatgttatattatgatgaattaaagttgtttggttatatttataatgccacatacatcaataatataatatatttttgagtgttaataaaatgtctgaaaaaaatacaaacaatcagttaaaactcgaatcatgcgcgtacaaattactccgtatttaggccctgtttagttcccaagtttttttttccaaaattccaactttccatcacatcaaacatttcatacacacacaacttttctatcgcatcgtaccaattttaaccaaattttcaaacttcagtgtaaactaaacacagctttaggataggaagggggagtaccaagttctaccctccgtgcaatctcaagtcgagtgttttcccgatttattaatttccaaatccaaaagaagaaaaacaaagttcatctcacaatatagattcacttttaaaactgcaatatgatcccccatatgatccagctctaagtctctaaccaaatgggcatgatggctgtgcaaattaattttaaggcatattcgccgaggggattaaaaaacaatcccccctctcattacattactaattaggaaatatacttcccccatcaatcaatcaatcaatgcttaaatattgaagtcaatcaaaaccatcgttatccaaaggaaaaccttaaacaaaatctaaaacgccagatcgaactgataggatattactactacagtactcccccgtcacataatataagcgattttgagtttttgtttgcgctatttgaccacttgtcttattaaaaaaatttgtgcaaatataaaaaacgaaaaattatacttaaaatactttagataataaaataagtaaaaaaataaataataattttaaaattttttaaataatatgagtggtcaaatagtacagataaaaacttaaaatctcttatattatgagacggagggagtgctgtactccgataaaagcgggtagaaaaagcacatggtgaaattcctgcgtgcggtcgtgcacagactccgtctcggagactctcccgctgactgacacctcaaaaccggccgtcccacgaggtctcctctctttttctcctctttaatcccctccccggggtctcctctctctc

SEQ ID NO: 33154 - DNA, 364 bp, Oryza sativa
attgtcccgtgatgcgtcagagtttaaaaaatgtgacgaaatttgatgtgcgatcaccccatattctgcactcatttatgagagaactgcatttaatgttaaagacacaggtcagctagcagacaatcccaatttagttctaaatatgcaacccaggttatcctaaccatgaatcggctcacattattttgctaggatttaagaaaaaaaatattttattgtttcctcctgtcactctttccggtcatattctcattatgtttccttgtcagtgtttttacatcgtagtactgtgctgctatcactctaggaacaaggatattattttctgccgctcacaagtcataatatattaatacttatt

SEQ ID NO: 33155 - DNA, 314 bp, Oryza sativa
cccatggtcaaaaccgggcaggcagattaaactcgcggatcgatcgacgtacgtaagccatttgctcgcactactatggtttttgctgctatgtttgacggctgtttcgaattaatttgacgggtagtaaataaaacatttgacaaaccaagcgagccgctaggagtatcatcagctaagctactactactacgaactaatcggtcacggaaagcagcgtttgcagtgacgtttgctacagccgatctcgctacttaggtaaatcaatgacagggtcatcgtcccaggatatgtcccaatcaggctacacatca

SEQ ID NO: 33156 - DNA, 854 bp, Oryza sativa
  unsure (1)..(854): unsure at all n locations
ccgtccactcctctgccgccacgcgcctccgtgtcacgccccgaactagtcccgaccggatctagcccgtgacgctccaaattaacctgttaatcgataccagtcccaggaaacagtgctggtatcacagggagacagagtatcacagcaacagaggtctctttattatagagtagaagtacagtcatattgggctgcggacagatcccgagctcacaactgcattacaaaaggaaagcggaagccaggacttggaccaatcatcacaggcgcgacttgggaactaggccgaaaccctaaagctcatcgtatgccgacttgctccntggaagaactcctcgtcagcaggatccacttcatcttcttcagcaactggggggggattatttatatagagcaagggtgagtacgggagtactcagcaagccaggggaaataagtgtttaatgaaggcttcaaggaaaggctattgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcagacaaaactacgctaggaatcacctcacatccgcccatgaccgtgggcacggctgttcgaacagtttgttaacctctgcagagggggtacactttacccaca

SEQ ID NO: 33157 - DNA, 217 bp, Oryza sativa
ccatagatctgaacatgtcaccctagactagtgtttatcctaccaattcaagactaaacattagagcatctccaacagcttctctactcagctctccaagctaaaaatttggcaaatgaaccaaaaacactcctccaacagactctctattcaactctccaagctaactgcatctccatccaagcccacccactggccaatattggccagcctccta

SEQ ID NO: 33158 - DNA, 300 bp, Oryza sativa
tgtaaaggtcgacgtatgaaacacacttggcacgtagcgttcgtgttggagtacagtcggcaccgccggtggatatgcatgcatatgtacattcacgagatgttgtacaagtaggaacacgttatatcttaggaataccggttctataagttgagggacacattatatctagtattatgcttcaaggatgtaatttatactcgaagtttagatgagggacctaaagaaaacttattccttctctacctggccgtgtcacccgaccacttgcagttgtgcagcccatttgcagttggtagg

SEQ ID NO: 33159 - DNA, 521 bp, Oryza sativa
agatctgcacgttacacaaggagaaagaaaaccgattcacaatgcggcctgccacgccaagactactcgtgctgtcgtacagcgcagaataactggcccttaacaacagaatcgacagcgccggagcccgagacgggagaaagaaaaggccgtaaaaacaaaatcaaatccggcctataaaagggggcgccccaagatgcaggcagaggctattctccacgtggccatctccccccatccatcccccactcctccgctactcgcaccgcaccgcaccgccgattgatttggagaggaaaccccctcctcttcctcctccacctacctctcctccttcccagccagatccgcctcctcctcctcccctgctccctcccagatctcacactccatctcgcgagcgcgccgacgcgggacagctcgccaccccgcccagatccaccgtctcgccggagccggagagaccgagcggcgggcggcggggaggaggatggccgtggggaaggagggcggcggcggcg

SEQ ID NO: 33160 - DNA, 1501 bp, Oryza sativa
ctagggttttgctcggggagggaagtgacggctagggtttctcacgtgatgcaatgcctccgccggtcacacccctcacgaatatataggatccatcacccgggccaccaaggcccgtagaactcctattcggatccctatccgaattaagctcatattgaatctccatccaatgcccttattccggcccattaagcgtgcgaccctgtaggttcatgtacactcagctgtaacccgaaaactccttttcggtccacgcgtcaacagcggcccctagcagaacgttttgacctaccgggcatacacaaagatcatatcggctgaacctctagtgtatacttatatgaacccctttgcctcacgatatcgattaagctcaaggctagatatgtgccatcctctaatagctcaatcattcactcgaacctgttgatagattatataacttgtgattgactactcaatcacctttggcatggccatgcacttccataatctacaacatcgaggggcccagagatatctctccataggaggggcaaatctcatcttgattattcatatcctactacatgtttcatagcatacccgaaaactacttttataactacccaattacggagtaacgtttagcagtccctaagtaagctactacacatgttgggaaccatgataatcttaggtctaaggattcaataccaacactaaatgagatcactgatgacacaacacatatggctcttgcagtgtctcatgttgggtctatccaacaacatgttcaccaacatgtgtccatattattaatttggtatctctataccatgattcatgagacatgatcatcaattaatacatgtgctgatcatctaaacatatttattctatatatgatatttgatcagggatcctttagaaatagcaacacacaacataaagagtctcatgaaagaatcacatattcattaaccaataatgagttatctatttcaagtaacaaagtcggataaatatgtaaacatagtatgtgtcacagcctgattttcgtttcaggatttataaataatttaataaattattaaaagaatttatattaaatgttcattaatttacaagtgaagttaaatgtgggaaataaaatttcctaaatataaagcatggttggatttaatttttattaaattctccatgattaattatactctctgaaattttctcggatttttcagagctcaattcctaattttaataatacaaagaatatttcagtaattatttaattaataaattaatcattaaatggtctggttttaatatttttaaatactttgagtgtccaagtatgttcaagatttttcttggaattatttgagcattgaaagtatttttaacaattgaaagatcatctcattggttaatttatttggaaaagtaataaaaattctcctcctcagcttgggccgaattcagcccattccctcctattccctcctctcctctcagc

SEQ ID NO: 33161 - DNA, 1501 bp, Oryza sativa
gccttccaggtgtttcagagattcaacaattttcagagcatatgcacgtcagaggctgggatatctcccccacacttattcaaaacctaaattttattaaacatgaaacaaaacaaactttggaaaacattggggttaacaccaatgagccacattatttatagcaagtgcttacatgattggaaaaataaaaccaagcacctactactattttattcatgggaaaggaagcatctaattagcataatacttattttcctttcccatttctacgaatgcacgcttgatcttagcgcacaaaccgcaactaagggtatcgaaattatttctaatttcagcaagctctacccctagctccgcgttgcgatccctaagctctatgttctccttgcggagtttcttcacttgcgcagcgagcttatggattgagggctctggcaacttcacctcatcttcttgatattggtcgggagcccttactattggagggggcgtcaaatgatgcttcaccttcataggtggagggctacgggattccgctgcccctccttctccgatgccgtcaacggccggagtaaacccttgccatacccaccgccgggagttcgcactccctggatgcggaatcgctcctccattggagtggatggagtagcggtgggtatgacatacttatggagcacctcatcccctgccttggtgaacagggtgcccacatagcgctcggcgggaggcggcacggccttcccgtcatcttggaaaaggcgtcgcgccttcaacaagccgagttctcccgttgtcggccgtcgcgcaggcgaatccccccgtatttttgtccttgtgacatggcgaggggagagggatcgcactgccgaacggggggccgaacggggccgagagggcctggttcggccgaaccagggagctcgccgtcgggctccagatttgcaggggagcccggcacagctgcgaggggttgagcccatacatcatttaccccctccatcgtgtattcttctaccggaatcaattgatttgtcggcgttggctctccggtgagattgtaagtggaattggaagaagagcgaatgaatgggatcagtgatttgcctgccattggtgaattggaggtgatggagcaagggaatcgggttgagatggagaggaggtttgcaaagtgggaaggaggaggaagaacaggtgctctggttggatgcgactgatccacctccgaaagcgcatcacaacagactatagacgagcgggggagattgctattcgaaaatggggccgaacgggcgccgccctggttcggccgaacgaaccctggtggatctggcaggcctccacttctcgtcctaggcccactaattcctaagctaagcgcagaaatgacaactatacagggttttaagcatgcactagatgagatcatcatggttcataatcgattaattcaataacatccacttcttcatctaaagtttcatttggttcaagg

SEQ ID NO: 33162 - DNA, 970 bp, Oryza sativa
tggattggaagtcaatatccctgagtggagtggtttgtaagggaaaaaaccaaactgacccactctgtagcataaatgagtatgcatgtgtgcagatctgatttcttcaggtcatacctgaaaaactaaattaaagacatccagaaaacaaatctgcatatgaactgttgcactcatgtttcgttgcgtatatatgctgtgcaccactgaaatttcttgttggtcacactctattggttcttgactctatgagccttacgtgctatcaagcaaggagatattttcaatcattttttaatcaagttctattacaaatatctgtaattaaacggtgtttatggagtacttgttttcctactaactagtaggcttcgtttcactgtatttttgtggcttttgctgcaacaatgtttgactgtcatgcagtattatctgctctgaacatcctatgtttcgtgttgataatagattcaatagatgacatacagaaagctgcaagttctctaaaacgcatccacctagcctgcctagcatctagtgccttaggcaatcactgttctcttcgaatcataatcttgtcaggatcttgatagacttcctgtgaaactcatgctatattcttttttgatctctttatgttctcccccattgttcttgataatcttgtcaagatcttttcatttatctgattattcgagctaacatcttctgattgcaaatcatggggtgtttaagtgcggcaagttttatgaatattttgatgatcacttaagttacatgttattattattgtagacaacttgctgctgctgtgctccttgcctccttgtgacttctgagtttgtctaatcttctttgactatgattgaacatgtaccttttaacagaaagtggtcaccttaaaatcactaaattgtgctcactattacatcacacataataaaaaggttaacttgaacatataaaacaa

SEQ ID NO: 33163 - DNA, 1226 bp, Oryza sativa
ctgcaagcagttcatcacaaatgaatatctcggagaccgtgccaaagtccaaaaatgttcatattttgggacggagggatgcagtgcgaaggaaagggaacataaggaggacgcttttaaagaagtagagaaatatcatcatgtgattaatagcaggattttctagataagtttgtacggataacaaagaatagaaatttgaaaatgcccaattctacaagattattcttggtagatttcaccgagagaaaaaagaaatccaaaaaaaacatggcatgaatacatgcaggcgtgggtgtgtgttagatgagaagagaatatataacaaccaaaatgtggtatagtcggtgataccatctttagctagctactttctgtttagtttaggccattaggacggtggtccaaaatacatgtaggagtataaattgcagaaagaaaaggtaggtaggtaggtgtggccggccaggggccagcgccgccgcggcgcgtgctgccggccgccgccgcgccgtcaaccttttggacggacggacggacggcgcagctagcagctcacaaagattatctgcggtcaattggccctcctgccgtcccctgtactgcttctgctgatgtgatgaccacattttatgatcacagttgtgacttgtcatactttttaaataatatatttcatatgccatagatttatttttttaaactttttggctagcaatttatccaccacacttttgtggctgtcataatttatctaacgttagttgtggtaaagtgtggctggcaactaaacatgtaagttttcgtatgattaatcacattcctaaaaaaaatatgcaggtccagatgctaccatcgttgtgattcaaattatttgtgttttacatttgtatcttagatcattattttataagatatcattcaaagccagctcctaccattcgtacaacgtgcttatcggcaattttacaaaattataatggcattgttacaattttcccaataaactaaggcccggtttagatctcctgcaaattttgcatcctatcatatcgaatgtttggacatatacataaagtattaaatatagacgaaaaaaataactaattatacagattacgtgtaaattacgagacgaatcttttaagtctaattgcgccatgatttaggcttaataaattcgaattaaatttgaaaatatattgttcattcaattttttgttaga

SEQ ID NO: 33164 - DNA, 1501 bp, Oryza sativa
aaaagaaaactgcagcggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacaacaaatatgcaagtgcacaggataccaaaggatgacataatatagggctcatttgcgaaagcagcatttagcaaacatttaagaattgcaaaacagtagagtaattaatcatcaatattaatcaacactgaacagcacatccatgctgatcaggcccaaccatcctgaacaaccatacccggctgcacagatctatctccaaaccaggaatgtaccattccaaaccaggagctaaattaattaccatcaattatcacattattattaatgagtagtgtgggactaatcacgaaagacattgttcgatccgcccataaccgcgggcacggctattcgaatagttttactctgctagaggtgtaccactgtacccacaagacacaaccccacaacatgtcaccatgcgcctcaataccaccacggtacctcggaaaggagctgtgacagtacccctcgcacaacacaatccaccacagcgcaccgttcctggatcataatcacccccttataaacaaggcatggactccccagcgacccccgtgggcttatctctgccacttctcagtctcgtgctccgcaatgaaccatgctatacaaaaagtaaagccgttgcccatgctggcttgtggttggcacggttaatgtttcacaaccgaaactcgtgaaccggtccttaattgttatgagcacgaccatcaaaaccatgtgctcacaacccaccattatcaagttttagttggcacattaattaattcacaatcacgattgaccatcgtgagctacaattaaatatccatcattaagtaatagtgaaacattatttatcccaatagtgtgctaatgtttctaagcatggctaagcaattatgtctaacatctagctgaaccaatatataaagctcaactagtcaaattatcacccaaggtataaagaatagagtaaggaatgcaaagtggtcataacaaaggaataggttcacaccacccggtgacattccaaaataaatgcacagttgaaataaatagagaattttaatataggatcaacatgctcaaaggaattgtgtttgggatctgtgtgacttgccttgcaataatcggtcttcaattagtcttcttgaacacttccgacgcactcatgaaccttcgcaacgacggaaacgacaagctatcacgcaaaacaaggaaaaagactaataaaaaccaaataaacaatacatataaagtaaacaaacatgtagatcatgattttagatgaatttagagacttgaacgacctcattccgatttcatatgaattaattacaaatttttacaagattaaattccaatta

SEQ ID NO: 33165 - DNA, 1501 bp, Oryza sativa
caacagtatattatgcatgtcaaaagatgagtattcaagcatgatttaaccaatttttcatgttataagttctgtaatcatcatgcagattagtagaaaccaccacatattgcagtaattcctagaataagatgggaagtcaaacccacaccaagcttcagcagtacatgttttacacactacccaatacaatcgcgctaacattctgaacataaaagtcatagtttgctaacaaaggcaacgatgctagtaaaatacatcatttatacgcataagaatgtgattcattacttccaaaccacattttacaagaaatggtgctctactgatcaacataaaaaaaaacaccgatcaacaagaaccaacaatactatatttttcaaaatggtaatcccaagtgaaatttactcctttttcccatcagacaactactctagtagtactagattgttcagatttcagcatagcatcacgattaaactaaactatcaagagcagggcgagatcaacgagacaagagaggcgcgtaccctgatgagcctgtacttgggctcgtacttcttggcggcgtcgaggttgtcgtagatgagtccgaatccggtggacttgcctcctccgaagtgggtgcggaacttgaacacgaagatgcagttggagtccttcacctcgtacagcttcgccagcttctccttcagatccgcctgcacacacgcacacgcacacgcacgcatgagcctcacgccggcggcgggaaaccctagcccggacggtcaccggaggaggaggaggacgcgacgcaccttggagacgttggcgcggcccgggtggagcacctcgagcacgaactgcttgcgggagaggaggcggttcgtcatgaacttgcgggtgcggagcgtcaccgccggcgccgtcttcgtgtcggccatgcttgcgtcggtggtgtcctcgccggagattcctcgctgcggcggcggcggcggcggcggcgagagaggagcggcgagcggtggcggcggcgagggagacgcgggttggggtggtgggggcttatatataccaccccgaacaaaccctaggtctggcttgggccgcttggtagaatgggaatattgggccgattataatgggcctgaagagacacataggcccttttgttattgggcctctcagctaccggtccgatcatatctaccagtcaaacctggcacgtgcagatgagcacagcatagtatacagctactgagctacctaaccaaatttccttttttttagaagtaacctaatttcttgcacatcacatgtagcagtagctagtagggccgagtttagttctaaatttttttcaacaaactttcaatttcttcatcacatcaaaacttttttacgcacacaaacttttaactttttcgtcacatcgttccaattctaatcaaacttttaattttggcgttaactgaacacattctacctagcttgctctaaactgaagtgaagcgtaact

SEQ ID NO: 33166 - DNA, 1501 bp, Oryza sativa
cgaatacatttattccctacttttacaaactcttactcttaaaatgaacttattttgggacaaatagatggagctaaaaatgaacttaatatgggatggaggaagtaggtgacaaggtagcatgctagttagagcattcccagcagcacatccaaatttcatcctccttatgcccatatggatgagcatccaaaaaagattcctcctttatatccatcccacttcaacagatcatccatatcgcaccctcctatattttagtaatatctttcaattaactttacatttgtatttttaagggctatattttgaatgactaaatttcaatggtgttatttaccgtgataatctttcgaatgagtaaattttaacgcatattttttaatgggtaattttattttctaccaatgctctgccctttcctctgttcaattccaacccatattcctctttttctctccttttctctatccttctctatcgttctgtactcttttttttttcctctcttctatcctgtccagactactccggaggcgtcgaccggcaggagcggatgtgcgcatgcggcggcagtgcggcgggaagccgtggaagcggcggcggaggctagcgggcgtggagccgagcaggtgacagcgccgaatgctcaggcgggcaggcaacgtaggcggccggtgggcgtataagtgaaggtggtggccgcggagaaaggaagtgacagcggtggccgacgggcgtggagccacacaggcgacgatggcggatgctgaggcagcgagcgcgcaggcggctggcagactcataagtggtggcttgtggcttgcgacggctcggcgttggcaacttgcggccggcatggcagcgacgacgacgacggagaggaggttgtgatggatgtccggatgggggcgggagctcgatccagatgcaggcgttcatatatggcgtgaggagagagaatcgctatatttggctaaaatatgctcgctttggcgcattgtgacatatttggcaggttagatgtcgtatctgttggaagcccattttcacctccagtatgccatattttgggtggaggaccggatggaggatctcctagggatgctcttagtgggctattgcattcaatttcttggaatggagtaaggcaataatgactatttttattgatcttaaggccaactcactttgctctatcttaacaactccacacatacaaaatatttccattaatatagtacatatggagaaaaagtaatcatcgacacccatgacggtgtcctcgtcgtattcggaattaatttttgaaagcacgtgtagagatttgaagttttacctacacttcagtcaccctttgaaacatagaatagaaaaactcatgaatagaagtaacatgtttttacaatcctatagaatttaaaaacacaggagaagtttgttaattgcaagcagtaaagattgatgttggtggctgttaaatgtcgattctatactgagc

SEQ ID NO: 33167 - DNA, 1501 bp, Oryza sativa
ttaagcactaactaagtgaggatgaactatataaatatataggatatcataaaacataataaagatatacattgaaacattatatgaattatcttggatgataatttaacatgtttgtatttgaaaagctctcttaaattataaaaattataaagatacaacatgtttacataatgtttaaatgtgatgattgttagtggaggatgatgtgacatcttgttagtggatgatgatgtagcatctttatatgttatgttaagcttaagtagttagtggaagataatttttttatagtaaaataggattggaattttagtgcgatgagtgtagctgtgagtgtagctgtgtaggccacgccacacatacgaggaacttaattcatgtgccaaataggcccagagaaccgtttgtttgttctaaaataaaaccgtttgcgaacggctctcacagtgccagtggcatttcaaatggttcagtcttgggcagtgagctagatccacagacaaaattgtatccgcagtgcccaactgaggggggttgattcaggggagtaaagttttgacgtgtcacatcagatattatacaaggtgtcgtatagggtgttcaagtactaatagaaaaaactaattaaaatatccgtcactaaaccgcgagacgaatttattaagcctaattaatctatcattagcacatatttactgtagcaccacattgttaaatcatggagcaattagttttaaaagattcgtattgcaaagtagtcacaacctgtgtaattagttatttttaagcctatagtatttaatattttatataggtgttccaacgttcgatataacagggcgtaaatttttgggtgggatctaaaccggcccttaattacccccccccccccccacccccaatctattcctcactcgcttgcgcttcacctcgcggcatcgacttcctagaaaccctcgttgcatcacctccacatttcactcgtttgcaacgttatcgtacgcccgagctctcggaagattgctgaggcatgaagctccatagtggtcctctggaagggtgttaggctcagttagtttctttgagttaacaactcactctcttcattttccattctcgtgcttttcaaactactaaacgtgtgttttttttaaaaaaatttatacatgaaagttgcttttaaaaatcatattgattcactttccaaattttttgctaatacttaattaatcacgtgttaatagactacttcgttttctgttttatttctaaatattttgataaataaaataaaaaatgaattcaaacaaagaaaaacaacagttgtcttaaagaaaaaaactgagggcccatacaacacatggatgggttagattcggcccactcaacaacaatccagtaatttgctacaggcccacgaacggcccttttaggagcctcacttggccgaaatacaagggccccacctgtcagtgaagcccgtaataagcacggcggc

SEQ ID NO: 33168 - DNA, 1501 bp, Oryza sativa
tctttagcagatcagcaaggaaagtaatcatatgatttccaaaagaaattacagcatcagacctttgtcaagaatgcatcatatgcttcagtttcagcttatgtaaatgccatattctgtaaaccatatgatgatgagattacttaaatggtgtttatcaacaggttggttattgaacaacattcgtcatcctaacatggttcagcagcaactccacaccagacaagactccagttcttccatccgtgactcttcaagagacccaagcttcaaactgccatgtgaatcgatcggtctgtcaacaagcggaggcgtccatcaaccgtaggatatgattgttggctgcagccaaaaattacaaaaaaaaattgatatgtttgcactgaactggagattaagcagttaatctgttcttcagattacttcaagccggtgaagcaaagaggcaattatgaataccatcacatttcattaccaggattagtggtgtgaaaaaatagcatgagagccttgcatgaatgatgatccatcaaccatatgattgttgcagcaaaaatcacacaattttgtttgatgtgttcgcactgaactgtttgatgtgttcgcattgaactggagcaatctattattcagattactttaagctggtaaagcgaacaggacaagacttaatcatagattaccaatctttactagtactctgtttttaaatattttttaatatactccctcgatttcatttcaaatttatgatgccattaacttttagtataaagttttcaaaaatcatattacctccatattttaatgtatgccgccgttgactttttgtttaacgtttgaccatttgtcttattcaaaaaatttattcaaaaaatttatggaattatcatttattttcttgtgatttgattcatcatcaaatgttcattaagtatgacataaatattttcatatttgcacaaaaaatttgaataaaacgaatggtcaaacgttggtcgaaaagtcaacggcgtcatacattaaaatacggagggagtagtttttttaaatataatgtgtgtaattaaatttgcctcgaaaaataatatcatatttatttaatattaaatacataagggttcaaaaacttaatcaaatcatcaaattacgattttaacgtcaaatatttatgaccgtattttctaaaaggtcagtattctgtttcgtccaaattcaattattaataactggactatttttagtcaataatatgagaaggacaaaaagggaaaaaaaaaaaagaaaaactctcctctcgcaagcgaagcaaagcatttccctccaaatccgctgcttccctccattttggcgccacaatctctctctctctcctcctcctcctcgccggagatgtcgtaccccacgttccacgtccacccgccgttcccggtgtcggcgaggaagaaggaggatgacggcggcggcggcggcggcaagaaggaggcggcggccgccgcga

SEQ ID NO: 33169 - DNA, 1501 bp, Oryza sativa
gcagtgccaatggcaacaacaaatgtacttaagctcggtgtgctgcgcactacgcaactaattgacgcatacaacacataacaaatctcatttgatgcttatatgatgaaagtcacaagtggtgtagttattaggagtatagcgtggctctgcccttagtacttcctaagctttagtttactttttttgctttttttttctcttcccttggcataagtcagtctggttgattgcgttgtataacataaacttattttcttctaatatattgacgtgtaattattttacgcgttcgtaaaaaaaataagtggtgtatcagctagtggctacgtgattttactcgtcaggttttaaattatagttatatgattattaaatattgcgatcatgaatttacccatggtttttgtccctttaaacgtgcgttacgtatcggtgggcatgcgagtatagtgtgcgtatgtagtgtgtattgataggaaatgattttttttaatagaggcagtacttcagtggtgcatactcctgcttggtcaagattaactatggtagaagtatttattttatttaaacaaatggagtaaagatcgaatcaataaacaatcacgcggtcaacgatcttgcatcatccttagaagatcattccagtgttaaaaggtctcctctacctgtcacatgtatgtatatatacgtgaaatgattcgttggactccgtgaaatgtgttgactttcctccccttcttcccaagttccaacccgtgcattgcatgcatctccatcacaaaccaaaaaaacacctccaaatctttcttttttgtgattttggactatttagggtcatgtgttcacggctaagtatccaatatcaaaatttaaatgtaccaaaaaaagttgttcctaaattgttggtttgcagtgagtgtggtccaaacataccttacaattgttccctaaccatattttgccacatttataaccaatactttagcttaaaccatccgtggcaaattaatcatgtgttaaaaaaacattctaatatctttaactttttagaggtatcttaaattaaaatcaagaaattgagatcaaggtgtgtcgctagtttccgctttgatttaaaacatgtgtgaagagacatattcgtagggggtgtgagtgcggtgtaaatgtgcgtagtggtgtgtatcaataaatgaaattaaactaaaaaatcaacataatctcacttgaccttttatcatctttctcacaaataaatatattactccgctaaattaaaattttaaacaaccagaagagaaaaaaaaaaccatcaagccgccggcaccagccaacccaagaacccaaccataaaaggcgcgagtcgcctcatctctcattaaaactcaactaatttaaactggagcagtcaatcacctcctcctcctcctccgccgccgccgaggacgacgacgacgacgaggagaagctgatcgtgatcgcgcgcgcatggagccccaca

SEQ ID NO: 33170 - DNA, 1501 bp, Oryza sativa
gtttaagaaaaatcaacggcgtcaaatatcttaggacggagggagtacgtacaaccgttacaatgcagggaaatcaattttgagggaactgatacgtggaaaggtattgtagctagatttctgttgttgaccataaagttgacaagttagtattgggacatatcatctagaaatgcatttacaggttgctctatttgaatatattagaacaacctctacttacaccactattggagcagctggcccactaacatacgctgaaagagacgaacatgtaattaagttccaagtggcatacggtgttttcttacagtaggtatgtaatttgaggctcggagttcatgtcagcaaatatatctatcgtctaccatcatgagagagatgcctagatactacccaaaacaacattgcaaaatcttttgtgacgaagcagaaggtatacttggtagccacaagggctaaggatggccgtgcccgtccttgttcttgaggttggcgtgcatctgctcaaacttggcttgcatttggtcagtcttgctattgatgaaagtgttgtgactgaacgcggagcgttgcaggcatccgcgcaccaggttgagctcagcgatcgtacggcaaccggctgcgatctcgaagaatgcgtgcaggttggcgtgcactcccatctctagcagtttgagagcctttcttgccttgccagatcggcatagttgtatcagttcaaccgatccaactggagatatcaggtgctttgttttgtgcagatcatggtaattacttttgagctgcttgaaaagccagaacgcctcctcaaactcttccgcattgtagctgacctcgatcatgagaagccaagagtcaagggtacgataggccatttgatcaaaggtcctgcgactgaactcgagcagatcgcacttgggatacatctcaatgagcttgttgttcacgccgcaatcgttgtgaaagccggagcacaggaagtagtggtggacatctttcaattcctccttcagtgctggagtcgagcagcttgcggcgagctcttcgaaggccttgcaattcccgcgagctccctggcttagtagatggatcgcttcattgacgcgtcccgcttgagcgaggttgatcagatcggctggtccggccacacgtgttggcgccggttggagttggcgctgccgcttgatcgctgccggagtgggctgccctgtgcgctgcttcatgggtggggtcgtggcggacgccggcgcgggagatgggaccagtgcggccgatgacgagtaggcgcgggtggccgcggcggacgccggcacgggaggttgcttctgctgcggctcgagctcgaccagtgcggccgcggcggtcgacgacgcgggtggccgcggacgagaacgtgcggcggtggcggaccctggtgcggggggctcgtccttgcgcggctggagcagttcagccgtggcgtgggccggtgccgcgggcgcggaggtcgacgacgaga

SEQ ID NO: 33171 - DNA, 644 bp, Oryza sativa
gacaaggcgggatcttgcggcgccttcctccaggggatctcgctcgccgcggccgcgcctcgctcgtctcgtcgcccaagaggtggaagaagaggtgggattttactcttttttcttttatcttcgtgggtggctctgggcgtagcgggtgggcactaattaaccaaagattagtgtagtaatcaccgggtgtttagtttactgccgccgctgcgtctgtctgtccgtatgtgcgcgtgtgaggctcgcatccatgtggcatctgggcagcggcagctgcagcttctcctccccactgagcccttttgtcctcactcgcaggtggcccttgccctttctctcttcttcttcttcttctctgctgctgctgctgctgctgctgcatacttccagcatccagggagtggctgcctcctggctttccatttgagccgccttcgattctgatctgggaccgaggagcaccccgcttccttccttcctcggttcttggccgtttctttggtcttctttgggaggtgcggtgatggagttctgcaagaattttgggagtcctgtgtttgttgttattgtgattgctggttcgggtgtgttcatttcttgctgctgatttcttggatgcagggatcggagaggggtgaaga

SEQ ID NO: 33172 - DNA, 1501 bp, Oryza sativa
cgaggaggaggaggagagagagagagattgtggcgccaaaatggagggaagcagcggatttggagggaaatgctttgcttcgcttgcgagaggagagtttttcttttttttttttccctttttgtccttctcatattattgactaaaaatagtccagttattaataattgaatttggacgaaacagaatactgaccttttagaaaatacggtcataaatatttgacgttaaaatcgtaatttgatgatttgattaagtttttgaacccttatgtatttaatattaaataaatatgatattatttttcgaggcaaatttaattacacacattatatttaaaaaaactactccctccgtattttaatgtatgacgccgttgacttttcgaccaacgtttgaccattcgttttattcaaattttttgtgcaaatatgaaaatatttatgtcatacttaatgaacatttgatgatgaatcaaatcacaagaaaataaatgataattccataaattttttgaataaattttttgaataagacaaatggtcaaacgttaaacaaaaagtcaacggcggcatacattaaaatatggaggtaatatgatttttgaaaactttatactaaaagttaatggcatcataaatttgaaatgaaatcgagggagtatattaaaaaatatttaaaaacagagtactagtaaagattggtaatctatgattaagtcttgtcctgttcgctttaccagcttaaagtaatctgaataatagattgctccagttcaatgcgaacacatcaaacagttcagtgcgaacacatcaaacaaaattgtgtgatttttgctgcaacaatcatatggttgatggatcatcattcatgcaaggctctcatgctattttttcacaccactaatcctggtaatgaaatgtgatggtattcataattgcctctttgcttcaccggcttgaagtaatctgaagaacagattaactgcttaatctccagttcagtgcaaacatatcaatttttttttgtaatttttggctgcagccaacaatcatatcctacggttgatggacgcctccgcttgttgacagaccgatcgattcacatggcagtttgaagcttgggtctcttgaagagtcacggatggaagaactggagtcttgtctggtgtggagttgctgctgaaccatgttaggatgacgaatgttgttcaataaccaacctgttgataaacaccatttaagtaatctcatcatcatatggtttacagaatatggcatttacataagctgaaactgaagcatatgatgcattcttgacaaaggtctgatgctgtaatttcttttggaaatcatatgattactttccttgctgatctgctaaagataaagagaacaaatatgaaaggtctgccgtcatacctatgttaacttcagaaaaattgcccaactgggctaagaagcttcccttccatcacctgaacaagttactgtactggagg

SEQ ID NO: 33173 - DNA, 1501 bp, Oryza sativa
aattattgttcaaataggagcaggagatttggttcgtgagctggaaagatctcgaaggagttccagagggaaatgctgccactatttttcagtaactccagatcattgaattatttattgcagagacctgacgacaagatgacatatcttgtggccaatgtagatcttgatatggcctggccccctcattgtgttgttgttttcaaatcacaaatcactctctggtccattgattcttttatgggatccctgcaataatttcagaaaatgaaacttctgtctgcaggttttctttcctaggctaagcgcttcagttgcactgcactaggacagtgctcactgatcagtttttttcttcacttctactcctagctgaaatgcttgaacttgccttcacgatctcaatcataaaaccaaaaccttatacttccttaaaaacggagtcatccgctcatcccctttcacatctcacatggcgtgcaaccatatccccaaaaaactgaataaccacgcttttactctatcacgctaccaacccatttccaatcgtataggccattggcctataaaaataattattgttagataattaaagtttttattaaactcaatcgattacattaaggtaatacaatttttgtgatatctgcataactaagatgcacacaagcgaacacacaaaattaaccgcaatagtaatttaatgtccgcaacagtaatatacgggtatcttattagttatataaaagtataacagcttgctttcacaattctggaaactcttgtgaaaatatctcggatcaagaaagcccctgattggagcacgcacgttctttcttgagttttcagtttggactaatgacaaaagaatttggccgattatcctttcaatttggaggactgatgacagggaattttcggactgcggttttaattttggactaactagatgggtacctcgcgtattgttgcggaaaaattatgtgataatatagtagatattaggtctgttcggtagtgctgaactgtggttgtacagccgcagcgctgctgcttccctagtatctttcttgtggtgggactgtggctgctggctgcaaggcagccagctagtagcgctaccgaacacacccattacttctaaaattttctttcttacctactatataatttttctttcatgtgtttatatttttttacctttatcaattatacataggttataaatgattgggttgtatggtgtgtcttttggagggaataaatgaaatttataccttttatgaatcatccaaaaacttaaaaacagttgaggtgatgtgaagagatgtaatttacacccttgatgaatcatccaaaggctaaaaacaattgagatgatgtgattttatgagagaaaagagaattagcattaactatacttagtggggatgaactttatatatatatatatatatataggatgacaaagaggtttgctcattatggcttccttattagt

SEQ ID NO: 33174 - DNA, 1501 bp, Oryza sativa
ctagaggcaatcatgtatgtttttccttgtttgctagcatatataataatacagttcagtaacctgagtacattaacttgcctgaatatttgaccaattgcaatggatttgccttgccaaattattggtgtcaattaactcaatcagcagcttcaagacagaagattctgaaaaaaaaaacaagcgattcctcagaagttgttgggacctgacctgatctgaggaagcttgtgcccggtttcctcgcatcctgccgccattgttggtggagcacatggccatgtgagccttcaaggagcaaccaaaggggtcgccgccccaaccccccgcagacgccggcgaccgcggcggcggagcctgaggtgtgggaggatctctccggcatgccgctcggagccgacctgatctccggccgccggagaggatctgatggggacggaggggagggaggcaaagcggcaaaagaaaaaggactactttgtaaatctcaccataactaacaagggtatttctataaatttatggatcgctatcattcctggcttttttgttgttgtaaaattaatcacagaaaatctacgactagcgactcaaaccagcgaattcctcgcaaattttgaattttccttaccgatcaggctgagttgtaaagagtagttggagaggctattctgtcctttttcatcatgggcatggtttctaaactattaattgatgtatttttatattaaaaaaacatttcatatgcaagtttttctaaaaattaaataaattcattttctaggtttacactggctaatatttaatcaatcatgcgctaatgactctttatacttttcgggtcagaaaaagatctcattccaagcctttctttcaaaagcagcctaaatacactgctgaatcatccctcccctcatccgagaaccgtagttaggttataggtgctgatgctaagatacaggtgctcctgatgctagtttgtattctctgtgtaggttcgtattattaggatgtgtctcatctgatcaaaattgtgttagatttaattgggtaattgatccatttaaatcaattaaatcaaataaattccaaggctcattatgctaggaattcatgtgaattcattcttttataggatatcaatgggatgaagagttttgagaattaatctatttgattagggaattggtaatttatatcaattagtcctaattgatggatggttgatggttgtatagtggaggatggttcatggctagttgatgacaattagttgctctattcctcttcctattccattggtgatggttgtgtagtggaggatggttgatggctaattgatgagaattagttattctattcctcttcctattccatgactcttactctttatcttccattcctcttataaaatgagaatggatttgatctcccgcgaaagaggaagacacactttcatccattttccaatgctgttgctgctacggtaatcccatcccga

SEQ ID NO: 33175 - DNA, 193 bp, Oryza sativa
cgagatatcatcttaaacactgtgcagtgtaacctcatactagaatagtactataagaaaaataatttcgtttgcaccaatgcaggccaaatgagatggagacgagacgagcagaggcgagcacccaaacaggctttctcagaagccaaggaatatgtgagagggacgtgtcctccggcctccctgtcccagc

SEQ ID NO: 33176 - DNA, 918 bp, Oryza sativa
ctgtggagagaacagagaattcaagcagcagtagtacttactgtgagcgggcgaccgtgatctgcgcctcgagcgtcatcaacttcccaatctgctctgctaatcaatacggagtactacactacaccgtcacacaaaagtgcacatgcaaatgcaattcgatttcactgcgcccccggttcttcaatcgtaagctgtccccggctctgccagtcctaggcaattaaggggaagaactgtggcagtactcctccactgggacactactagagctagtgtggcctactcaacctaactagaaaggttatatttttaggttattttttttacggagtgagtgtctttatttaggccatgtttaaatctcatcctaaaatttttcacctcgtcacattgaacatttgaacatatgtatgaagtattaaagataagcttaaaaattaattaattacacatattgcgactagtttgcgagacgaatttgtttttttagataatggaataaatattccggcctttactcattagagctacagccagttattacaaggaatcatacaaacaacgaatgaagttcaaataaaattaaacacacccaacaataaaaaaaccaaactaagaaaatgagcacacatttattcaagtctatttgtgaatctccatccatggttcgcaaatatttgcataaccgtcgtctccagtttacggcatgcaacattcgtaaactctccatcatcttcacgcttttgcagctttacctaaaatcggagccaatatgttgccttcaatattacctgcatatatgagatagatggtgatttgtcaaaaactatatcatttctactcatgctccaacaagtatgagtttactcattttcttgtcaaccccaaaaaccaaccatcaaacatatcttagat

SEQ ID NO: 33177 - DNA, 186 bp, Oryza sativa
ttagtcatctcagcaaaaaaaacactacaaaaatcattaaattgagaagaaatggataaaatggcattacaacatgttgcccctgtttgaggatggtattttaacgaaaccacttttgggagtggcattcgagcgaaaccccgttttgacaatggcaaaatgtcaattttctcccatcccgcgagc

SEQ ID NO: 33178 - DNA, 574 bp, Oryza sativa
tgccatgcagccccaacaccatcgccgcgtccccaggcgtctaggatgcgctcggcctccgcgccaccggcaacgaggaccacgcgagaacaacgtcacttggtcgaacgaacactgacattatttgttcatgaagcgaacgccaacggacaaccaatatggttattttgcatataatcctaaataaattaattaagccgaatcttaaatacttttttattctaaaatataatctaagattggatagtacacatcctattattccgtaatataatactaagagatacgatgggctttgctgaaaggagcactccttacctttgagaagacacttgctggactccttgggctcctccagtcggcccattttcatgatgtcggaccattttcatgatcgctttggttgtgtttgagctgaatctgctgctccatgcatgttcacgagtgtccactgtccagaactggtatcgtgcatgagcgtgacagatcgtcgccgttgcaccccaacaagattcgtgaatcattgcgaacgataggccaattcaattgggcccgtttcggatggcagccttca

SEQ ID NO: 33179 - DNA, 1501 bp, Oryza sativa
tttgaatcttaaccaatgaccgaacatggaagtatacatggaacgagaggaccgccacggcgccactgcaccactcatggcaactgacaacaaatacgcctctcacaaacatgcttcaatttgttgtttgtgcgatctggtagtgcaactcaggaggtgtgaagttgctgagcgatcacaaattcacaataatctcctcctaattacaggaagtggattttgatccctcgagaggatatctactctcattttttgcatgtcacttaaatggttattaaaaaatttaagaagatatattaacatgtgatatatcactccataaatatacaagttaaaatttaacttctacatctcgcaacgaaaaaacaaatttgactctgaatatacgttaacaagctgcggtttaatttatttttttcgttacaaaatgtagaagttgaatttgaatttacatgtttgtggagtattatatcacatgttaatacaccttctcaaattgttttaaattttttcataaccatttgcgtgacatgcaaagaacgaaagatatcttctcgagagattaaaatagtttctctaattacaggctacggatgcaaatattaatggcaattaagttattccggtttggccgttttggacacccttacatgagacaatgataacttggaacactagctgtaccgttagataaacctgttaagatagcttttgttacacatgaaagtttcataatctgttaatttcagtaagtctcaccttatatgcttcggcctatgacaatcatatcatattatcagtgcactaaaccatgatgtcgctcttccccgatcctagaattaacacatgatctccctccctgtttataaaattgagcgtgtgaattaaggagactaaaattttataaaacaaaatgacaattgtagcacaaaacaatactggatattcagcagtacttgtttcgtatctatgtaacaccaaaaacaaatagtcaaatacaatcgcaggccattgggctttgaaatcggacaaataaacttcctccttgattgggctgggtcgcgtacccgaatcgtgctccattggatctcttctgtagagaggcagaagtggagaacagaagaacagctaacaagtaacaaaggcacaaagccatcgaaatgacgaaatgtccaaccctcgtgcctcgtcgacgcttgcatgggaacgagcaacttggcgaccatcctctcggcacgtttcttcccaaggcaactccgcgccacgcgccttgctcgtgccgcgccaccgtgttcctctcggaccacgtgtgcgccacccgcgcgcacgcacgcgcgcgcgctcaccgctgatcgatctctagacctttccacccccgtcgccgctgttcaaattcatatccgttgcattcgtacagcatccggactcgcctataaacaggttgataaactagtcgaactacggatatgaaaccgtaatctcatccaatttggccgtcgtg

SEQ ID NO: 33180 - DNA, 529 bp, Oryza sativa
atgctcttctttagaaggatttaatggtggtaacagtgaattttctacccaaacactcctattgtaaattttacaaaacacttcttaaactttttaatactaaaaaaataaatctaaatggatagccacatataaaatcaaaataaggtgaatacttcccttatcaaatacataggtagcacacttcaaaaagatattttattagtagtaaagcacggatatttagctagttgaaactgaaaaaagaaaagagacatggtagaatccaggatgaaaacaaccttcattcaaaattagatatcactttttcccatcaatctttcacaaaccctgtgaagtaccaccagtacttcatcaacgaatctgaaacaagtataggaaagtggacacagtgaaaatggatagccaagaataatggcattctatttctttttcttttaaaactaccaaatatactgacctagacctaactagcagccaaggaaaggcactaccttaactgatacactggtgctcgctcagtctcctc

SEQ ID NO: 33181 - DNA, 290 bp, Oryza sativa
caaaatcgggttaaattagatcttattgcggtatgaattgatttcgctgatataacatcctaatcaacatgagatagatctacgtgaaagtggccacatcaaatttctacttcccctcatcgtcctcctcttcccaagtagctcgccgacggggtaaggggcggcggccggtgagcttatatcagtttttaaccccccatggtttttcactgtgattaccactgggtaacggtgatactcctattcatcaaaacggtaaaggaaacccggctaaaccggggctgatccgc

SEQ ID NO: 33182 - DNA, 1501 bp, Oryza sativa
tttgtcctataatataaggtattgtgttattttttagaaaaatgaagtaagtgctttggtttagtgctaaatcttgccctaccaaattgtttgtacatgtgtaatgtttaaattgattccaaaacttgccaaatcaatagaaatatgtcctaaaatattggtagttccaaaaattatctaaaacttggcactaggtaaggtggcaatccaaatatgctcacagtaaaaggatatgtcctcgaaaaaagtaaaaggatatgtgatgttacaaaatgtgttaggtgaataaataaaatactagtaaaatagtgatagatgtgaaataaacagtataaagatgataggtgggggagtaaagtactagtatcttaggaccttagagcaagtagaataaaagaattgagtaggctataatatctccaccatgataaaaatgatgagccggagagaataagaagagagaacttgagagggcgatcatattagcgtcgactgtatttagcctttgagactaggtgagaccattgtaattggctaaacttagcacatgtcggtggatctggatcatctaatttactaaaggaacgttacatgcgtgcagttatgctatatttgccatccattttcatctgacagctcctgctggctctcctccttgttcatatgtacaaaagaacttctgacaacattattggatttaggttaaatcatttagcatcatctaccgtgaagtgcgaataaaattacatcacgatattgtcccaaagaaaaggcagcattttggttcatgtacaaaagaacttaaaaaattaatcagtgtaatttaaaattagattaaaaaaacctctaagccaattctaaaattaagctctaaaatttaaaatagatttcctctttgtaatgttactggtgatatttattttgacaagtgcttttatttgtaagtttgatttacaagtgctttcatatgtatgtttgttttaagacaataatcacaggctacaattaaattttaactattaatattatattttataaatattaatattagttttacccgttacaacgcgcatgagcaatactactagtattaaataaaatacaaccattaaccctgaaaaagaaagtacaactacaaattggccctaatttgttaatctcggggtaggaaaaccaaacaaactctaatccccctgttgcaattccaaatccccgaatttgcatcgccattcgcacatgccacaacatgtgtagcactagtacaccggtagacgtgacgtgagcaatgagcttttcggccgtcgcgtgcgcgagccgccggctgctatgcctatgctagctaacccaagtcgagtagtagtagcaaagtccgacccgttcacaccatcaccatcaccatcaccaaatcgatctaaaaatactcgccttcttctccacccgagccgagcagagcagcgaagagggcagcgaagtcgccgacgaggaggaggagaaggagcca

SEQ ID NO: 33183 - DNA, 1268 bp, Oryza sativa
ctgatatagaaactttgaaacccacctatgcaagaccaccacgccaccttttttataactctgcatgatcaaactgtggacaaatgcaatgcagtatattataaactgtcacatacaagataaatatggtgctgcatggaattaatcaattaccattaggctggccagtagcatctagcaaacagaggaacacatctctcttattttcagaggagtgttgttattgctatcagttagtaaaactctgtctaacagcccatatttagagggaaaaaaagaaagtgaaaaagtcttctagctctagcctttcctctctgaccaactattgtacatagtgcataaaaggagaaatccaataaaatataatacatgtgcaacccaacatcaggatggcctcaattcattcattgtgccttgtttatatcatctaactcatcatatccctcaattattaacatccatcattgcaaaaaatacacccatgtaaaaaaatttactgcactcctagcactgcaatcaacatacatgtgtactgcattttgttctataaatggtgcttcttgttgtagaaattgttgtagcatgtccactttgtcagttgtgtgcttcaaaatctttggtgttggcattttcagaaaataaacatgaagcaccatggccatgtgtagatataagcaaaataagggcaacaaatgattaaagatagttgtggtttgtagagtataaaggatttaaggtggggatttctaccagatcatttgaagtgtgcatctcgatttcctgagtttgttgcctggttaaaacaacaacaattaggcatgacattcatgacttgttccactttgtttattatatactttaagcccacctgtaagatctgcaacaaatgaaagcagtcactatacaacaataattaaattctgtagaacagagataacatatctcagaaaaatatagtattgtagtgccagctaattaagatgagttaattaggatgttgatggtactaataacaacgtacatggtgatgtctaagttgattctctaatgttttcatgaccaaaggctggcagtgttgtattggcaccgaaagttcttgctcttagttttgtaccattcttaggcattccaatatcttgccagttatttatctgcacaaaaggggaaagcatacaagaaaatgcagatagagaacatcaaaacgtgcacttatgctcaagaaaattatcacagaacctcatctactcacagaattagtttcacattta

SEQ ID NO: 33184 - DNA, 364 bp, Oryza sativa
atatgattggttaatcaatagggaaggtagttcttggctcctgagttttattggctcgtgaatttcattacttcatgcacagttgtttgtatttgatatctagtcgctaagttggctgaaatatgagccgctgaacttttaatactctactccctccatcccacaaaatttcaaaccctagcattccaagatgaaattaaggaggaaggcaaaataccaaaatgtccctaattaataggaaagttgtattgatggatgggtaggtgaggggtatttaaaggataaaatttcttgatttgcgaactggtggtaggtaagaagatagaaattggtttattttgggacaaaattcaaacatagaagt

SEQ ID NO: 33185 - DNA, 345 bp, Oryza sativa
cttacaacgatggaaagttcatttgtaataatcattttactacctcaataggaaaaacaaaacatagagcgagcttttatagcctgaggctgtgtttagttcagcgcaaagtttggattttggttgaaattggagatgatgtgactgaaaagttgtgtgtgtatgacaggttgatgtgatggaaaaggactgaagtttggatccaaactttggatctaaacacagcctaaatgtgaaactaattctgtgagtagatgaggttctgtgataattttcttgagcataagtgcacgttttgatgttctctatctgcattttcttgtatgctttccccttttgtgcaga

SEQ ID NO: 33186 - DNA, 977 bp, Oryza sativa
tgtactggtagcttaaaacagcatacagaagccttatgaacgtcatacaatatcttgaaggaatgttactgcgttaatactatatgcgcccacttgtctaatgcaaaaggtaaaacaacacattgaaattgacttctagcttggtagattggcatcaataatctggcaggcgacaaacttcaattaactctttatgttgcttaacaaaatttgctgaagttatacactgtaatcatgcatctagcatttgggggctggacatatttcttttcaaagaaccgtgcataaatattcttgtgcactatttttttcaccttttgaaactccactaaaaacataatgaatattaaatcacacctttgaacaataaagactgacctcatgtcatgtcaacacataaaatagttagctacttagctcatgacattcaatcacttctgggtgatactaattagtgatggaataaatatcttctgttgattggagtacactgtagactacagaatctattgaaaaacttaatatctcctttgacctgatgatcaaaaaacttgaatctatttatcaatggaaaagtttttaatactgcagtgaaagagagacctaaatcaacagattagtagttatatggaactgaatgaactgacattcaaaatgttttatcctttgaccaacaggtgctggattttctagatgttctcaacatgaaaaacttaagtcaccatgaagcagcaaaaaagttgcatgctttataaaacatgacttagaggttggaaagggtacaattgcactgatgtattataaacaaccatctaacagaattatttgcgaataacagaacattgcgagcaatcaatttgtgtaattccaatttgttcaaatctccaacatcctttttttcccttttcagtagcattgcagtataccagagatctagatgacttctcaaggttagatgagacattggtactgctaat

SEQ ID NO: 33187 - DNA, 598 bp, Oryza sativa
tgcacaagaaatataaagtaggatagaagaggtctctcttggaaacagcattaaggtggatgtagctaattaagaattaaccatcttactgaaaaacttaaggccttaaactgttaaaaggtggacaatctacttatagtataaaacttgaactcagtccacatgcaaggccaatcaactctccaaggtttagaaatctaaacttatgttattgcttatcaggctccgtcactaaactttaggagtctctttggcagcaaaactccgtgctagtttggcagtctgttcaatttgtatttctgattatgtaggcctgtccaactatttattagtggaaataggttaaggagatgatttgtaccaaattttaacactagcatattccacctacaaatgttacgatggactcatttgtcttcaaagtgcagtttttcacaacccaaagctaaatttgtagctcagggacctcatcagacgttcatgaaagctttaagggtgtaggaatatattagcataattcattcattttattatgattttgttgtatttaacagttaccccagcaccccttatctccacttttcaatttctgtgcagt

SEQ ID NO: 33188 - DNA, 271 bp, Oryza sativa
aaatgagaagagaagagaagaaaatagaagaaagaagatatgtagaccccacgttactcgcttacatgtgagtcccataatctagaagatatgttgactagaatgccacgtcagtaaaattagacatctatactgttataggatcttatttttatatgattttatatagtttagggatatagatttctaatattagagattagggatatcatacagactcgatgtatgtaaagtggattaacggttggtgaacttattccaattaaaatca

SEQ ID NO: 33189 - DNA, 362 bp, Oryza sativa
cagttacccactcccgcttgtggtaagcacggtaagtttcccagggtttcccgtgaaccggtctttaattgcaatgggtgcgaccagcaaaaccatgcaaccccaacccaccattcaatgtattttaattaactaacaccattgcggtggcaccaatctaaaggtatgccaatagacaaagtctatgtaataatgtgatccctttttgtgtgctagttgagctaagcatggctaagcatttcctaggccaacatctagtcattttgatccccaagttatcaatggcataaggtaaccaatatgtggctgaggaataggacccatcccacattacattgtaaaacaatgcaatatttaataga

SEQ ID NO: 33190 - DNA, 613 bp, Oryza sativa
tccactatttagttaagtactcccgttgtttcaaaataattttactttttacccatacatgccaatacaaaagaaaataaatagaatacccatactttatcaaaatacaattattatctactttatctatttccaatacaattattgtatttttttactttcacaaatcccgatacaattactaccaaaaatgaatttattttgagacaaacggaaaagctaaaaaataaacttattatgagacggatagagtatttggcttgttattactaaaatatgtcaataacacacataagttatacaaaaaaaatggcattaccgacgtttcagtaagatgccaaaattcgattgtggattgatcaccagatggaatatcccgtgtacgctttccactgtgcaattagcaaatctggcaccaccatccgttgctcatcatctgaccttttcctgagtggataatcatgccctgcacttccaacttccagcacaccacacaattcaagtattcaacctccttttcataagcagaagtatctttgtcacactctactactactagtctactagcactcctaatgatcgatccttcccacgttcgaagcttcccctgtca

SEQ ID NO: 33191 - DNA, 179 bp, Oryza sativa
aaatcctctgaaacacataatttcataagactttcagagttcatctcccatgaattcgttttgaagatcctccatgttaggaaacgataggcaaacaaacgataaagaacaatagatcaatcatagatgacacgatatttaacgtggaaaaccctcctaaagaaggagagaaaaaacca

SEQ ID NO: 33192 - DNA, 819 bp, Oryza sativa
ttattcaaaaaatttgtgcgaatataaaaatgaaaagttgtgcttagagtactttagataataaagtaagtcacaaataaaataaataataattcaattttttttaataagacgaatggttaaacagtgcaaacaaaatgtcaaaatcccttatattagaggacggatggagtagcttgaacctagtattatttttttgattgcatagtacatgcacatgtacacacatcactgcacacgctacatccactcacacgcctatgaatgcacccccccccccccgattcatgttcaaagaaacgaaaatcaacgcgcaatatttatcttcatgtataattcatagcacttgaacatatatatgaatgtgaaaacgtttatgcgttgattaggatgtgtaataaaaaggttaatgaatctggtgagcgatcccgatctatagttagcttggttgtgatcgatagctatatatgctagctagttagtagtagctagtaagatggcaatcatttaggaagattacaaagtcgtatgattccggtaagtagttgacaaaaatttttgcagatgagattcattggagttgacgaagctgaatgtcatgtaacatcggtctccaaaaagttactaagttgaagagattcccctataaactctcgcaaaatccagggagtaatcaaaaggcctagctacatgatcgatcgacgacagttctaacaaacttttgtgctgcaccgcacacttacctttgttgcattgctattaattcgagtttcttacaaggaaaaaaaatgttttcttgaaccaccttttttttgtagg

SEQ ID NO: 33193 - DNA, 622 bp, Oryza sativa
agtgcgccaaaaataaacattgtcagtgttatcttagcttgaaaaatgctttaggtttgaaaataagttttaggatgttttacttttaaaaataaaaattgaaaaggtttttaaaaacagaaaacctagacagtttcctgttggaacaagatacccttctatgagaccgtacctgatacatgatacctgttgtggtaccagctgcatggtacccgatatctgtgatacatgttacccggtacctgtgatatctaggatctgatacctgtaatatttgtgcaagagaatagttaatatgtctgttgtaacgggatcccattttataacagccgtctttaaaaaaaattgtaaatcccagaaataccagagtcaaccggtgactgcccatcttattattggggattggtggttttagccaatggccgtctcctctcctcacggagaactgactcgaaccgctgagaggcaacagagaaaccgcacggactgaacgaggcggcggaaataaaacaactcgaggctggaggctggctggcttccttgccgctgcccggctgaaaaagcccccgaagcagaggcttccggttgaagcaaagcaagagcgcgagggcgccgtcgggca

SEQ ID NO: 33194 - DNA, 911 bp, Oryza sativa
ttataaatttttcaaataagacggacggtcaaacgttgaacgtgaatagtgcaaaactgcacttattttgggacggagttagtacatatatatacacattacacattgcatacataaacatacaaccacactgccctctagctatacacatgccatgatgccaagagccaatgatcaccacccaaatccttctagcaatagctccctatggcacaaacagtcacagctgcacaaacacacacacacacacacatatcacccattcatctactctagctaatctaaaggcactagcatagtactacaatcaaccagtagtagtagccctcatttgcatgtttttatttcgcccaccaatccttggaatgttttagattcccccctctcactctctcatcaaggaatgagcatcccccattctcccccaacccctcatattttcagtttctcactctacctttcccctcctcccctagctaacccctctctctttctctctctaaagctccaatctttctacctttctctctctaaaagctggagtagcttaatttctttctttctttttctttctcagctgggattgcacagtgaagctagggagaggctatagctatgggggtgatgtagctgggcagtgaggctagtgacaatctctctctcacacacacacacacaaaaacacttgtgtatttttggcagatgatgtcctgtcaaggaagctgcaattgcaagcccagatgttggacgtgcacgctcgccctccctattaaacccgccctcctccgatgctccctctcctcctcccccctcgccgccgccgccgccaccttctccggcagctcaccgtcgttgtagtagctctggtggtggtggtggtgacgacgacggctacggcggcggcgacggca

SEQ ID NO: 33195 - DNA, 561 bp, Oryza sativa
aaagtgtgtcttcttcttctcgcgggagatcaaattcattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacacaatactctttctcacttgcctgttttctttttcttcagggaagggatctacaaatgacagtctcgacg

SEQ ID NO: 33196 - DNA, 355 bp, Oryza sativa
gggggcagggagatttggaggcggacgcgcgggtggtgcgacgaggaggacgaggaggaggaggagaagatggagcggagggggttgtggccgtgcttgcggtggggcgggtaggcgtggacgacggcggcgagcgggagggcgcgcgcggagcgggagggctcgtggaggaagatgaggcggtgggaggtgaggacgaggaggcgggcgcggagggggccgaggcgggggctctcctcgggctccacgtccccctgcgcgacgaggtggcgctcgacctcccccgcggtcagcaccggccgccccgccgccgtcacgtccgcggccgggagccagtcggccgccgcggcggaca

SEQ ID NO: 33197 - DNA, 1448 bp, Oryza sativa
tggtcaaacagttcaaacaaaaacttaaaatcccttataatataggacggagggagtataaggatttctagaatttaaattttataccataatataaatgtatttttgtgctaattccaatgaatcccatcatttcaatgattccatagccaatcaaatgcacaatgtgaaaatatgagcggatcttaggacatcaacaatgtgaaaatatgagcggatcttgagcccctaagacgtacgcaattcaaaaaaaaaaattgccaacctcagaactatttactaaatagcctaaatatccttataatttggaactgaggtagtactaacaacaatcaatcccaaattttttaactgatttttttactgcagcctactcaactgaaaactcagcaattcgcatcgatctcccaatgaggtgctcatgatctaccgcgaaatgcgatcactgcaccggcagcttttatatatactgaaaccatcgaattaaactgagttacaattggtgatcgataaatagatcaatggcattgattgatcttaatccgcagctaacatcgccatcaaaccaagccaaagctctaactggttaactgaccacatcttggctgttcatatgctccattgctagagcttgatttccagcaccaccacccgagctcctcttcagctcctcgcacatctcctcgatcattggcttccatagccgaactcgagcgtttatgaaccaattcgacacctaccatcgccgcgcaaatcgaccgaatcagccacggaaaatcaaaaaaatcatgctaaaatgtagtacaacaaatgtgttttcagataatataattcagccaagaacatgatcactgggtctatgatttatcatctttgcagttttgtttcgtcgaaaatgcggagaagcgtttggtttacgaatcatttttgtttgacaaaagtttggaaatgagttgtatatagtactcccttcgtttctaaatatttgacaccgtttactttttaaaacatgtttgaccgttctttttattcaaaaaattaaataattattaattttttcctatcatttgatttgttgttaaatatatttttatgtacacatatagttttacatatttcataaaaatttttgaataagacgaacggttaaacatgttttaaaaagttaacggcgttaaatatttagaaagggagtattacctggttcctgctgaggccgctccttgctgcgagcatctccttctcgctgtctttcggatacctgacgcaagaacaccaaaaatgaatcgaatcagattgtttgatgaaggtgttcgatcaaatgcgtgatgtggcaagatcggcgtcaatggcggcgtgggtggtgcttacgggcggaggaagttctcgaacatccaggccttgaggacggcgacggacttctccgggaggccgcgctgcggccgcca

SEQ ID NO: 33198 - DNA, 1501 bp, Oryza sativa
tctatagtaagtgaaataggaaaaccgaaatctagtgatgagctcgtattgatttgcgcaataccagcggggcaacaaagcgagagagagttaatatagcacaacaacacgaataagcatgcagacattggattctgcagataaagagtactccctccatactcatattagaagtcgtttaggacataattgtgcatactaaggagtgattaagtagagatattttttcatgtctgcccctaataaatagggatgtggatgcattctgtacgataagcaatcatagctcaaatggctagtgcagagatcactttctttttgcttgcaataactacgcatacgtgatgacgagcgcaacggacggcgagcgcagagccatacacgaccccgcgggcgaacgacgacatgtattgtgaaaacggaccaaaggccttagaacgacatctaatatgagtatggagggagtatacgattttcagttccgtcacatttctttattattcatagctcggctaccatgttcatatgcgttctgctgctgcctctgcacaacacatgaaccagagttcaatgtgtctaggcgagacaaagattccagcttttgtcaccgagaaatttcttgagcgatttggttggccaacgcgagagatcgattcactgcggagcaatcagcacgggatccttctttcccttgagaaagtccgagtaccaacgagcggagcgcctcgctcgccgcggccgcgcgccgtcgtcgaaatccacacggtacaggccggatcgcgactggtagccttccaggagctcgtacacgtccacaaatgaccaaacgaagtagcctctcacatcaaccccgttcctgcacaaagcagagatcaatcagaacagcatgaggcctcatgtttacgattatcagctaaaatctaaatttttaactttaaatttaaagttaaatttgggattatttttattgtatattatttttcagccttcgtttttacaccgttaagaacacatatataaaagttttattcgaggaataagccaaatgatggggctggaagatggattgaagtgaaactcatgtagtttgacacactgatactgatgtttggagatcacctgattgcatccaggacacctccaatgtagcccttgatgtaatccaccctatcagggtcgtcgagactgtcatttgtagatcccttccctgaagaaaaagaaaacaggcaagtgagaaagagtattgtgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgagttttgagaattaatccatttgattaaggaattggtaacttatatcaattagtcctaattgatggatggttgatggttgtgtagtggaggatggttcatgg

SEQ ID NO: 33199 - DNA, 1314 bp, Oryza sativa
aaaaactcaaaatcccttatattatgggacggagggaatattttttaaggggagcagtaaagtatttctggagctagcgcgaatgggaggatgacctctttagcatggatccatcgggtaatcatgcatctatgaagtgaaatttgaatggatttgggattgccaaggtacaaaaatgtggtgctggtttatctgcatttgcagcactgaatccagctacctgaacatctaggctctagctagctggagtatttcttgttccaggtttcgtccacggatcgccacatgagagcacatgtgatgttttcggtttcggccctatgaaccgtgctacctccattcaaagtatagcaacttttggtatttaggtcttctttgaattatatgaatccaaaaaagaataagaatccaaaaaaatacatgattgcaatattaatcctacggagaataaaaccatgggaattactcgatacatgtgtaatttccccattatatgttgcccatctactttcttattttaaccaattataaacacccctctctttagttctcgcatgaaaaaattctgaactatttatattttagcatggagggaacaacaattttaaatgttgttttgatgatattctcactttacaacaaaagttttggcagagtgcggcaattcatgcatttacgtggccacacatgtggcaaattatagtaaagtggggtaacagccaaatacaacgagccccatcggttaccctaacaagctaaagcaaaagctaaaatttaaattttcaaatttagttttgcagttgattttaagatattttcaacatagttttttttcagcattggtttttaagtcgctaataacacatatataaaaattttacctataaattactttttattcccctataagctgttttagtttattagagaatatggacaaccgatgtggacctaggctaacttggttaaaggtgaatgccacaaacgtggttctcatgtctcaagcaaacatcccactcgtaatgcgtgttagagttgacagttcattggagcaaaaataccagggattcatttagcaatagaccctgttagcctgtctggaacatagtatggttcctgttgatatcgaactataaaatcctgtgaaactgatttcatgatcttcatgaaggactctttacaatactattagggtaatgagagccactgatacgtgggcttacttgtatcgtctaagctcccatctcattgactttaaatactcctacaataccgtggaggatccatatccatttaaaccgtagtgtctaaaga

SEQ ID NO: 33200 - DNA, 1501 bp, Oryza sativa
tgtcataagctcctgcaaagaaacaatgctaatggcttaatccgtgtattttcagcatgttctacataaaaaaaaatgtactggtagcgagtgagagcatgatcttgatgattctgttgaagttgtaaaaaatgtatcttgacgcatgcatggggacaggcaaaatgcagtacttttccactttacccaaaagtgtttcttctttactctcttttccaagaaagaaagaattactctcttttccaagaaagaaagaacaaagtagctgcggattcaaagttattctgaagaaagaatatgtgcatggtactaggacggcaatggaattcggagccatacacgctagtgataatttgtgaatcatagcgaagaaaaagtttgtgaacttttcccacgatgtgaagaggatcttgactcacccagatagactaatggaggcgatgagacatcagacatggatgagcatcgatcaccacacgaattccgaggcagaaggaaacaccgcatttgcaacacaaattaaaaaagatcagcacataagctagcaggaatacaaaatgacctaacaataaccaaagaaagagagaacaaagaaaaacaaaatggcaatcaacttgtcccattagctgcagaaaacatagtagacccgaggctcgtagaatttgtatttctcaccttgcctgcctctcttccttgtctggtttgggttccagccttgcttgtcccacaggtgcgcctcgtacttccctgaacccctgtgcctacacaccagcaacacacaacaaacgacgcattcatcagaaaccaagcaaagatcacgcaaacaactgcgaactgatcatcagagcaagaaaaaggaatcgaaaacgcagaccttgccacgcccttgtagatggaggatcccttcctcggcgcagcagcaacggcggcgtcgtcgtcgtcaccgccggtgccatccttggccctcttcctgtgcttactcttcttcttgccgctctcagtgcgcggcggcacaatgcaggaggacgccgtggaggaggaggaggaggaggaccgaggaggggaaagcaaggtggttgcagctgcaacagcaaaggccttcttcttcttcctcatggagaccatggcttttgttgatagctcctgcaaggcccctgtttgctttcctccttggcaacaaagacaacagacaagggtagtgggtgtcaccggtgaagtgaacctgcctatatagggaagcaaggaggaggactgtactgactactgagactgatctggagtactcctagtgatctgagaagggaggcaaaggtctgggcactatagcttccaccccgagcgccacgacacttggcgtgacgccgccgtggccaggcgtgtgggggcgacgggcgtttttacggtcaaggtctcggaaaatgctgggtacctgcgcgccgtgaagtggagtggtgcctccatgcaggtgcgcaccaccactcgcgcgcggctgtatgggact

SEQ ID NO: 33201 - DNA, 812 bp, Oryza sativa
ttcctgcacccctaacttggcttcaacgaaattggagctagtgctcatctagtggtaagtaaataaatgtagccataacatgcgaactcctagatgagttctggaacctctctttcgagggattttctaagattttcctatgagtagaagtgtttctatagcttggttcttgacatctatcccgagaggcttgcccactatcaggattccttaaaccaaccaaaacaaaccaaacaacacatcacgtattttatttgaacttctaaagatgcatcctactaatagagatagcaatctagcatcgaggccaagttgtttatctagtttaactttttgagcctcttgtcgctgtaaatttatctggcaacttcaaaactgcactattatgtccagaatttgttttggaaatttaaattatgttcaaattatatgttgcaaaattaagtcaatatttttttttagaaaacacattataaacgcaaacgcttacatacacacgcataggggttgacaaaataagaccgaaccgaagaaccgaaccgaaaagaccgagaccgagaaattcggtctcagccctcaaaagaccaaatttttttcggacaattcggttattggcttcagttaactaaattaaccgagaaaaccgaattgtggcccaataggcctaggaggcccaataagcccagtaaattgctaaaccctagaagtcaccgctcctagtcatgagtcacgcgacgccctcaacccatccatcgcgccacctccgcctccgatccccatccatcgcgccgcctccgcccatcgcgccgcat

SEQ ID NO: 33202 - DNA, 1501 bp, Oryza sativa
aaatactaatttgattgcaaggaataagaaatgtgttgttttacctactaatttgtgtgcacgaactaacataaataatgacagtacattttgcaacaagcatgtacaatgttgtcaaaataaagcatgatattgttgatgtttcagtgtttatcacagtaacaagaaaaaggaaaagtaaatatgccagtggaataggtatcacaagctgtacccattaccaaattattttttctcttcagtttgtataactgtcccttttctcatgaagcaacttctgcataatgctccggacattcaaccatgatggtcacattgtatttgcgctgatgttgcggtcagtggtttctcttttagagggccaaagggccattgaaaacaaatccagtaatttttacagaccatcaagagaaatccatgaaactcactaaaacgaaatgcagcttgacaacacacaaagcacactttaagaaaaaaaaaatggagcccccgagaaaagcaagaccatacacactttctgcaagatcaaaacatcaatcaactcttcccccaccccccaaaacaaaggaacccagaaatacagccaaatctattattattatgcggggcactgactttcgggaccaacggatcactagagaatcacagtgcattctccttttcagttatacctcttcgacaccatcatcaagatcaaccttccggagtttaaggttgttttttccttttaatctcaattcgcaacatctgatggctaaacttcgaagctggggcactgcttcttctgtaaatataactgttttcaacttggttagcctaataatctccagggtcttgagctctctgaaggccttatcatagaaaaccaatgtctcgctaatatatgaattgtctaggagagcaagtgtgaccaagcagggtagtttctcaagggacattatatgattctgttggagattagtcctgtaaagtttaataaccgcaagtgtccatgagttagaaatccagtatggcatttttccaatatgaccgtcaagctttatggtttggaggcgtggaaactccagtggcttcttccttttcttttcagagatgggcaggcaagcaagtgttccatcactttggcatgctccgaggtacaaataggtcagcgaagaagaaatcctttttagggttttggagacttgtttgctgttgccaattgtaatgcctgccaatccaaggtgctccaacctagcaagtttccccaaagcttcaatttctgagccactgttgtccttgatatccatgatatccagcctttctatgtcctgcaggttctctatccctttaggcactgttagagctgaatcaatgcagcatcggttccttctattgtgacaggaatcttctgttcttctgctagcacgaaggagttgtagcttgccgagttgagtgacctcattaggaagttttgtgatccttgtctttctcacgtttagcagttgcaggaacgggagca

SEQ ID NO: 33203 - DNA, 1052 bp, Oryza sativa
ttttttggatattgttttaaatccattttcaactttataataattacatcgaataatcataaaaatatgcctatttttgaaaagtgaaatttatagaattttcacattaattaatataaccataaaaaagggcattttggattttttttatggaaaacagcaggagcctcccactgcagtatattaagtaatcagaagtttatagacaagcatttaacaccgtgttttcttaattttacaaggatattattcgaatgatagttctagtggctctttttagttttctaatatcagtcttcctagatagaaaaaggcaaataaaaaaagaaaaaggtttgaaccaaattttattttcagtaaaggacacgagaaaatgatgaatagccaacgtgcccccacttcgcatcccccgcttccatctccatatctatttctctcttcccgcacctactactacactcctccctggtcccaacttccaatctgcaagagcgactgagagacacacacacacagaaacggcagcgcgagccgcaggcacatcgtctcctcggctcctcgccccgcgccggccgccggcgagaagggccgcagcccgcggccaacggacgcacggtgtgcacggcctcctctcccttaccgacgccgcgctcctcccttgtgcgcgcggcctggcctgaccgacctcctcgcctgcaccgcggcgaccggggacaagcaggtcggtctgcctgccggggctgaacgcggctggatcgaattcaattgtgaaggtatccattctttacctcgtagcagcagaaatctcgtctcgatcatggggagccagacaatggcgtcgaaggccggaggcgggggcgtcgcgcggcgcggaggagggcggatgcggagtctggggaggcagggatccatgtacagcctcaccctcgacgaggtgcagagccagctgggcgagccgctgcacagcatgaacctcgacgagctgctccggagcgtgttccctgacggcctggccatcgccgacggtgccggtgccaccaccagtagccagc

SEQ ID NO: 33204 - DNA, 154 bp, Oryza sativa
gaattcctgcagccccggctttatagtggaatgaccgtggtaaacccagcatgcatgctttgacctgaaagatgtaaagtctggttcatccatattggaagcgctatcctcggaacaactatgaaactttgtcttttctgagaaacaacaacta

SEQ ID NO: 33205 - DNA, 1501 bp, Oryza sativa
tttctgcagtgtccgcccataaacatggatgcttacaaccgaaaaaaaaaactaagcaccggtttgatagtttgatctccttagcgaatcaactcctcccacataatcaatctaaagggttattcaaattatataacgatcagaactgcattaacctaataactcatgctcgagctacatttttgtacaaattttacagcccccggtaccgaaactgcacaatagaatctgttcatccaacatccaatatcttccgtgcgcttactagaacaaatttctcgcagaactggtcaagtgaacaagacatcatgatgcgcatagatgagagagagagatacagagagactgacatggttggtccgtcggaggggccggcggcgagtgcggcctccttttcgccggccgtccgagaagattgggacaaatgagacgcgagaactgcgaggcggccgccgcttccgctcgccggcggcggcagctgcggcggcggtcgactggcactggcccggctcatcccttccccgacttcctcgcccaatcgctgacttactgctgcctccatcaccgtcacgctcgcacctcagcttttcaacagatttcccgcttactaaaggtcaaaacgtattttccagctttacgctatgttgccagtgtaaacgtacacgtgaaagacgcctgcacagactgctctgtaccgcattacaaccgctcttcttaaaacgatgctcccaacatactccctaatgtttgacgccgttaacttttttaaaaaattttgaccattcgtcttatttaaaaaatttaagtaattattaattctttttctatcatttgatttatttttaaatatatttttatgtatacatatagttttacacatttcacaaaagttttaagacgaacggtcaaacatgtttaaaaaagtcaactgtatcaaacatttaagaaatgagggagtattttactagtgctctttactagttcacttattttggaacggaggaaatatacaataagcatttaattactactagcttattgcatttaattactactagcttatttcagatcgaagaagtatatataacaagcatttgattgctggtgttaatccgaactcttatgattctcaagcccacaacatatgagaagacccgagctgccaagggagcaagtcctatcaaagcatcaatctatcatcatctggataatgtgagaatgacatatacggatgtttttttttgttttcttctatagattctgatttgaatgggatgagattcgtgctgtgaaaattacaaaaagagagaaacaaatcgcatcctagattccaagagtaaaagatgtttcaccaacagatgctgctgcgggaactgttgctcgaaatggcatctgacgaacaccgggttcaggatgtgatgcagtgagtacagcaggggcattcaggataagtatgtttcagcaactgatagcagatgatgttggagacagacagcgacat

SEQ ID NO: 33206 - DNA, 1501 bp, Oryza sativa
tagtggttaattgagttgacggtttgagggtttgagtttgtccttaatttggggttctgcttgaattatgacctggcattacctctcattagatttgtggttaatttcctctaattgcttggaaataattgagttgttaccgtgctttacagtacttggtatgaagttgttgaatctaatagtttccctttgtttgatttggggaaactattctaatccctcgatgggatgtttcctcgtttgcttaaaaatcatctaaacggttatgaaaaattctgaaaaaatttgacaacattcatacaacacatatattcaactccaactcaactcacacatcgagatataaaaaagacaaattcagcgtatgaatagtagcatactgtttatatctaaatttgtcttttttttttctcgatgtgtagattgaatatgaacatgatttttggtgaactaatagatatcattatactctacattctacattgttaatttttttcagaatttttcacaactatttgtatcgaatttgtaagaaaaaggtatacgaggggatatctcctcgagggattagaatccactcccgtctgatttgtattactagtagtctctgatgtgttgttttgactgaatgacgatgatttgattcatcctgatccaaattcagatgtttttcatagttatctttggtctctcatgcatgtatatgtgcattttcaatacaatcagaaagaaaatgtgtatcttgtttaaataacagcccaaatcattttttttgctgaatatttctcgtcgcattttttttagcatgaacaaagtaaatcttgttttaatcagcccaaatcattttatgctaaataacccccatcgcgctttatagagcatgaataatgctttgacgactattgtatatatgatattttcatataatatcaggccacatctatatggtttgataaaaacagataaccaaagtttgtttgttttgctttttcaaatagattcatatactcccttggtccccaaatataaacatttccagttttatcttaattcaaattactcctttgactaattaagtttatagataagagtattaacatctaccacaaatccccttaaaaaacatctgccacatcaaacaagtaaactacaaaaatttattttatatagtaggtatgtataaatgaaactcattttcgttcaaaaacagagtccctacttacacgcccaatactaggaaatcccaaacccttttttttttggttctccggaatccggatatacgagcgagatttggctcccaatcgtagctgcaattcctttgcacgcaggagaagggtgcatcataagaatctattgcgcggccacttgggaggggtcgtaaccagggttcacagttctgacgaaaaccggtcgaattctgtgaaatttcgacacggctcgaaattaagtttcaattggaatttcgaaggttaaacattatatttggtcaaaattcagt

SEQ ID NO: 33207 - DNA, 698 bp, Oryza sativa
aaatttactctttatttctggacacttggccattgtgagcatgtgatccctatatatatatagggcctgtttggttggtgacctgagtattgtgcctgagaaaattgcatgcctgagtttcacatgagttttgatgattatgcctgacagaaacttatttgattgctgacccgtgcctaagagatctagaaactatgattatctacattatttattcttaaacactaaattaaccatggattatttattcttcaactttgaatcaaccatagattatttactattaaactctgaattaatcttgttcagccaacactctacttatctaaagcaaacaggtctgaaggaggtcaacagaacacaaacaaataaaggcaacaacctgtagcgttgcaggatggttaattaatgcaataatcactgatcaagcactcatgctaacttgttaaggggagtactgagaatcatatgctagccacaattggatcaacttccatagcttactattgtctattgtagttatctttaatttttaaatacactgacatgatcatgtttctgctttgtttgaccactcttatatgatttaagttgtaatttcttgttatgcctgacaaacttctaacaagtttcttctcaaattaacattttcagggttcttgctcttgcaaccgaaaccttgcagcaaaactttgaag

SEQ ID NO: 33208 - DNA, 152 bp, Oryza sativa
tgataaaggaaccaaaaaattcatttttgtaggagcatccgctatatgttgggctctatggttcagtagaaatgatatggtttttgataaatctccgtatgtatcttatatgcaggtccttttcaggataacatactggctccggttttagg

SEQ ID NO: 33209 - DNA, 401 bp, Oryza sativa
gatcgaacaaaacaccgcgagagaagtgcagcagcaaatgcgcccgcccgctcctgtttgcattggttgatagctagctgtgcgctggacatgagaaagacttggaaagttcgtgttaaattcgtgcaaaacttcctactacgttaaaattaggctgcaagcatgccacgtttcatcggcgcatcgatccaataattgcgattttttccccgactgcagttggacaaaacaaatgacaactaacacagttgatgatcacactgtcgcgcagtcgcaccggccactagcaagatcgaggaagcaaacagttttttctaaaatctgcaggtacatgagcaatgcatatatgcattgcagctggagttcgaccaggatataggagtcatcgacaaacacctcga

SEQ ID NO: 33210 - DNA, 635 bp, Oryza sativa
ctgtaacttgcatataattacactgtaacaatagtgtaacttgtatgtaactttcaaaaatctctctgtaatatgttatttcggtaaaatggaggttatgggaacaaatccttacacatatgtgtgtgctgtgatttttttcttcctcaccaaaacaaatcttgtaatagatttaacgattcaaaattacgtgaaacttatatacaagttacactgtagttacatgcaaggtacagtgtaattacatataagttacagtgtaattacactacgattgtactataattacatctgtcaattttttaggagaaaatttatcgataaatatatagctggtcccatatttttatatatttttttcttttaggagtagctaattgaattgcatctcctagctagatgtcacacgtgttcttcgtatcattcattcatgtgtgtagagtgtcgaccctgtagtcctgtagcaggcattggatagcagctggcgcctggcacccaaaacaactatgagccgcgtcagttccaaatccatcagaaccgttggtgtccaaaaacactaaccctagttttacttttcctctcccctcccctcactatgagccgctctacctcccctcccctcaccggatcttagc

SEQ ID NO: 33211 - DNA, 1501 bp, Oryza sativa
gcttttttttgtgtgttttctcaatagtttttctttatttcatatgaaaacataagggtgtaaaggatatttaaatattgaatttgcatgcatagatgatgtggcatgtacacatggcatgtttagagggtctaaggaccatattgaatcacacaatgaacttaaggtacttatttggacaacacgaaatgtcagggactaaattgatccttaagcgaaagttcaaggatcacgttgggtattcaccctaaacctttcggcatgttcagattagttccgaaaataaccttaccaaaatttgacaataccaaatttttgacaaattgatagaattgccaaattttgatatgttggaataaatatgttgtgccaaaattttctatgcattaccaatatttggtaacaaactaaatgcaaccatatatttgttaattttaccaaacaacggtatggtttaaaatggcaccaatctaaacagatcctttatcacttaaatccaatgttgattagagaaaaatgattattagaaaaatttaaattattttaataatgttataagtatagtgacatctattacttaaaaaaattaatcgcctagacattgagaaaaataaagagataaatttgagtgcaaaatacagttcatagatttgttctttatatctcgatacgtgagttgattttagagttaagattttgtgatgtggcataaatatgttgtttgaatattgttatttttttaaagaactttctatgaccatttggatagtttttaatatacgaggggatgtctccttaggtatataatactttctctatagtacaactcattttcataaaaagttgattggagcttatactgcagctagttgtaaatctgttgtagctacttttttctttttaacttgacataaatttgatataaaaactcttacaatatgtttatatcactttgttgtacttacactaaaactacgtggtcacttaaggcttggtcagattgtagtcgaaataaaccttaccaaattttggtaaatttatcaaatatgtgcacccatttagtttttttatgaaactctggtaaatacataataaatcctaacaaaacttggccatattgccaaattgccaaaattttgacattgccaaaatttggtaaagtttattttggctacaatataaacatgcccacatgcccttaacatgcactagctaacataggcttcatttggatcatgtagtggtcaatacgtcaatggcggttttacccttcatcatccaggtcttttggattcatttttttctcttctgaaaaattaattgaagggttaattgcttgtgatgaataagttttttttcttaagggtcttgtgatgtttaagtttaggtgttaaagtggtacgtgttatgtctcactgacgtgtgggtcttaatgactgaagtatccatatttcatctctgcagttcatgggagcagcaagatccgttttctaccaatcga

SEQ ID NO: 33212 - DNA, 1414 bp, Oryza sativa
gacgcaccagcgccagcgccgcggcctcctgctcctcctcctcctcttcggctccgcctacaccggacgagagccacacgcagcaagctcagccgcagccgcagcagcctacagaagagtcatccaacactgaaccgaagcctctgctcttcgtagcagagcaggacggcattccagaacccgagctgaatcctcagctccagacagctgaacaacatggcagcgacggcaacacggccatgttccagccgtcggtgacgtccggcggcatttggggtccggccgacgaggcgtggttcagcgcttgggggccaggaagctccgtctgggactacgacatggacagcgcccacggcctcctcctccagtctcgcttggccggtgagcagaccggcatggactacgcctacaccgcgccggaagtcctcgtggcaccggtgccggcggcagggacagccatggccactgccgcttcctcctctcttcctcctcgtcctccccctccttgccacagtccaaccttcgcatggaaggactaaacagcatcacacgccactcttacacgcaggaacacctaggttgtgagatgcacacaggttgcaaatttttgagacagcttgtggcatcgcacagtatgatcagcgatcacatcgcaggaatatctcaactcctcgagggcattcccattcccgaccttcctctctgaccaatctcctcctgaaaaccacaaggaaaaacccggctgcattttttaggctgggataaggatggccaaatattacaagcgtcatccttatcgatctttccatgatttttcaaagatggattcttttagacatttgactagctagtgatcgtatcagtgtctgtcacctgcaggatttgtagttgaatgtagcatgtaagggtttaaggattcctgaaagaggcttggaaagaggagacgggttttatgctctcctctgttcttacttgatgcttgtgttttcttcatttcttgcacgtactatcatgtatttattcatgtgtgtcttcttgatttggaagagatgtgccatcggcaaggtacttatttgtactgtagtctctatggtcaataataatgaattgatagttgcatgtcttcctaaagtcttgtttttcgtcttcaagtcatcgttatgagttcatgaccacaaatatggacagacatgttaacattaatggcgcgagtgtctgatcggtggaattattatgtggattcgaaatttcgaactgtttgagaagaaattgggccagaaactcgtaatagcccaatggcccagatgggccgatctactaatagctgggccaggaaagcatttacaattgcagtagcaacctttgcaggcatccccttcgccttcgccggtcgccgccgtcaaagccaagaggc

SEQ ID NO: 33213 - DNA, 1209 bp, Oryza sativa
actacttgcaccaaagcgcatctcgcacaccgcctttctttttattttaacccaagccaaactggttctggtggtcttgtggattttagccaccaccaccactgcacggtcgttggcctctcccttgctactataaggggaagccagccattgcagcctcgcctgcgcgcgccagccatcactgtggagtgagagctcagctagctcagcaccgccggctcatggcgatgccaaccaagatcgccgtcgttctactacactgacatgtgaagcctcctagtcctagatagttgagagaggcttttcttctgttccggcgacggtggggatgggcctcgccggcggcattgtccggcgagtcttctccaagagcccctgctcgtcggccggcggtggcggccgtggttgccacaatgtaggtgctcttttggtgttgcgtccactgtttttgtgtagggcatacgtttgtggtggtgcagtgcaactgtgcagtcggtgttgggttcgggttcaggttcagtacgagaaaaagtgaagatctctcggtacaccaatcagtaaccggcgatgaggccaatgtactttcgattctgtactttgtcgtggcacctcggttcatggatcttcacaattgcagatgcttttgcctgcctgcgacataaacaatctgaacagaaaatggagtttgattaatcgagtgaagaagattgttctgatttttggtttgcaggagaggggctctgctgatcacaagaggagatggagctctctccggctctacctctgcggcgacgagatcagcgcggccgccgaggacgagaacgacgacgacgatgatgggacggtctccgtcaagagcttcgagacctgcgcaatgccgcaggaaccgcaggcggcggcgctgacggttgctcgaccggcgaatggcgtggatggcgtcgccgacgccggcggccaccctgaagaacatgggagcatgagcatccccatcaaagacatcgcgcctccgacggcggccgagccggccaccgacagccaagtcgaagcggcgacgatgatccaatccgtgttcaggggattcatggtgcgttcttgatccaaattcaaaaattggaggttagaaaaaaaagatcgatcatgcagatccactggtgttgcaggcgaggaggcagttgcagaagctcaaatgctcagaaaacggctgctgca

SEQ ID NO: 33214 - DNA, 1501 bp, Oryza sativa
aaaatatgttaggtgttaaaacaataacccttttttttaagtgcgagaaggacacacactcaaagcttgtgtgtcctaaaaacgctccaaaacataagaccttgcaaaacatggcacacacgtctgattttttccaccaaacaagcacacttgtatataaattttggtagataggcagatttacataaatctaaggatcggatatgtgcgtgaggaataagatgaaggcaatgatgtttctagagcataaatcaattaacaacgatggcacgttagtgaataaatgagtaacggttttgctagctatttgtggattatctaaacgtggtcaaaatacaaaattgtagctttcaaataactttattaacttttagcttgctctcttgggtttagctagctatatgcatgtgtttttatgttgctattgattatagggaaaattgcaaaaaccatctcataagtcaattgaagtttgacattttacccaataaatcactttgttgcaaatacttactcatctatttgttgcaaaaccacatgttttcataaagtgtgagccgtcaatgtattctttaccaaaattaaatattttcatagtatagtcttgacactttttttttgagattccacaaatagaattgctgatgagagcttaaatgttgatgcattgagtttctctatatgaacaaaaaaaagttcaatcaaacatgaaaaataagtgtaatgcaagcacttggagaagattgatttcgctaacttagcatgtggtgactctacatcagcgataatgggccaatttggttaagcacgtgcgcactgggtggtttttgcaataaaactgagtaggtgatgggtattagcaataaaataacttatgggatgaaatgttaaaattcaagtgacttatggggtggtttttgtaattttccctatagtctctttgttttactagcgaaccaaccgttcgttgttacaggaattagaaaaatcgcattggcatattacaaggaagaaatctattttttaattttagaattaaatttgagttttatttatctttttgtgttttagccataaaaatatttctagcggactacgttgacttcctgtcactaaataaatgctcctcccttcaaaacgttgcatcatagataatctatgaattctaccatatatgcgttttgtttgaggaggggcactgatttcacatatgttttggaggttaatggtgggtggtgaaagatgcaccaccgctcccttttataagaatatagatactggtaagtggtaaagaagttgaccattttttttgttagttaatttcaagcattatatgtttcaccctaataaaaagaggtacgtagtaaatatgtgagttgttttgtgttgacacttgatacaatatttcaaccaaaaagaaaggtgattgacaaataagttacccactcagtgaatagatgcatggtccaacaaatgtctagtttatatgagaggaacgtat

SEQ ID NO: 33215 - DNA, 1501 bp, Oryza sativa
cattttgttgtaaaatttcttctgtttatgcatgatgactaatgctctgttcggttaaagctcaaattagacagaatcagcaagttgtgacttgtaagtttaacatctgcaagcattatactacacttcctttttagaaccctgaggtgccacactgtctcagttatgtgtttaacatctgaaaacattgtacttcacttttctcttttagagccctgaggtgtcacagtctcaattgtgaatttacatccgcaaacattgtttatagtagtagtgatcctgaggtgttattgtctggtgaactctgaggacttgtgtttgttgacgtactttagatgtttagcactgctattaccgaatgcaccgaaataaaatcaattggtattcgctattgatttgtgctgtgagtgatgcattttctgtattctacatttctggtatccatttcaggtttccttcagctataaatcaaagtctctgttttaccgtactccactatcgttcttgtgcctttcatgaggtttgctcccataatgcaagtggtatgcctgatgtaaatttggcatgaatttcgatgaaaccactcaaagctatggacagtgactccagtgagccatgattctgctttctttggtttgtctgatgagaaaagcacgcatccatttttctttttcgcattcatttacgtgttcccccttttactcctctttacatgttcagcctttgtggagctatacgtctgttcgctgacattctacctgccatttaaatgcgtccttcgattttgcatagtactccgtagcccggatcagaacggtcaacttggaagctccctgatgcctgagctagctttggattctcttactccatttgaatcccccaaaggcaccattggtcaatccatgtgtttcagtccatgtgagcgtggtccgagcgtacataaaaaacctatcctttcgtatgcgccggcagcgattcaagtcgtacgcatacgtgaaatcgtgaaccattgatgccacctggggtcatcaggccccagtaattgaatggctaaactgcaacagctgatgaaatccatcagccaatcaatttaccaatcaatggctgcgcctgatccgctttgctgcccactgctcctccattttcctctcacgccgtccacgtgaaaaaaaaagaaaaaaaccaatctggaaccttgtggtttggttcacttccctctctcggccgcgcgaatctggcggcgctgccgaagtgccgatccgatcaaaaaggaggggtttttgccacggatgccgcggtggcgttttttgggctttctggcgtggcgcaacggtcggcttctctccgggcgttcaaaagaagaggtattttaacgcaacggtcgaattctggtgcgacaggagggcaaagggaatcgcccgcgagcgtgcaaatcttgtgcgtctgcgtgtcgtaggcaggaagccgttgggtgaatctggatcgggctcgctcgcgtcgg

SEQ ID NO: 33216 - DNA, 1501 bp, Oryza sativa
gactagagctgtcaaaaaagcttgaggctcgactcatcctaggctcgattcaaactcggctcgacctccaaacgagccgagcccgagcctagctcgagcttccaacgagcctagtaatatattatttttattgttattcaataatttaggatatcaaatatattatttacatgcattgtattaacatcatatatttattttattctttttcctcttctattaatatgatgaactaggaacaatctcggtagtcaagcttgagcttcatctagctcaaaccaaatctatctgaaagctcgaacattttatgggctcgagtttcgagctcgctcattgacagccctagttagagcaagtttaataatataaccaactattgtttctaaatcatccatagtcaatttagtagccaattcatacacatatgtatcttggagtctgtgctccagctacagcaaatctgtagccaactactcttctgtctcctcttttatcttcttgctggtttatagtccgatattgtagtcatcttaggacgggaggtttttgtaaatcctatcttacaataaatttatcccccactaactccttaaacttaacatgcaaagatgccacatcatcattgacggagcgtggggctcctcaccgggagaccgagcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaaccccactcgccccctctctcctttttttttttggtgggcaaggtcctccttttatatctcaaggggatactacatgcaccacttctacctacttttcttctgggtggggacctactctatcttgaccaaaacttggcttgcaccttcgcctggaagctaaatcacaacttgtccttgagtgaggctcagcgccgtctctcgcctgacaccggggatctccctgttactccctcattaatgggcgaagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccacaacgtgtcagttcagcatgctacacgtctgcccttcttcatacaatgacttccttgcaatggttgcgatgaagcctggaatgtatctggccggggctgacgtgccaactccaggagttcccacgccggctccggctagggacgagtgcctggaggccctcatcattcagacgggacggggcgaggcgtgtgtcaggccgcctgttgccacctaacccgcgatctgac

SEQ ID NO: 33217 - DNA, 477 bp, Oryza sativa
ttccttactgcacatataacataatgttttgtgccatcaatcttgtcgcaaccaagacattcgttttaaataaaagattgacatgtttactgggggcatagggtgtgttttttcaaaatttgggcacatagcgcatttcagctattgccacttaatagtgctggattattctgtttacatatgtttcattgaagaatacttaatcaggttatcataaatcagagcctgttgacaatatacggaggttcgagtagattcatgaagcttactgtgtagaatgctggaattttcatggcattcaaatttgcctgcttgcatgttgtcagttttccttttggtttctgggatgaaaacatctggatgaagctatatttctgtaattgataggttgaaaaaagcaaaacattgtaactcttttattgttttgcgtctttttggaacttcttgttttatacaatattttgtattgatttgcca

SEQ ID NO: 33218 - DNA, 514 bp, Oryza sativa
gtgtatgataaggttgaaggaaaggggcttccggttttcttcatggcgcacagggattcgatggatttccttataccttatctttgtttacatgtactctccttgttgatctttgtttccatgtactctccttgttgttttctgcactgttcttgcactgttcatgatggtgaaccctctctgtctgtagttgattgttacgagtatatggtagcgatcagaccgtctcttcttctagtgtaaagaaaagagtaaaattcgtattattctgaatttaatcagactaggtgagttggtactttagtttggttctggcccttcatgctgattgcttgattgtgtcggctgctgctacaacttgcacaatttatattatcatgctgttctgaaccagtttgccaacttgtcccatgcatgagagatgagatgagccacaactatttgttaattttgtttcaggtacaactgttgtttggtgcttgtccagctaggacagccgagtgaagtgccagca

SEQ ID NO: 33219 - DNA, 1501 bp, Oryza sativa
tttttataattagcatttttattattgttagatgataaaacatgattaatactttatacgtgacttgtctttttaattttttcataatttttttaaataagatggacggttaaatattggacacgaaaaattagggttttttttttttttgacagagtacagtaggactatatgccagtggccagaccgccggtaagcacaccggcaaaaccactaacccgccgctgatccgaccacagtaatgaggaggaatctggtggctgacctgacggctagattaccggtggtactttagggaaatctgaacatcggaagcgccaccaaccgcgtccaagtacagtacagtagtatagccgtatagtagtagcacgtgatccatccccatccaacaagctaaaatcgtggtagaaactcgatttttatttttaaaaggtttcaagtttcaaatggttagaccagaacttcagttaaacggctgcttcaatagagtacagcattctgtagttgctttcaggtagtactagtagatagtagagtgctcaatagtggtggccgcgacacaatttttagggggtgtttagatggggctaaaactttttagcgcatgtcacatcggatgtttaggcgctaatttaaagtattaaacatagactaataaaaaaactaatttcataaatgagagctaatccgcgagacgatttttttaagcctaattaatctataattatcaaaagtttactgtagcatcacattgttaaaatcatggcgtaattagactcaaaagattcgtctcgcgaattagtccaagtttatggaatgggttttgtaattagtgtatgtttaatactctaaattagtgtccaaacatccgatgtgacatggagttggaataaggccctgtttgtttcagcttaagattattgtaatctaaattattaaatcagattactctaaactggattataataagctgacatagaataagctgcgagctgtttgtttctctggattattgaaggcatctaagggtagtgggtctttagccacccaataatctgaaaaaagctccttcagaggagattattagattatagtaatctggcttatagattataataatctatcgtaataatctacttatttatttcagcttactcttaataatccagattataataatcttaagctgaattaaacaggcctaattccctgaaaaacaaacagcccctaatagacgaattccgagtccggtgtgaccggcgtgtgcgtttgctgacctcgcgatctccgctaccaccaccagactccccaacaaacacgcacgcgcgcacacactgtcgcacctacttcatccccgaccccgctgcctaaaatccacctccccatcctgcaccaaaccaaacccccgcgacccacacccaaacccgccaccgattccgagcgcgccgcggcgagcgagcgggagagaggggggtcgcaagcgcagcttcctccccggcca

SEQ ID NO: 33220 - DNA, 163 bp, Oryza sativa
tcgtgaatagtaaccatgcacagttcatttcactgtttttactgttgctacagtgaaaactgtaaattactgtggcaacaaactcatttcactgtgtgtgcgcgcgcacctttctggaaccccgcccatgcaaaaaggtctccgtagtcaggttgagcggaaa

SEQ ID NO: 33221 - DNA, 1501 bp, Oryza sativa
agacaatgagatagctatttaataaatttttaagtaaaatcatacttaaaaaaaaatgattttgtttgggtgctagccgcgcaattgcgcgggccaccctgctagttttatcgaaacaattgttcttattccaagttcgtttccacataactttcctaattttattgattcaattgtttcagtgagcattggtccgcgtgacaggtgaacactgaacagcttcccttccctctagtcatcctgagccccaacaaatcctccccaccagcaagctgaatcaagttgattcgcgattctatattaattttctctgtatcgctgaccagcaggccctaattgtcagctcatgccatttactcctaatggtggaaaataactgctaaaccatccctagtttctattcagtcattgtttatatcttgagtcattggcatggggacacaactactaggggtggataacaattaacaagttggctttactcggctcagcttgttaaaacttgataggagaataagcttgctaggcttggccgtttagataactgaactgaaagtagagctcagttcagctcgttaaaaactcgagccaacttgttattatgataccgatactaattagtcacacaatcaaatctaatgcctattattatttagttgtgtataatataacatcttttagccctatatattatcttgtatacttatatatgtagttattgttcacactaaaacattataggtctaaatatttatttgtatagtttagggacctacctgtctgcctctgaacatagaaacattaggatttcttcagaaagataagtactccatccagtcaagaatatttgatgccagtgtcactaatcgcagcagcgcaggtgttaaatattcctgaccggaggtagtgcaaaattgatttaagatcatgcacagtgttttccctttttttttctttttaggatctaatatctttttaaaacttagatcgcttcaccaaactcctattagttcgtgatataccataatacacataaatatttagatttgtttgttgtttgctttctgggaactgtctactgttatttggttttctctgtaataactgtggacattcagggaacttttgaagattatccaaagtaggagtttgtgaccaacaccaccttacatatattgactctatattttacaaatgcattttgttctgtactccaaatgcgctattttcataaagccataagctaataaacttttacctatttctgcatcatactgccttaaatattgtccaattttaaccttttgtccataatgattactcaataattattttttaaaagtgactaatttagggatattagaacaaagcaaaaaagaaaatgactgtcacatgctctaacagtgaaattgtcataaaagagctaattgctctcatgatctaatgtgtgttttttcttagataatggtctgatgtgtttttgtcttctccatttgtcagt

SEQ ID NO: 33222 - DNA, 1501 bp, Oryza sativa
gaaaagaaaaccaaacaacctcggcacatccatgcttctctacgtcaccccatattctcccgaaacggctagatttggcgagtggaagtcgtctagtcgtcgccgcccctagtgcgccgtcgatgcaaacctccattggtgccatctttatccattttaggtaagctgacgtcacgcgccaccagttagcccattttcaaccatcgtcattcgttgtttagccggaactagccaaccatacacgaaccgacaagatcggcccccagcgccaacgggagccgccgccgtcctccgtcgcagcccctagggccgctggcgccgacgggagtcgccgccggccgctggcgtcgacgggagccgccgccgtcttgaaccaccgcagcctctagggccgttggcaccggcaggagccgccaccatcctaggcctctagcgctgcctggagcccctgccgtcctgggtggccggcgccgccgggagcccccgccgtcttgggcagccgccgcccctagggccaccgccaccactggggcaccgccgagcaccgccgcccccgagggcctccctcgccgacgtcttgccgctcccctccgcccttccgaccacctccagccgtccccaactcacacggctaggcacgggcccggctgcctcaggccgccaccgccgcacctccgcctcccacctccccaccaccgccgtcctagccgccgcacaaacgccggtcagctctggcagcggcagggctagatctggggcgctggggagaggaagagacgcgttactgcacagccctccaggtttaggtgggtcatcacatatgtgacagcccatcgataacgagtcgaagtttttcatcatggataacctcatctctaacgggctaagtttcagatgagacttaagggacatggcccatcacaggtaacgacttatctatcaaaatctgagtacatcggcaatgagatttctgagtattttaaagagtatattatggttacactttttggttcaaaatcttactatgggtgtgtttagttctttgggtgtaaagtttttaaagtatacggacacacatttgaagtattaaatgcagactaataacaaaacaaattacagattccacatgtaaactgcgagacgaatttattaagcctaattaatccatctttagccaatgtttactgtagcaacacattgtcaaatcatggtataattagactcaaaagattcgtctcgcaatttaaatgcaaactgtgcaattgattttgtccacatttaatgctccatgcatgtgtccaacatttgatatgatatttttggctaaaattttttgaatctaagcaaagcctatattatctaattaagttcaatttgttcctatgaactaataatagattgtactactttctgaccaggccattcgagggaaaagaaagaaggtgaaaaaggtagcatcagaatcaacgtcactttattagcctttttctgtcgtaacgca

SEQ ID NO: 33223 - DNA, 1501 bp, Oryza sativa
catgtaagccactcctagcaatatcctcatgtgggtcatatgggctaaggcacccaatgaaaagtactccaaccagccctaccaaatctgaggcaacaaggtagagataatctagcccacaacggtcctatcctagcccacgaagccacatgtatgtttttcctcccctacccctagctattttctcagcccatccactgatcatccacttctcccctctttttttcttcgccgcccgtctctctctcacctacctctcgctcgtcgctctccctctgcccgtcgccatcgctgacttccccacctcgtgccgctgccgtccaccactccggcgatcagatctctccgctttgcgccgtctccagttccattccactacgatgctgctaactccgccccaccacggcgccgtcgactctaccccaccgctcctgccgccggacggctccgcccaaccgcgacgcctccatatccgccccatcgcgcccgccgccagctctgaccaccgcgactcccgcgcccacctccggctccgaccaccgcaatgccttcgattctgccccaccgcgcccactgctaactccgaccgccatgacacctctggttctaccttgcatccgtcgcctgctccgcctcaccatgccgaggtgagaggggcaagaagggaaaatatagagaaaggaggtgaggaacggggcaccactcgagccgtgtctcaaaagagtagtcgaggagccagaggggcgcgttcccctgttggggtcacgcgttccttcaggagcatgactcatagacggaacggtgacgctgtgagcgaagctactagctggagttacccattgcatatgctctcacaacgtagaggtgcggtcacagagacagtcacagccgacaatccgacatgcacaacgaggcagattcttgagaaaaaataatgagtacagtaagaagagagaagggcagaggaaaatgcggcatcagaccgttactcaatcgcagcaaatcaatccaccatccatccacgtcgcgacgcgtccaactccatccaactcgactcgacgccgacgccgacgacgaggaaagcaacaaccaaaagcttgccgttaaaaaactccaaagttaatccccaaaaaaagaaggaaaaaaaaaacacccgacccgtcggcttccaggcagccactaatcccaaacgccttttttttttcttttcttttttttttcgcgtcgcctttccttctcccattcctcctctctccagagactcgccgtcgccgcagccattcccatttttgcccactcctcctcctcctctccagtaaaccctagcccacccaacctccaatccccccccaaccagcgcccgaatcgcagccccgcgaggccccaatcgagctagggttcaccgatttcgggggccgagccagcgaaggctctcagttttcgctgcgatttgtggggtgaaattttcggggggattttgatttctttctctcacggtggg

SEQ ID NO: 33224 - DNA, 296 bp, Oryza sativa
gagctaaacaaattattaccagtataacatccataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacattacccctcgcataacacaacccaccacagtgcacctttcctggatcataatcaccccctcaaaaaccagaggca

SEQ ID NO: 33225 - DNA, 1048 bp, Oryza sativa
attttttttgaaccaacggggttggtcccagagcgctcccccaccctcaccctagcagtagcaggagtgcaggacagccaatgtcaccacctacggccatccgctccgggctccggccgtagcccgcagcccgcacggcaacgcgcgctcgcgtcgatttgacctttaccggtgcctgtctgtccttgcctagccttgatgtgttccacaggggacccggccttctgcattcttgcatgtgccgccgctcttgcagatctgctcaacttcttggaattcttctcctcaatcaagtgccacttgatctcttgatctcgaacggagatgagtttttgttccttgagtgaaaagatgtttggtttgctcctaaagtttaccaaagattaccacatcttaggttagtcaagtttgaccaagttagcctattatttggtttatagccacacttgtggcaagattacttctcatctatttgggtcccacatgtcatcaactcatcaaagtgtggtacaatttaattttactagctaagttgtggctcgcaagcgtggcataaaaagtacggtgaattgtgacaaacttagtatagcatccacttgtgcatgtaatttcaaaatcaattattttttttaaaaaataatacaataatcatattatatgattgttactacctccatccagaatataacaattcaaatattttctatatatagtatttctatacatctaaagtttatacacctaaaattacccgattcaaatttgaatttgaattcaaatttgaatttgaattcaaatttgaatttgaattcaaattttttatacataaatttttctaactttttattcttttaaaaaaaatttggtgtactgtaataggaagagaagaaagggaggaggaagaagaaaaaggagcgggggcagggggggtggaccgatcgctgggcgatcgccctggcgatcgatcgtccattaggcccccttggcatgctagtcatcaaattccatctctcttcttccttctctaccctactctctctctccccca

SEQ ID NO: 33226 - DNA, 352 bp, Oryza sativa
tgcaccccgtgttggttgtaccccacgaaaggggtcgggccgccccgaccccctccatgcacggccacgcgtgcatggtttgggcgggcgtgtccaacgccaacccactgcatttattagaggagttggcgcgacaggtcgcattaaatgcggcatgtaggcgcactactcgcccgcccaaagtcggaatgattgatgtgatcgcgggcagagcgcctcgcgcgtgcgcctactgctgtcagggagcatggcctgcgccatgctccgtctaaattgccattaatgatgggctttttgtcttaagtttggatccagaccaaatcccctcgtaccggtccattcaaagtggtca

SEQ ID NO: 33227 - DNA, 449 bp, Oryza sativa
tccggcaactcaggaaacggaagaaaccaatgactccatcccaatgcctaattcagcagaaaccatggctagtaacaataagcaagatcgtattgtgctagaaccaaatgtggttgttgcacatttgtcatggcaagttttagcctttaatttgggccctagtcgtccgaagatcctggttccgccactgctcgaacgcacaggcaatgcacaaccaagatgcaaaactcaaaccaagacgaaactagaactaaaaccagcacttgacacaacagtggaccaaaactcaataaagcaaaattgaataacaattgcaaggctcaaaactaatgtttggtgaaggaaaaagtggtgtggcaatttgtagataatgggtagggaaaataaatatataaaactaaaatcctcaccaggcaaccgatactctgataccatctgataccaactga

SEQ ID NO: 33228 - DNA, 318 bp, Oryza sativa
gctactcgtgaaaaaaaaaattaatacctataccttgtgatttttccgattttttcatatattctggcccagccccactcgtatgcaggccggccctacactcggccttccaaaaaaaacgccttctccaccgaacagcccacgaaatagcaaacgccgaagcccattagcccactaaccagtgaaaaccctagcctgcagtgccgagtgccgactgaatccgaatcatgctctctctctctttgcctctctccgtctcttggtctctcttcgatctctccctacaggaggcgcggcgacgctcgatagggcggcgga

SEQ ID NO: 33229 - DNA, 1501 bp, Oryza sativa
ttattattgattcgatattatcttgatgtcagcatcttcctcaaattgccatatatgtgatacataacttgttatggggattattttacaggttggcatttcgtcaggtgctgccacagttgctgctattaacgtcgctaaaagacctgaaaatgctggaaaattgattgcggtgagagcttttatctattaaaagatgttgcagcttagtgaagtttgttcatttgtatcacaatgatcttattataatcaactcagatggttaataaataatgaatttgcaggttattttccccagctttggagaaagatatatctctagcattttattccgtccgatatatgactcggtccgaagaatgaggaagagataactaacttctgccactccaggaagaagaaggttgccagttcttaaacctaacatacttccacggcataacagattttgaagggtgaggttccaggtagattacaacgagtagtgcctgaaattttgaaacgccataggcactggtcagcctcacagaaggttgaaattgcgcacggttgctgacgagtagtttgcaagcctgcaatttggttccagggaatcgtgtccaaaactattcataactgtaaatcatctgcaccaaagcgtctggaaccagaccacatccacgatggaatatgtagaattagatattgcagctagcatagtaggatctttcttcaatagtttaggcttggtaatggaacagatctgtaatgtgatataccttttgagctgatcttgttgacttattgaacgaaactctacacagatttactacctgtcttaaaatatactccctccgtcctaaaaaaaggcaaaccctgggtttccgtgtctaactttgactgtccgtgttatatgaaatttttttataactcatatttctattgttgttagatgataaaacatgattaatattctatgcgtgacttgtctttttaatttttttcataattttttcaaataagatgacggttaaacgttgggcatgtaaaccaaggtttatctttttttaggatggagggagtacagagtaacaacttttaagtacaaatctgactattattttatagaggatatcaatagtttcttcaaattgtgagttaatctgggccaatatggcaaatatcaggtttcattgtctgcactatgctctagccaaataatctatgtggactctgggagtctggagtcgaccgtccaaactccaaactcaaagccgtccgtaaagcaacaaaaggctcagggcaagtagtataatgtacatatgttgcctctaagagtgccacattagattgaatgatgaggtggaggagagaagtgaggagagagaagataagccacctctaaatcaagaggtaacctctacacaaatttcaaaaagaatgtgagagtattatagatattggtgtttgtgtacgggtgatacgttgtatgagttgtctcttaattcatgagtgaataaaa

SEQ ID NO: 33230 - DNA, 451 bp, Oryza sativa
ccatcatttcgtggaccacttcaacagcaactggtatgttttatcaatgattcaaggttctttgctctgcaagctttcctgatttgttctacaacagtttgattttgattgagaacaagcatatacattttttctgttacttcccaacttatgacagatagttttatcctttttattcctggtatctagtttaccatgatattgttggctcattgctgaatggacaatttatgaaatttggaacctgttagaaagatgatgctagactggatttttttttatctgtatggattgctgagattattaatgcacacagacagaatggtcttgtaattttgcatgtaagccttttagttattttgcttgttaatcttgttatagtctgtattcacctacagtgagtacttttttctacaatctattggtttgggactttgggcacaaatgatga

SEQ ID NO: 33231 - DNA, 944 bp, Oryza sativa
tgcttctaggcgcagctcctgctcatcgttagcatgcattatggcatcatgattgattcactctttctcatagaaaaaaaagatggacatcagcactaaatcactttgattgaatcgaagcaaacagatcctcaaaagataatccaaaaccagaaacaaaaatgcctatactgattattagaaatcttatacgaaacctgatcgagtaccaggacctagtatcaaatggatgttggctagtgataaagcatacttgttaataatttacagaaacaaccgaaaatttcctcgcattcatttaatttgatcaaacaaataaatcaaacattgatcttatagcaaagtgaaaggaataagattattctctctaaaagactgtctcccaatgcagcctgtcaaaaacaatgaaaaaacaaaacagataagaactgaccatgctaagttctacccaaaaaacaaaaaacttgatcaaaatattcatccacctaaatagcataagtgcattatgcaacttctaagcaatcaattttctcaaatacaagaaacatgagtgctattttagaacattaattactaacgaaaataattgcacctattccattcgaagccaaatagcattgcatctagagtacggactttaactttttaagaaaactgatcgatttaccaatataattctgcatcaaaagggcaaataaatacacatagcaacgagtgttttactgaaataaaagaaccatagcacgccttgtgtaaaactttgaagtctttttaaagttgtgttgcaacataaagagtgatcagtgaaacaagacttgttggtgatcgcatctaggttctgaacatttctgtgctctctgaattagtttgaacagttatgaacttgtccatttatctgatgcttgaacggttccaaaatccatcacgatctttgcttgtctaga

SEQ ID NO: 33232 - DNA, 800 bp, Oryza sativa
tttgtcttatcttatgtaatctacgcaccaatgatttggtggcatcgcagaaagccagttcaagctaaatgtgtgtgtaccatattaattcctctatgcttttacaatgactaaagtttatgttcacgaactgcaggaaaccaaacaattgagaggcttcaacaaatattttcttcatcaagccaaacatatggtggcttgacactggatttacattgtaatcgatttggtccaactgctttatttcaggtctttttactatccctaaacttgtttatcaaagtgaaactacaagttatttctgcttttgaaagctcaaaaaaattgaacattaaaatggactggatcctcttctacaataaaaaggaaaacttgactcttggggagagatgtcccataatgcttttaacaaggccgagaaaggcccgaacgacacgcagtccttacgtctactagtgttcctggaagaatttcagccgaaaaccaatttaacttgtgatatctctctttagtcttactgtgtgagaaatttagatcactagaagctatactctattacttactttagagtttagactcaacgggaatgtgctataacaagtgctggttgattttctgcattgagattggatgtccctcttagtcgcaaatctcaatgatcctgttaaaactaactgaaaccatttggatggttctaattccatactctgatgaaactcgagggttgaccctttaccagaacaaattattctatcgttgcctatcggaccaaaataagctgtcttgctttcaggcacacg

SEQ ID NO: 33233 - DNA, 1501 bp, Oryza sativa
aaatggcagactaggagataaatttaaatctctagcatcaagtcgtcaacacactttagaggctatctttgagacacagtgagactttcactttccaagtaagcttctcaaatgaatttgtgatagaatacgtcctctgttatttatacccacttagaaactaatcataaatatgagtaatctataaaaattgttgatgtcgattctaattatttgcttcattttgttcatgacttcaaggctataccatcattatcggtaaatagctgcctggttatttgcatttgcaaactgaaattcgctaaccacgcaggcatcctcaactgcaagatgaaaaaggctttggcgttaatggaacattctcacaccaacagaggtcattggagtgctggcctaagcaacagctcgaagggattaacaaaggtagcagatgtactccgtgacagcctctggctttggttatgtgcgacttgaggcgaaagctggagattcgtagaccagttttggtaggagatcaaagagtagctgtggtagagtggagataatgtgccagtgatgaaaaatcctgttcactgaaattttactctaggacaccatatgatcccaacataggattcagatttttgtagcctgtagactatttactgtctgtaattcaactgctgagaaaagtattgcctaatgaacttattactagcacggtgtgtacagcttacattgtgttccacataaccacatttcagtgtctatggttttgttgccaatctgaatgtcattacagatagatagagagttcacttcagtactggaaatcactctgaacctgataccacctctacctgccttccctagctaaatgtgagggagttgagctgtccttttgcacagaatgagctctgtgccagtgactgttcaaagcatttgtaggaaaagcaacgatgcagacagcttcgttggcagaagttcgcacaaagcatcatagggctcttaggtaaagcatcggtgctcatagcactgatgcgtcttgtatctgaatgcacttcagcagcttgtggtgatctttatttctaatcagaagcaaagttagacagccatgatgagctgcccctatgactatctgggcatctcttctgattattgataaatgttcatgtaaaatgcaggtattgtacagaacattgttgaagaaaaactccaacaactcacccagttaatccagtcatcagataggagcaagatcaagcatcatgtcaagatcagtcaatcaagtcatctaattagaacccaaatcacattagaaaaaagatcagaatcgtgtggtaaaccagatcttcagactaacaaatcctcacacactaacagaacaaaaagtttctgcaaacagaaacagaatgtcagtaaggacaagaggacagaaacaaatctttatctgcttttttctcccttattaacctttcacttttttctgtcttgttagagtgcaccgtttttgtgcgaacat

SEQ ID NO: 33234 - DNA, 655 bp, Oryza sativa
agatgcgcgaaactagcttgtaacaaacatgtctcatgtgtctgagatgggggtgctagcgcgcgcatacgcgccagcgatttagctggcgcgcgtggtagctagccctctccccgtgtcttttttttcttttactgtttgcacatttttttattttaggcgtgtttttcttttttttgccgtttgttttcgatttttttttcaatctttcacacacctctataaaatagaattgaaagtttttaattttgacttgaaagttttcaaattttgggttgaaagattttgaaactttcaattcaaaatttgaaaagtttcaactctaatttgaaaactttctacctgaatttgaaaacttttgacccgaatttgaaaactttcaactagaaatttgaaaactttagctcaaaccttgaaaacttttaacttaaatatgaaaacttccaaacttgaatttgaaagatttctaactcaaatttcaaaaccgtcacctcgaaattttaactttcaaaacattttttaaaaacttcaactcaaattttgaaaatgttcatcatatttctgaaacttttcaacttaactatttgtatattattttgataataaaatctataattaaattaatttatacgcttagcactattattagtgctaa

SEQ ID NO: 33235 - DNA, 1501 bp, Oryza sativa
tatcttcatagtctttaataatatactatcctatttggagaaccgacaaatccttatctggtgatgtggtacacaaaacaaatactagtagtcgatttattttgatcaccaaatagtgtacgactgaggcattttacgcagtaatgaagttggcttcatcatgtggttattgaaaacactaataacattgttatattttatatttataaaattgcatgtggctttaaacagagatgaaagataatagtaataagcaaataggagtaccataattttatttacacccgaaaatcggccgctatttacacctctgatgaaacacaagttcccattaattcatctctgtttggacagagccccggaattacactgacgaaccctagttaatttactgtggtaataataatatttccagagagcaactctaacctggtgcttggggaggtcgaccaggtttactacatctgcaagtctcttctgcagcagggcttcaggccgcagcaattcatcccatccactgcaaaatgcaccacctccttggctacatgtttccgagccattccatcacctctagggccagaagcccaagcagaatacagtgactggatatcctcttccgacaacccgttccgactgagatcgagcaccttcagttgctttgcagaaatgatggcatcagcgagttcttggatggcatgacagccagaagaggagtttctctggcatgaacttgcacagctcccgtctgggccggtcgctgcacgggtgtcctcgtggactgcctcttcgtcttcgctatccggcacctccatcttatcagggtctatgtgatcgttcgcttcagcattggtacgttggttttggtcagtacctggtgatacatcctgcgcgtcttcatcgtactgcaatgttctctgtagtgccaggtttgtgttctcagcaacgcgtagttcctccaattggtcatttcctgaaagtagcaggagactattgaggttgatgcataagcttccatacttgttggtttttatgtagtagttgttcctcacctgctagtgcttgaataatgcccacggtgccagcaagcccaagattgcatctatcaagggtgagagatctgagactgcattggggattcgaaagcaatgccctaatagcatcacattcctgcgccgtatacagcataatttagtcgaccaagtttaccagaatatgtataagtgtatcaaggcattcgagaataggaaggaaacctctagggtaaaagaattgcctccaaggttcaagtcaacgatattaatttgagaaagatttgtacagagttgcgagaaatcaggagttgtaagcccacagtttgataaatccaatctcagcaattcttgtgatgcacaagagagtgcctcagtaagcttagttgcccctccctacaaaaaaaaaaatcttcacagataagaagaatgttatttgtataatctgaaaatactaaccatgcgtgggaagc

SEQ ID NO: 33236 - DNA, 1501 bp, Oryza sativa
ctccgaagcggacgactgtggcggggctgctcctccggctatcgcgcgcgtggagtgcgacgtgcacgcgtgtcacctggtgggctgcctcggtgcgcggctgcgcttggaggcgatcgtctcggccgatgatagaccaatgcataaacacagtagatcaatctgattagtaaaaaaaaattgatctagcaaaaatacttacccggatcaacggaacgagcaaactcgtgctgataacgtgttgaataactagtggcctattcgctgatccggagtagaagacggcgatcccatgcacacaatcatatagtagatgaacacggatatagagaggggcatcacagctttattgttttaaccatatgcggatacatcaaccaacctctcaagccctctctctcagtatatatatatatatataataggaagagttctattaggatacgtttctatatatttggtatgagcccatatttatctctggcaggagataatagtttcataacaattatatgtatttgtctccttaactttttttttcagaaattaaatttgtacagataatttgcatgtatgaaccacaagcttccattataaggaaacgttcagagctcagagtagtagctgaaactgaaacatttaaggctgtgttcgcatgcaccttttcccatccccttcccctcgttttccgcgtgcacgctgtattttttgtaaaaagtttctatacaaaagttgcttaaaaaaatcaaattaatccctttttgaaaaaaaatagctaatacttaattaatcacgcgttaatggactgctccgttttccgtgcgcagaagttgggttcccatctcccccatccgaactcagcctaagttatcaggttaacaaaaaaatgaaggtcaatctgtgtacaacgaggaacttgtggaccgacttgaaagctgtgggtttgatccaatttcttctttataatacagctacagagagttcggtgccaagatttttacaggagttcctcatagatttgcctgtagataaaacaccagcgacccgttggctaaatcgctaaacacaaggtcttgctttcatgctcgacaggtttcttcagaacaaattcctggtccatgtaaaatttgcattaacaaccttgcaggctgaataagtaatgttatccatctgtttagttttttttttccacatattttcatatttgtggtccacagtacagataattttattttgaattctatttaagattaaatttattcatcaaaaacttctattctaaaacaagcctgtaaagtggttctcgtaaatattctttcatgcattgcagattgagtacatcattcttcactaatctactagacgcacgaaactagctcgtaacaaacacgtctcatgtgtctgaaatggcgtcctaacatttaccgtaatataatttaatgattcatcaggtatgcaatcagcatcacaaaataatttgtatcgcttaattaattacgat

SEQ ID NO: 33237 - DNA, 168 bp, Oryza sativa
gcatatcactagcatccagtcaaaacttggcaatgaggttaaaaattttgcgtcttacggcgacattgctagcaataagggcatatcaaaacattaatgtatctcctctgctaccatatcttaatgtctagttgggtgtttcttataagattatttttccttttaaga

SEQ ID NO: 33238 - DNA, 1501 bp, Oryza sativa
ggtaagtgggctgctgaaatcagagatcctcgcaagggtgttcgtgtctggcttggcactttcaacagtgctgaagaagctgcaagagcttatgatgctgaagcacgcaggattcgtggcaagaaggccaaggtgaattttccagaggctccaacaactgctcagaagcgtcgtgctggctccaccactgctaaagcacccaagtcaagtgtggaacagaagcctactgtcaaaccagcattcaacaatcttgccaatgcaaatgcgtttgtctacccatctgctaacttcacttcaaacaagccgtttgttcagcctgataacatgccatttgttcctgcaatgaactctgctgctcctattgaggaccctatcatcaactctgaccagggaagcaactcatttggctgctctgactttggctgggagaatgataccaagacaccagatattacatcaattgctcccatttcaaccatagctgaagtcgatgaatctgcattcattaagagcagtaccaacccaatggtccctcctgttatggagaacagtgctgttgatctgcctgatttagaaccctacatgaggttccttctggatgatggtgctggtgactcaattgatagccttctcaacctggatggatcacaggatgttgtcagcaacatggacctctggagctttgatgacatgcccgttagcgatttctattgaggaattcgaagtcttctagtcggagcatgtacacagggaaaaaaaaggtaaggattatcaatttgattttttctctctgaatatgcacgattttttacattgctctaattttgcttgtgtttttcaggaataaatactattggagattgggaggcacctgcatggcaccttgggggtagcatatcgttatgtttagcttagatgcaaaaggctgcatcctgaaactctttggtgattggacctgttccctatccgctgtctatgtatggcagccatctatgagactcaagaactgcttttttttttccgttctagttttctgtcgttgctacctgtatatggctatgaacatcgtgaatccatggccattatgttttaatctatgttgttgactgctctttctttcggtctttgctgtgctgcgctatgttggtgataactagctaccatattgattttctgtacataattcatttgttgaatccgaaattaaatagtgcattgactatatatttatatattatatcttgttagattgcagccttgcagggttgttgctcttgctactgggcgcgtgccatccagaatcaggatttctggaaagatgcttcacttcctcttttcttgatgtgaataggcagtatgaccggccaggtataagctttgtgataacaagaggggtatttggcacatgttgtcactttttcttctcgagatatttttgttaagactatgactaattcagagcgaagacctacgagcttcgtgactgttagatattttttaa

SEQ ID NO: 33239 - DNA, 940 bp, Oryza sativa
tatgtcacccaatctgaataggtgttgggtagtactaaagtttgcaatattttggcttggtttattgaggaatttttttttgttccgattaggatttgatcagtggaaaaatgccatgggagcaagcgaactttatggattagattaaagataattttagtgatactgtcagtattattatcaagaaatcaaacagtgaaaacagtgtattcatgtcacagcatctcaactatacttgcactgtgtgtctgcgtacttgcaaaaatgaatactcttagcccattatcctcttaatgatagactgcaaataagttttgtttacatctttttatacatgcaggtcttctcttaaaattgtagtcattatcaaaatataatcatctcataactatagtagcaaatgcacgtcacctgcatttgtacgagcaaaagaacaaacaaaatgcctattgttaaaataatgccagatatgaatgataggaaagtatcgaaatttattaagagagtgataaagctcgaacctaggccgactaatccacacctttagctattatggtgttaaaaaaaagccactcactggtatgtgcagacgtgtagtgtgtttgcttttttgttttccacgcaatcgggaaaaaaaaagaaaaacaaggtttgttttgtatgtaaccgatataaaaaaaaaagataaacataaaaaattgcaatacggtggttgtgcatgttagatttaattgggtaattaatccatttaaatcaattaaatcaaataaattctaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatgg

SEQ ID NO: 33240 - DNA, 1130 bp, Oryza sativa
gttacaaaataaattcatttttagagtaattattgcatcggagtttgtgaaaagtagggaataatgatattgagagtatagataaagtgatgaataattacattggggatataataaagtaggggtattctagtcgttttcttttatattgatatgtgtgagatgggtgaaaaatgaactttttttgggacggagctagtaacaagttttggtttgatgtgcttaatttggagctggtggcgttgagagttaagagacaatgttgttgcggcttaactgaacatatcaggaaatcaactaaagtttcattttcttacaaggctagagaaacccattacttacctggaaacagaaaacaattgttagtatatgagaacaaactagtggaattaatgaacagtttaatattgggtgtatatgccctggtaggtgcatgccgtatcatgcatcacggattgtatggctatctattgttagctagtattgagtgccgatgtattcaagtgtgatctgaccaaccttttttaatttaaaaacagatgacccataagattgcttctgcttcctatatttgggaaagttaatttttttcctttgccggggtatagtccgtggtcctggacaaaagattctataacaattaacaaattaaacccgcttcagcggctatatgcaatgccaatgttgaatattggtcaattggattcaaacatatacagatatatattactgaggaaggagcgcacatgcattataaacctactatagcttagcttggatgctagcagtgacaggagtatgatatatatcaattcggtaattgttaattagtaacgtactccacttcttattacgtgtgaacttaatgttactcaaaagagctgcaaggtgcaatccccttcttgtcaagccatctaaattcgtatgtagtttcttaaaactacattatatatttcgacctattaattatagccacagcatcatgatttttatatactgtgatattattatagtttcgaaccataataataccatatgcatatatgtcatctacagtatcggtgtagaatttgcacattttagtatcaagcagaataatctctgatataaaaagtatcgcttcgtgcagt

SEQ ID NO: 33241 - DNA, 820 bp, Oryza sativa
aatgatggctcatctccgggtcctcgctcatcattccctcctctcccctttttcattttcttccccctcctcttttaccaggattattattacttactgcacccccttcctttaataccaccctcaggtgatcatgatcccctcaccacccaattgaatgccgcacaattgtggcttctccttacactcctctctctctcacacacacacacctccaatttttactgcatgccgtatgactatgacatatccctctcatgtataccttcttttccctccttttccccttggcctatatcacacgcttgttattgatttcaaaagcatcttgatgagtatgatagtgtgattgttacaagtaacagaatctgtgaagaaaaatcctacttgcaatcacaatcctactagcaacttccagcgttcaaaatttgttctagaatatagcaacttttttatcaactttttcatctcaacctatcacaatcacctgccatttaatttcttcacgtactccctcatctttaattaattagaaccatctctgtttaatttcaccttcttagttcctatgaaaaactctaaaaatacttatatttagtaacggagggagtagtagtagtagtatttgacagcaaaaataggattggagctgagaatgggagaggaagaaaaagagaagcgggcaatgatgttggacagcttggagtcctggactctctaggctgcatatataagatagcaatctttgcagctaatacagctccctggcctaaacacaaggcttggccctagcttgcacagggggatccttgtggagaca

SEQ ID NO: 33242 - DNA, 1501 bp, Oryza sativa
gacttgagacagatgtgaggtctcacaggtgtagtatgcgtgttagcagaacggtcaaattgtcaggactcaggactacgtggatgcgtgcggtgctgctccgacggcaagagcaaagcgggcatcgtgtaggcatcgggctgtttctgccatctcatacagtcatactccatctcacaactgaaaatcagcccagaatttttcagaaatatcatggtgtgaaaacagcctgctaatgaatcaaccacgaggaaaatggagccaacatggtaaaacacaatcatgacaggcacaatccaaaatagagagaaaaaacgtggttcaccagaaattactattacctccgttgttccgccctaaaatataacaacatttagctatgtgtttaaatttatagctaaaaatacttatattttaggacggagggagcagtaagcagccgatcaaacatagtactagtagaaagcatactctttctcggtgttttgaaatttgaactggtactcgagaaaagcaaacctgaaccgtgtgcctcatgcctcatgcctgcactgggctatcgataaatgggccgtaagacaagtctatgggccactgtttaggcccatatcttcgttggagaaagcccacaagcggcaggagttggggaaacctgagccgtaaaccctctctcctcctccggtctccttcctccccttcacctccgcggcgcgccgtcggtcgccgctcgccgccgccttctggttcttctccggtctatttccccgcgggattcgtcgcggacactccggttggttggtgtatctgtatgtgattcgtcccacgctgctccccgtcgcctcccctaagacgaatcgaagctgacattttctggtgtttttttttccatgattgttggctgcaagaagtcggttcgagttgccaaaatctgattgttctccggaggtgaaggtttactaggcaatcatggatggtacgcacgcgctggctctgttgcccattcccatttcgttaagctttgtttattttgtgtcagttggggaagtaaatcttaacaaaacttggtcatcctctcttgcccaaaccgcctaaaaagtttggaggatcaaattgtgttttagcacataggttgtgcagttggttgttaatgcaagcttagtggcgattgtagttgcctgggcttgagttaattttgaagttcgtaatggcaactgtgaggaaataactctcttttttttctctcgatcataaaaaactgatgacttttgctgatcatgcaagaaccagacctatgctatcagcaattcagcattaataaaccactgtggcacagtcaggaactaactctctagtcagtatcatgcagtataaccagcatgccagagaacctgatcttactttccaagttcgtgcatttcaagtgtaacttctattcgtggccctgtgcaaatgatggtagtttttcatacatatttttcaacagtcgataagcaggaaacga

SEQ ID NO: 33243 - DNA, 1326 bp, Oryza sativa
acttgtgacgcaaccctaaattagtgttacgtcggtaatgatttttttcaatagttgagtagttttcattttgttctgttctctaaaaacaatggatactacctccgtctcattataagtgcaaccgtgagtttccgtgttcaactttcatggtccgtcttatttgaaatttttttataattaatatttttatttttatgagataataaaatatgggtagtactttatacgtggcttatgtttttaattttttaaaaaaattaaattagacggacgattaaagttaagtaaaaaattatggttagtagtaaccaataaaacgccattcttcttgttttctttccatgggcccatatgtcagtttgcctaaggtgttttgaaattttaagcttgcgaattcaggtgactagctagaaaagcaagcatggcttgtagtacttgttcggtactaccaactgcaagttgatactagtacagtatgttattaaattattatagggcatgttcactttgataaaaaaaaacctattgcacttgccaaaattttagtagtattttttatatagttactaaaatttagcagcaaactaaatgtagataattttttaacaactttaccaaaacttggtaaggttaaaaatgacatcaaaattaacaaggctcatagtatgtagactggtaatttttttagacgaatccaaactagtacagtacagtattatttgtttactaatgtgtgcgcaaatcacaatcgaagcagtagtatattggttgaactgtgcacgacctcgatcgtcacaatcctctggattttcttctgccgcctgaagatgtaaccactcccatgttggcatataccactccgtaccaaaatccaaaataagtgtagccatagatatcagtgttcaacgtttgaccgtccatcttatttaaaaaatttatgaaaaatttaaaaatatttagtcacacataaagtactattcacgttttatcttctaatagcaataaaaatactaatcatacaaatttttaaaataagatgaacggtcaaacgttgaacgtgaatagtgtaaaactgtacttattttggtacagagggagtattatcaacgattttttagcatttcaaaacggacgctccgtggtactaccggactagccacaagttgagatcgcgtttgatctttcaaaaaagagatcatgttcgaaaagttaaacaagagcagtagcatgcacgtcatctcttggagagaaacaaggcgaaagctagcgtagcgtggctcgtataaagtccaagcgaactttaaattttctcatcaaacaagt

SEQ ID NO: 33244 - DNA, 426 bp, Oryza sativa
gtacatgggcaggggggcagaaagttagatgtgcgtgggcataatgaatgggctttggcaaaaaggcagaacagggccggtcaatgtggcgcatcaattcgccccatggaaaacttttttctcccctcctcccggccaaccataccagctagcacaagaaatccagacacgttggccgtgtcagggggtggtgaaaaattatcatggagcttgcagactcttgagcacccataccccccataaccagcaaaattttcctgcatatacttgcatatgtagctggccaaattccatgctgtgccatgcttgctcacatggtgaaagtgaagagtaggtagcagctatgtagtactactgtgtacactcttgggttgtgttgtgtacgcacgcataatgtgcagtgtagtagcactgtggtaacataga

SEQ ID NO: 33245 - DNA, 1501 bp, Oryza sativa
cccttttccttctctcgcatcattttttgctatcctcataaatcacatggcttcccctaaagacaaaaggattatcaaacgtggtggccactagtgttccatcaagggagcatcacaagccaaacactaccaccgtttgtctcccgttggccagggtcattgtgcgggacagagcgagacagctctacctaattacctaaagcttgttaagatttcaataggctgccgttgtatatgaacccttcaacaagtttagaaacttttgagtgagagagcttgtgcaatgcatgttccttcagctgcaccaactttgacttgcctctcttgaagctctaatctcacctaccttcgctagaaaactgaaaactgaggttagcatcgaactctgggtgcggcaggttaatcacaggatctaatctgatggttcgctcctaacacattctctgttaggttggctcctaatcgtattgtattaccttgtactgttggttgggattctgataccgattgctgagcatagcgaatcattcattaaaagaaaaaaaggaacatattcgttcaaatctcgaaggactaaacattcacaagtattatatgtagccttcactccagatctcacatgacctcgaaaactttgagaaattaaaaattacaatggaggctgatgaggagatggcatacgcatttgatttgagtggagtaccatttcaaatatcagagtatgttgtgacgacaagcgcggatgataatcaacgaaccaagccacatatagtggacgatgctttacaatccaccttgtgacctcaacaacccaaaacacgccaagcataaaataatatttacatatcaaacggaatgttcccacaatggtacatttttcgaaagaacaaaaattatatatccatatgaatctacctctactttcttttcaaaaattgagaaaaacgcctatctacttgctcctacaagaaagatgggaacaaataaccagaatgttatactttcctaagagggctatgggatgatgtggacatatatcacaaggcgaatgtctgaagtttgctgtgccatctatctcttctcactcctaattccctactcaaatcaccaattcccgtctcatgaccacttggaaaagacaagtttggccttcaaagtagccaacgcgtaccgcgtacatgacacaagcatcgggtaattttaataccaaaaggtgtctccgtggttaacccactgcacgaaatgctcaggtaaattctgagtatagatatcagcatcttgattttcctgaaaagtttgaaatttcgcaattggttatgttattagcacaatgatattgcatatttgcatacatgatctctaccctaccactataaattctcacacaattaatctccagaattggtctgaacaaatttcaacaaaatcaaagaacagaatttagcggaatcgaactgttgggaacatatgctcaccatggtctcagaatttatgccactta

SEQ ID NO: 33246 - DNA, 1501 bp, Oryza sativa
gcccggcgtcgccatcccacggccagtggcgccgccgcagccgacgtgtccaaatcgcgcagttcttcttcttccgccttcctattttactagtacctccttggaaactggaagctggagcgcatccgttcctcgaatccctccggctgcgcctccactccgccgcctgctacgattccgtcgtcgtctccgttccgcggcaatccgaggtacgcgacgacgccatcaccaacctagccgagcttttttttttctttctttttttttctctgtgtgttttggggattcgcggcgcgggggagagaggggatttcccgagggtaggagacgatcgggacgacattcgcgaggattccgggtagctcggccggattgcggccgctgggggaggcggtggcgcggattcacgatcaggagcctctcgtgctccgcggcggtggcgtccatgcgcatttgcccgcggcgtgtgacacctgccaacgcttacgagttacgcgtcggtttcgcttagcgagagacgctgtgaacagaaggccagaaacaaagtgtgaggccagtaatagtatagcagcaaggagcctgtgaggaggtagcaatgcagcatatcatgatcaattattgatcatcatccctgccccaacgtacagggcatgggtgcgagtgaggtgcggagttgggggccgttgggccatttgtctccgaggtccggtccgtccggagattccatgaagaatcaacggttctgttttgtcaatcatgttggaaagatagtactggtatgagtattgttttcctcttggagtcattgattaggacctcagattccttggttgtcatcatcagaggctcagagtggagtagtggaccatggtgcacagtgagagactgtgagtctccacctatagacaaagggagatgtttagttcctctttctcgttacactattgcttttttattatttgattgatacttggcacatgacaacatgagtgtttaaacgaggggttccgtttaacaatggaacagttcgagagctcatctacttgatatttctttatctttttttaagaaacaaaaagaaactatttcccttcatatttaggtcatgttgatcaaacttcaaattaaatgtttggaaaataagataatttcagcaatagagtgtagtcttgacaagctggagaatttgagaagtagttggtgagtagccagctagtgagaatgtggaaaagctgggttttgcagcttatggcttataatcattttttagactctatagcttatgattcttagaatctgggtgaaaagctagactgtttcgggagttggagattctagaaaaagctgcaacttccagaagctctaaattgtgtttgtgtaaaatataattgcaactataatcatttgttgtaaatctccataccctgattggcatgcatttcattctcaggaattgtaaatagcaggttcttcactgtggcaccttaacagggcttctcta

SEQ ID NO: 33247 - DNA, 251 bp, Oryza sativa
attttattcgcttattaattagagtaatatttgtactctattatcaatttgttattgtgtgcctcggctgattcctggacgagggttcacacacatgtaagcgtttggaattttggatagaaattccgggcgtgacacccactccgcatcgtgcaccggtgagcaccgccatggccgccgccttcggccggcgtcctagccctcttccatcctcctctctctctctaaccccttttatcatgtccgctagg

SEQ ID NO: 33248 - DNA, 460 bp, Oryza sativa
gttttcaaacttaaactcactgggcaaaagtgctgggagtgttctattttttttcctactgggattatgataaagcatgcttgtttttatttttctttttttaatgcgcacacaagcaggtggagtgtgtttcaacttttctttcatttctctttgttccatgtagttttaaggatcgagtctgtggacattgatcaactgatgcctattacctaattctttttgtttgtaagccatgacgccttagttcatttatctagttcagtgtctcatggataactaattttatgtctatggcatttcagaacattaatgaggttcctatccatttccaatcctctggaaacaaaactagttaccggcttcaggatgcttccataagcaaggtaatgaattttttgtttcataaatcataagcacatattaagtatgaaattctgacaatggcgttcacatcagg

SEQ ID NO: 33249 - DNA, 360 bp, Oryza sativa
aacatgttcaagtgacaagcatgacttgccttgctcagctgctggaggaacctcggcgactatttcaaagtacaccggagcgtcgggagagccggaatctaagcgatatacaaagcaaacaatacaaacaggccataagactactgaaacagagaacaaaaccattttgaatggattctatgcatttttcttgatttactgatacttgaatgtacttaaacggaactcggatgaattagatatgaattttagaagattcactgcgtttttactataaacagaaaaatccttaattgatttattgcgcaataattaaaatcccggggagagaggggacggcgccgacaagcgggccccata

SEQ ID NO: 33250 - DNA, 1501 bp, Oryza sativa
ttttctgcttagattccgtcgtttccggagagtccgttttcgcagaagaagagtttgaagagttccaaggccagcaaggcaagtcacatagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagccctgcttagaaacattagtacacttatgggataactaatgattcactattatttcatgatggattattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgaaaaagatgcttaaactggtaataatctgattagctcctggtttggaatggtatattcctggtttggagatagaactgtgcagccggggtggttgttcagaatggttgggcctatacaacagggtatgttgtatagcgttggcttaatattgtttaattacttaactgttttgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgt

SEQ ID NO: 33251 - DNA, 1501 bp, Oryza sativa
cttaaagatgggcacggagaatatgttcttcaggtttgtctggagcaggtacagaattataaggagttgcttccactaaagaaaatgccctaaaaataatgcttgaataaaaaaaaaaggtgctccatgctctttccattctgtcgtacattccgtcatttctagccgccagctagtatatcctatttctatagaacattgctattgaaaaggacaaagtatgagattaacatgtttcagtggaggctgcatgtatatgcatttatgcatgagtgagctgttttgtttagttaggatatactcctacatcgttccttttctgttcatagtaacatgtttctccaaataggttcatacaagtccctattggccggaacaaggaattcctattctcaatcagttattaccactacacaaaagggagaacaatggctatgtttatgcatttcctttactgacaaacccatttactacaaatatatttccccttttgctttcaaatgtgtttgcattatcatttttaggtggtccctcttaccatgttatcttcttttctcaaagaatgattttatgacttttaagatgtgccaatattaataacattttctaatatgaattttgatacatcttaatctatatttacaatacataatttctgaatttggtatatgtatctctcagaaagggtaaacttctctctcaaaaacaaagaacactacttctcgatcatttttttggagtttatctcacttcttactatgggaattagaccattcctagaaaatttacatgtacttcaatcatttgagttagggatatttttcgctatgtacggtccagcaacttttggcacgtagaccaaggttagccgcacgagtgacgcggcgatattaatttcagagagcccaaggccatcatcatatacacagagaagacgtagtcgcctcgcctcgccgcttgttcatacacagagaagacgtcgtcgcgctcgtcgcttgttgccttgttggcttggctatttggcacggcacgacaaaaacgaaagagcactggtgccgattcccaacaatgtaacggccgtttcgctggcaaaacgaaaaaaaggcagcagaccagagctatctgctgcctctttcgggcgccaacccaacctgtggctgcagttgccgttgcgctgtgtgccgcgtctgcgtttccgcggcagcgtgtgcaagtctcccggagccaaccaaattggtcgtcagctcgtgccttcacgtatccgccatgctatgcacgcgaaccatcctgtaatactgcagcagatggcatatgcgaaactgcaacccagataccacaagctttttggccatttcccctccttaccaatcctacgtgaaactaccatgaaatcaagcaagctggacagcttcttgctttctatttttctgtcaaccaagacaggtgtcacggcgatctcctccgtataggcgagtttccaggcatatgtctccggcgccga

SEQ ID NO: 33252 - DNA, 1501 bp, Oryza sativa
gcataatagggttccatttgcaaaagcagcatttagcaaacatttgagaattttaacaaaacagttaagtaattaaacaatattaagccaacgctatacaacataccctgttgtataggcccaaccattctgaacaaccaccccggctgcacagttctatctccaaaccaggaatataccattccaaaccaggagctaatcagattattaccagtttaagcatctttttcaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataatccatcatgaaataatagtgaatcattagttatcccataagtgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctatgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcgggctagggtttgggtggaccggcacatgggcggcggttcacacgaacggacggccgagatctaaccgatccaagatggacggccgagatcgatcgggtccacggcggttcacggcggacggccttga

SEQ ID NO: 33253 - DNA, 1501 bp, Oryza sativa
atcgtttccggtcctcaggtttggggctgcgttgcgcgccactcgaccggaatggcagccggatgcttccaaggttgacgctccatccagctcgccggacagcaacggctcggcggacggccggaggcggcaggatcggacggcggaggaggggttggaccacccgatcgacggctggatgggctccttgtctcgcatcggtagcacagggagtggctcagttccgtcctcgcggcagccaccactttacagattgtcacttcccaggtgatgtaaatgtgcaggcgcagcgctagctgccagctcgctttcacgatcgagctgacagtcctcgatgggcattgccaattattaccatcaggaaaagaacaacaaacagcatcatggctttcgatgctcacgagctgctgacaggaaagtggcaaccaaagatatactccattcgtcaaaaaaaaaaaacaactttagacaaaaaaaattatctaggttcattctcaaaagttatctttttttttttttgacaaaggaagtatctgagagcaggacacggtaattctgacaatggatgaggatggccatcgtgacaaagaaaaccaccaaacgacttggaaagtaataaagggtccgtggccagctctgaagggcgtcgagtacattccaaactcaaacgctttcaggcgttagccatccaacatcaatagttagcaatccatgttgatgactattcagaaccatgcctaattgccttaacagggggacacgcgcccacgacacatcagtgaacagtgcaatgcatatggctattaggctatatgctgttgtgatagtgattagctacgatagacagctacgtgtacgtgatactactttttaacaaacatggtgtaattttgaattttttttaaactctatggtgcatcttgtaaatttatgcttgtaggagcctttaccaaagaaagaaagtgtgcgtcaattcagaaatatactccctccgttccaaaataagtacagttttgcactgttcacgttcaacgtttgaccgttcattttatttgaatttttttatggttagtatttttattgctcttagatgataaaacatgaatagtactttatgtgtgactaaatattttcaaatttttcacaaaattttcaaataagacggacagtcaaacgttggacacggatattcacggctgcacttattttaggacggaggtagtacatgatactgccatgaaatatacgtgttacctctgatgttactgttgtacaaaaatacatctcctaatattgtagaataacattctgtatgataaaactttcccatccagggtacgaactaagtattgacctgtcaaaagggccgaggaaaaaacctcctcgagagaaacaatttccccctgcagattcaggcacttcattaattagccaaggaaaaatggcataacaatatcatgaaatgcaaggtagtaagaagcattcggtactgagatgagtg

SEQ ID NO: 33254 - DNA, 1501 bp, Oryza sativa
attattattttttctataaacttggttaaatttaaaataatttgactttgaccaaaatcaaaacatcttgtaacctgaaatggagggagtagcatatactcctatatttagggctcatattaatttgacaacttgcatagagttgcagggatgcgttcgatttgtttgttgcgcctttaaaagagggcatagccttttttactacggttgatttcaggaagtacacactcaacacatataatattttctttttcattttctatctcgtgctactgcaatgtattgtagataaagatagctaatgagatgaaagctttctccacttatatattatattttttgcttttctacaactaatataagactatttgcgcgcgctagttttttgtaaaaaatgaaaaaaaaagctatatacacatacgacgtaagaaaatttcaaagtcttactagctagcaccataaattggcacacaataacatagccagttatattagctacttctttcgtatcgaaaataaataaatctaatataaaatattatatattttaatattataaatctgatatcgtggttggctgccttgaacgcagcaaaattacgaaaattgcatgcatcgtcgtcaatggacactacatattttcttactacaaacgtacgtacggcagcgagcggccgacgaccacgacgattgaccatagatagacgatagacaaaatctaacgcgggatagatgggccatggttagctgggtggaatctcggagactagagcaacggttcaccgttcgcacgccacggcgccacgctgtgccgacatcaccggctgcacgcacgtcgcgggcttgtcgtggccgccgcggagaaaagaagctgccgcggcgccgcgcacgcgcgctgtaactttacgtaacgtggctagctactacactactactatgaccgtttgcattgcattcggttggttgatcccatgcttttgtatggacctgtggctctattatactacctccgtttcttaatataaggaattttaacatattacttgcactgttcggtcactcatcttattcaaaaaatttacacaaatataaaaatatgaaagttgtgcttaaaatactttggataataaagtaagtcataaataaaataaataataattctaaaattttttaaataaaacaaatggttaaacagtgtaagtaaaatattaaaatcttttatattagaggacggagggggtatgatgagtacaactttaagtagcagttggttggttgatggttagtttctacaaataaaaggaaatgtgcttctgagattttgatttctaatttacatttttattatgtagcgacaaatgtagagaggaagattttttttaaaagaaaaatctgcagttgctttaaacttttctacactgtttcctttgattaaagagacatggtgtcagggttacgggttaggtataccctttacccttcgatatacgtcacatatcga

SEQ ID NO: 33255 - DNA, 1501 bp, Oryza sativa
gtatggaattatatgatgggaatcacaggttacaaagggaacgatggaactcgatgaaaccggcgagatcataatcgaattgattcgactagatctcccagcgattcggctcctgcaggctccgacttcgtaggctgtggtggtggcgttggctgtgagattcgatcccgcaggtcctcccagggggtcccttttatatcgcaggtcaggcaatctccaagcaggactcagagacatcgaaccgcacacgatacgttgacaacacagtcttgcccgagtaggtctctttccatctgccaattccgtgaaggatttccttaacacgtatagagaatgtccctatatgcgcaggcatgccatattgatatgtgacatatatcgaagggtaaagggtatacctaacccgtaaccctgacagtagcccccgacttctgcttaaatgaactcgtgtgaccaacgcgacttctgatgtcgaagctgatgtcgttctcggtgtgggaaccgtagagacaggacatagtcgagaacaccatgtgaagtccaacggtcatgagtgaatttaaactgaagtctgaaagaccgccgcacgcaatagacccagaaatttccggcgggcatctatctcctttccttgaaattcgcgccgtgcgaagcgcgtctacttaagggaattttggggattcattctgaagtccgcctgttcgtgggaaaactttctagcctccaagcatccctcgtcttccccgctcccgcaaaaaccctcgcttgttaatctccgtccttcctccgacgatctctagttggcgatggatctcggcaaatctacttccaccaacgcgtcgctgaagaaactccaggaagagggcgcccttcccggtcgcggagtcatggagagagaagtaggaggtactgaaccccagcctgtcctaggtcgcatggttgcgatcgaggacaacattctttgtggttttctccctccaccttctgaatttcttctattggttctgcacttctacggcctttctttgctccacttgaaccccaattccattgccttcctcagtatttttgcgcacctttgtgaggcttacattggggtagagccttttctcgatctcttccgcttctactatgagttgcgttggatggaatccaacagggtgtccggatgcgtcggattccgacttcgggatggcttgaaatcgcgctacatcccgttccagtgcacttcttctcgaagcaaatggcgggcgaggtggttctatcttcagatagagaattcggatcctgtctttgtcgtccctgaggaacaaccagacaagatttcgtcttggaccgcaaagcccgccttgaccccttccctccaatccttcatcgatgccatcgacgacctccgagtacgaggtttgtcggggtatgaagtcgctaccgacttcgtcggtagacggatccaaccgctccaggcctgagcccacccagcctttgactattctgggccgga

SEQ ID NO: 33256 - DNA, 1501 bp, Oryza sativa
cataaaatccacagattagattaaacagtgaaacctttgttgtcatcggctaaatccaacatgtatacaatccttataagccgatgcaacgtccagataactcatcggctgaaaccccgatgaaacccttattggcagtcaagaagcaggctagatattatggttctaagcacgacttagtagatcaaacttaactgatgcagcactaagtatgaaaagaaacataatatctagacaatcaagctgttgactgagttttcagggtggtagatgtctaagctaatctaatctagcaaggcgatttagccgataccggcataaaccctaaaacgagaagcagccgatagagctaaattgatatgctaagactagattaacagagacatgataaataggtaggcaaatatatcatccaaaccagagcaatctaagaggtcgaatgtactgatgcagccttgaacaacgccggcgcagacgatacaattgcctgggccgacggaacattggacttaccccttcgccggagatcgaacaccgatgcagccccgcgtcaggtgccaagtcccgccggacgataaaataaagtagaaaaggtaaaagggtggcgatgcaccgaattgtattgatcgtagagatagattacatagaccccgggtgtacatatttatacccatagggagatacaagtccttgtcggacaagaaagaaactaaaaaggaaccagtctttgtcggacaagaaagaaactaaaaaggaaaatataaagtccttatcggacactaaacacactttcctaaagataaaatgaaactaacaaactatgcctaattaatagataaactgtcatgtcgcatcggtcttgaactcggactcttctagataagcttcctttgattgatccgactccaccatgaacacgacatcgtggcgacttgactcccatcggctgattctagaactttgaagctgatactgactctaagccgatggtaactttgggcttaccaaatttcactgttaacacatgccccccagttttggagtatgagaactcatgcttcaaaatttcttgtcttgataactccaaaaccgatcttcctttgcttcgtgcaatcggctttcatgagccgatattgtttgcattagatgagctagactgtcaaactcgtggcaaaagaatctatctccgataggtgctgacaatccttggaatgcaagatctactagctgttcattgcttaggctcaaactataacatcggctgcggacattacgaaatctctgaatatattccatagccgattctcctttttgctgctcaactgatattaagtctgaaagcttcaactcgctgaatccagcaaagaagtagtcatgaaattgcttctcaagatcggcccatcctctgatagaatttgatggtaatgatgaaaaccaagtgaaagccgatccagtcaaagacaatggaaaaaacctaactttcagagcctcttcagtcgat

SEQ ID NO: 33257 - DNA, 602 bp, Oryza sativa
ccatgctcatgaaaagcaggcatcaactattctttcccattgcttttgttcctactaaaacactcctttagagaatcctttatgaattccttggctgttaactttaaatgttcacgaagatgctaaaatacattagaagagatgaatatgttaactgaacattttctgttctgatatctaacattaattctgggaaggcatatttcttttttgttgtgacatgggccagaggtttggaccaaataaaccttaggataagctaccatgtgtagctgaagctcactaacaaataccggcaaagaaatcaaccgctggtagatcgttgacatgtggacctaccatcaaaagatactgctaccaccctttatgtgtatcacttctaccatgttggatggaccccacatgtcaaaacctctatcaagttcttttggagttagcttcatacaatgctcatatcatatttgagtcaagtagtcaacctaggattaatgttcacctaaatgtttcctttctctcaatattgaagttatgtttcaaatgatttatccagggttttagtcacattatcattgattatgacaactgttccagttattgaaata

SEQ ID NO: 33258 - DNA, 257 bp, Oryza sativa
aaattgtgaggttttaatgaatgagatttcaaaaattagagatgttaatgctgcacatgatttgaaaaatagatcttctcttgcttgcagttttgctttgcacacacgcactttggatgagttgtttttaactaaaaagttgttgcaaaaatatcaaatagcttttcatgctagtttgatgtttaacatgatttctgctaaaaaattaaaacaacctcatgatattttggattgctcaacatgtaatttgaataaga

SEQ ID NO: 33259 - DNA, 1501 bp, Oryza sativa
gcgctcccgggctggccgcggccgttcacggcgtacgccgcgcggtggcggatgccgtacgaggagagcggctcggggaccagcctctactactccttcgacgccgccggcggcgccgtccacgtcgtcatgctcggctcgtacgccgacttcaactcgagctcggagcagtacaggtggctggcccgcgacctcgccgccgtcgaccgcggcgcgacgccctgggtcgtggtgctgctgcacgcgccctggtacaacacgaacgcggcgcacgagggggagggcgaggccatgaggaaggccatggagcgcctcctctacgaggcccgcgtcgacatcgtcttcgccggccatgtccacgcctacgaacgcttcgtgagttcgattttgatcagcgccattgctcgaacggttgatcacacgtacaattctcaactaagcagtgcacgtcttgactttgtcgctgcagacaagggtatataacaacgaggcgaacccgtgtggaccggtgcacatcaccataggcgacggcggcaacagggaaggcctcgcatttgagtaagcactaaacattaacaccggcaaaataacttacaaatcttgatagctaaccatagctcacggctaaatctggttggatatcagctttcggaagaaccacaagctggcgccgctctcgttgatgagggaggcgagcttcgggcacgggcggctgagcgtggtgaacgcgaccgccgcgcgctggacgtggcaccgcaacgacgacgccgactccaccgtgcgcgacgagatctggctggagagcctggctgccaacggcgcgtgccagcagagtagcagcgccgccgccgccgcggactctcagaacgacgagttgtagcattgcacattgcttgatattaattcaacaaattaatttgatagcgctcttaatttgcttgtcacgtgccggtgaacctgggtgcttactttacgggcaaacaatgcatttgtaccatagtgtggttagtggccagtagtgcttaggccggcggcatttgccgtgcctctgatagctagaacgaacaacttctgtgcctgtttgtgggtgtaatcatggttgttaccattccagatttcctgtgtgatgtgctttgcacgctagttctgcctacccttgaactcaataattaaaatgttcgtccatagacacacggtagtcatatatgtgcgcggacgcgctagcttgttaagaatttcgtatattggtgtggttgggcaatgcagttatgactcatcgaagtagtggtttcccaaaccgctggagccagattaccgcgccctgtcggtaagcactgtaaccgcggtaaccgtgacaaaccgtatagtaaaatttattaaaattttaaattattttttaaatttatttgaatttaaggaggttaccacggtttttctcttactgtactctacggtaaccacgcgaaccggcggttttggaaacccttcattgaacttgaac

SEQ ID NO: 33260 - DNA, 1305 bp, Oryza sativa
cattgatatcactgtgagtagaatcatctacctttttaatgtcaaaaatgttcttgtgaggtaacggttgatgatttgttgtaatattagggtgctgcaggaataaaaggtcatgagtttgacattgtatgcaaataaaaactgaacaattataatctacattctagaaattggatactccaccatgtgttcatccatattgctattggcatgtggggcaggtttggtttaaggcataaattaggcttaccaatatttgtcaattttaatagtgtttagtgtctatttggtttgaaaccaaattttggcatgcctaagaaaataggccatttcaatagtgaacttagactattttggcttcaatccaaatacaactttaccttaccaaaattagtcatgccaaaacttactaaaatttggcattgacaaaatttggtaaggcctatctagaccacaaaccaaaccaacctgtgatttgaaaccgtattcacgaggttttcaggttgactggagataaggggcatgctatctcccgttgtgccccttggagtgcaccacgccatgcagaattgctcgacaattgtgacactataccatgatcaaatattccttgtgtgaagtaaacaaaggttcctgatatacaagaataaattgtactactaatttatttaggatgcacaaaacagtgttttattgataactgcaagcaagcaaccctgatttacttgggtggacatgatgacctttcaagcaaaagggcactctgaaggttgcaggggtatgtggttaaagcatgacgtggtttcattcctagtataggaagtcaattgatccgcagacccacacggcccaacggaaagatgcatgagatgagtgggttgaataaaaaaaggtcagtgtgggacaggatatccataatctaaaattttacatacttgtatgtcctatttctcgagggggatgatgaggtatgacactatgaatttgactgcttagagcatccgcaatagtaaagtaaggtgttatctataaagcatgtacatttcagcaatagactagattaatagtaaaccacttcaatggtatgtctacatggatatctatagctctttaatccattgccttatttttctctatagactatctccaggttagtagatagctttgctctctctctttatttaatctcttcaaagtagaaaaatatgctgacatgaatctcttatagagagcctatagataaccattgcgggtgcccttatgaattgggtttctcttttcttctcaagagttccctttggcttc

SEQ ID NO: 33261 - DNA, 176 bp, Oryza sativa
ggtgttactaacctggaataaaaatcaaaacacactatataatccatagtaccgatcctcttttcccgtccacacaacaaactcctccctctatctctttttttcctctctaacttcttatctctttccttatctctaactcccctcctctccttccttttttccttcaccacagt

SEQ ID NO: 33262 - DNA, 1501 bp, Oryza sativa
tatggaattatatgatgggaatcacaggttacaaagggaacgatggaactcgatgaaaccggcgagatcataatcgagttgattcgactagacctcccagcgatttggctcatgtagggtccgacttcgtaggctgtggtggtggcgttggctgtgagattcgatcccgcaggtcctcccagcgggtcccttttatatcgcaggccaggcggtctccaagcaggactcggagacgtcgaaccgcacacgatacgttgacaacccaatcttgtctgagtaggtctctttccatttgccaattccgtgaaggatttccttaacacgtatagagaatgtccctacatgcgcgggcatgccatattgatatgtgacgtatatcgaagggtaaagggtatacctaacccgtaaccctgacagtagcccccgacttctgcttaaatgaactcgtgtgaccaatcgcgacttctcatgtcgaagctgatgtcgttctcggtgtagaaaccatagagacaggacatagtcgagaacaccatgtgaaacccaacggtcatgagtgaatttaaactgaagtctaaaagaccgccgcgcgtaacagacccagaaatttccggcgggcatctctctcctttccttgaaattcgcgccgtgcgaagtgcgtctacttaagggaattttggggattcattctgaagtctgcctgtttgtgagaaaactttccagcctccaagcgtccctcgtcttccccgctcccataaaaaccctcgcttgttaatctccgtccttcctccgacgatctctagttggcgatggatctcggcaagtctacttccaccaacgcgtcgctgaagaaactctaggaagaggacgcccttcccagtcgtggagtcatggagagagaagtaggagttactgaaccccagcctgtcctaggtcgcatggttgcgatcgaggactacattctttgtggttttctccctccaccttctgaatttcttctattggttctgcacttctacagcctttctttgctccacttgaactccaattccattgccttcctcagtatatttgcgcacctttgtgaggcttacattggggtagagccttttctcgatctcttccgcttttactatgagttgcgttggatggaatccaccagggtgtccggatgcgtcggattccgacttcgggatggcttgaaatcgtgctacatcccgttccagtgcccttcttctcgtagcaaatggcgggcgaggtggttctatcttcagatagagaattcggatcctgtctttgtcatccccgaggaacaaccagacaagatttcgtcttggaccgcaaagcccgccttgaccccttccctccagtccttcatcgatggcatcgacgacctccgagtacgaggtttgtcggggtatgaagtcgctaccaacttcgtcggtaggcggatacagccgctccaggcccgagcctacccagcctttgactattctgggccgga

SEQ ID NO: 33263 - DNA, 1501 bp, Oryza sativa
ttctcgtggtaacggcggagggcttgttggtagccggctgctcggacggcaactcgttcgcgatgttcctcgagtagattcacattgtcgtttcgctgctcctcctgatactcgtcggaatacttctgtgctcgtgtactctgatgtcatagctcgctgaggagcatggcctcggagccgtacacgagaaagaagggtgtttccttgttagacgttgtcggtgtggtgcgtatggcccatagtactaatgggagttcttcaacccatttcttgtcgtgtgacatgagcctgtcgtagacgcgggtcttaatcccttgtagtactatgccgtttgccctctcgacttgtccgttgctttgaggatgagaaaccgaagcaaagcatattttgactcccagcccgatgtagtaatcctggaaatcggtgctgatgaactgggagccattgtcggtgatgatgcgatgcagtagtccgtatctgcaaaatatccccttgatgaacatgatggcgttgtcggccttgatttctcccgtgggtaccgcttcgatccatttagtgaatttgtcgatcgccacgaataggaacctgtagccgccttgtcctcgtgggaatggctcgagtatatctagcccccagcacgagaacggccaagtaagagggatggtctggagcgcttgtgcaggtagctttgtgtgcttgctgtggaattgacaggcttcacaccgctggaccatgtcgcatgcgtctttgagggcggttggccagaaaaacccttgtcgaaaagctttcccgaccaatgtgtgaccggcggcatgtgacccacagattccttcatgtatatcgaggaggaggtgtctgccgtcatcggatgagacgcatttgagaagtactccgtttggcgctttcttgtatagatcgttgccgatcatgcagtagatttttgctttacgggttattttctcggcctctgcgtcgtcctcaggcaactcttcgctgttgatgaacttgatcagtggggtgcgccagtcatctgtggtctcgatatcgacgatggcgtgttccgcctctgtgacctccgagctgatgtcgggggcggctgtgttaatctcgccgatggcctctttcactgatggctttgtcaggatgtccaaaaaggtgccgggctcgagtggttcttgcctggatgcacgtcatgctaggtcgtctggctcgatgttgtccttgcggtatacgtgtcggacctcgatcccatcgaaccttttctccagcttcctgacctctgcgaggtacttggataactcggggttagagcatttataatctttgtatacctggttggcgactagctcggagtcccatttcacgatcagtcgtttgaccccaagttcagctgctgctcttatcccggcgagtagtccttcgtactcggctgtgttgttggttgccctgaatttgaggtggattgcgtgcttgaattgatctccggaaggagatgtcaaga

SEQ ID NO: 33264 - DNA, 1501 bp, Oryza sativa
ccggcgagaagataatctccagggtcccgacgctagggtcgaagaccaacacatggcctgtacctgtggcaaacatgatctttttcttcttcttttcttcgttgttgccatcactaaacatatgaatcggggcgatccaataccaccttagacacgaatggtcaggcggcaacacgctcacccattcgatggaacacagcttctcccagcttccagctgcagcttctctcgtcacccatatttcgcacgtaggactctccggctcctcgtccacgagctgcaactttacgtctgtgaaagtatacacacacagacagccatccaactctgtcagctcaaagtcgtcgcgagattgcagctcaggaggaggcttcaacgacgacacgccgaaagattcgtcggtcacgttgaatgtgacgatgtcgccgtctcctcggaggaagtgcaggtcgccgccgttgcagagcgcggctcctcgtcgccaattctctcgcgggtaatgccaatgccgcggcggcggcgtcgtggacgcggcggcgggcggcctccagctgctcgacggcgacggctcgtcgccgtcgagagccaagacctcccagacgacggtcgccggcgagcagcagcggcaacccaccacgcgcaccaccttgtgccgccgcgtggccgagcagtagcccaagccgtaggtcgccggcggcggcgtgttgtccgtgcccgggagacgcaggatgtggcgggtggaagggttccagaggtagtgcgtgtggtggccggtgatcttgaggaggacgaggccatggcaggacttgctggcgagcggaaagatcgtgccatgtggcagatgtctagcggtcatgatctcctctaccgggggcctggggatcagatgctgccactgccattgccaggcgaagaaaggttgtcgaggaccgaacggcggcctgatgaacagccgtggtgggtgtttgttccgctgctttcgctggaggaaatgggcttcctggaacaggtgtgacgaggtgatggtggcgtggaaccgccgcgagacgcatcggaatcggaggagcgatttgacgggcaggtgggagaggatctcgtcgacgatgtcgtcgggcagtggacaagggcaagcccccgagaaacgcttcatcctcttggcgctcctcgtgccatccatgtcttcctccctccttgcctccttggttggttaatgattactcaactcactcctgtttgttttgtttgatcgattctggtgaagtgtacagcagatccaggagatcggtgccctccagttaaatgagtacccaaggagcaaggatgagtccgaatttgaatgggacacgcaacaaaactctagtccgagccggagtcagttcgcacgggcacggtattccttcgattaattggcaatcgccgatcagcgatcactatcagccagctttgccgtttttagggaatatcctccccgtcggttgctcgggagaggtatagatggtca

SEQ ID NO: 33265 - DNA, 1501 bp, Oryza sativa
ggcagttacctctgtggcacatatttggttcaaatgtcatttcttgacgcctaagatgggcttgcgcagtcaatccctccatatgacgagctagatatggtccatatctaccaaagatatgtacaatcactgttctcactgctggcggtggcaccttttgatcaactgagtggtctgcccctattcggccaaacaacagtttcttcactgcctccgagaagttattatcatcagaagaccatccgggaactatcacaataacagaagctgcagcaaaatgttaatttcaggtaagaatgaactgagtgaaaataatttataatctaactagttgggccatctgttctcaagtgacagtgatgagcattgatcaattcaatgtagcaaaagccctaggtaaccagaaacgtaaatagtcacacagacaccacaaattaaacagtatttaccaacatatgaaacatacggagggggcgtagtctcacaaatacaaactactagcaacaagtttgcatggcattttgaatacaacattgctaactgcaaaatcaaatcattttcacaaaaataaaaggaccttctgaattgtaacagatgcaccaaggtcaggcaaatggcgagtagaacactcaccatttttgtcctgagaaggtagcttagacacagcggtgggcagtggttcctggagattggaggtatccacacgacgggtgagtgcgccaccaggcaacggatgttgtgatggtgcaggtgtccccagcccgacgcggccttcctcactgctgctctccgctaaccaaccagaaccaagaagaacaacttcacaatggcacgaagaggggagttcaatcttggaaaaaagaagagggcaagaggcgcgctcgattaggtactcaccttggatgcgcaggggcctggatgcgcccacagagcgcttgctgtttcccagcaggggcattggttcttaagtgatagtgagaaacagaaggattactgaagttagtcgattatatacacagaaaaatgggactatcaattatgctgattgctgacaaagccactaggtgtaatgtagaagatatacaaaatactatcagaacagacagaacaagatacctaggtaatcagaaacgtaaatatccacatggcagtggcagattcaaaaaattttaagagctcgggtaaacctaacaaacaaaccaagaatatacaagtctatataattcatagatcattttaacatgagcatttgctttataagtttgtgttaagcatatgtgttgatgtggagttgcttcatacggcctagcagtgaactaagcaatgtaattagcaagctaattaagtgttaatctatggatgcacagctgcatgtgccaggcagagcctgggccattgcccgtggtagctgggccttggctccgccactgcacacggacgcaacaaattacacagtatttaccaacaaatgcagtatacagagggggcatagtctcacaaa

SEQ ID NO: 33266 - DNA, 1501 bp, Oryza sativa
agtgaagaaaccagtcggcagcagatgtagacagcttgtgttgaagatgatgacgcctattagcgatggtggcgacgtggccagccgtgaagacgatagcgccaattggcgtcatacgaagtggctggtcggtgaagatgtagacgtccaacaacggtggcataataggccagtcgtgcagcggagacaccagtcggcggcggataaggcggccggttggtgaaggtgtagacgcccaacaacagcggcatagtaggccagccgtgcaagcggagacaccagttggcggcggcgaaggtaagccggtcggtgaagacgtagatgcccaacaacggcggtgtgaccacctgaccgtataagcgagaacaccagtcggcggtggacaaggcggccggttggtgaaggtgtagacgcccaacaaaaacggtgtgaccacccaggcgatgacagcaagccgatggtgatgtgctgactgatccattcctggagcgtaagagataagcttatagccatgaatcccttttatgcatatctggatctggatcctgcagaacaaacatataggatgagtagtatctgatataaatataatactcgagaaaaattcaagtattttaaaatatttataaatatgtatttcttctcttgtcaattttgatttccccgagcagatgactcattacgtttaaacactctgcccgactagtcatagccaccatgcaccgggagtcagcctaagcacttcccaaacatgcatatgagtgacatgagttcgtcattaatggaacaaagtttcacgggtcggagtttactactcgggtacttttgcaattattaagagcagaaaataaattatcttatctctatgcttttgatttattccgaataatacttagcaccttgcgttattcgatccatccaacaagcccccgggtgctaggaatcagcccaaaggcaactatcaattagcaaaccaaacgaaaagcataggaagatggaactccataactcgataggcacttttgtactcagaatatgtcgcaagcaatcaagataaatattatgaaaattgtttaaaaaatatgatacacatctgtagcccccgactcactagtcaacggcgaaccagttgatgtagtgaggcaaaggaaaaggcaaaatatcatataaagaataaaataaatgacgacttagctttgtcgtattccctcggtgacagcaaaagtagccgatgtgggaacgaagcagtccatcaatggtgacaaaaacaccagtcggcgccagtggaaccaagccagtggtgtagatgatgaagcccattaacggcggcggagtccgctaaccgtataggcgaaaacaccagtcagtggcggcagaggcaggccggcggtgaagtcgtagatgctcaacagcggcagcataataggccagccgtgcaggcggaaacaccagtcggcggcggacgaggcggccggtcggtgaagacgtagacgcccaacaa

SEQ ID NO: 33267 - DNA, 1501 bp, Oryza sativa
ctgaccacattttcttgttttgtcaggcctgataccttagatcctgcacttctacgtcctggtcgtttggacaggaaggtagaatttggcttacctgacctggagggccgtacccaaatattcaagatacatacacgcaccatgaactgtgagcgcgatatccgtttcgagctgctggctcgcctctgccccaactcaactggtaactggaagaactttgaaacttcgttctgggtggtttcttctagatttgtttgttatagtctccacctcaaaagcggataatgctaagctttgttctcacaaactcctgtttgctgttacaggagctgatataaggagtgtctgcacagaagctggcatgtatgcgattcgcgcccgacggaaaacagtgactgagaaggacttccttgatgctgtaaacaaggtcatcaaagggtatcagaagttcagcgcgactccaaaatacatggtgtataactaaaccgttgttgctcccatttactatggcccatgagattgtctctggctgtctgcaaagattgttgttgtttcttctcggaattgtgcatctttgtggcgaccatgtcatcttgtacaagttctattaaattttataagtagggttccttttgacggttaatgtgtcaacgacaacaatgtgcaaagatttccacgacggttgtggtcgggtggaacggtggagatgaagaattgaaggtgactccacgaacacccttgcctggttccgattgatggagtagcatatgcatgcatcctagtcctagcaaatcctgcatgacttacaatattcttggactcactagaaattttgttagtttcttgagagcaggaaagcccattttgttcctcgcttttcttttttagtggagctgattcagtgcttaggctgagttcggtaccaaatgttgggaaccaaatgctgagtttcagaatttagttatttctaatacatcttattttaaaataaaactatttctctacctatctcctcctctcaaccatttttccttttttttacctaccttttcatctcaaccaattataacatttctcaaattatctctatctactttttaatatatgtgaccatcttaaaaatacttatattttagaatagggctcgtagtgtaataccatgattcggagcattatttccgaaaatgtcgtacacaaataatatctttaaaaaaaatctgagctctgcttttagcaggacaaatctatagatactactatcccctttctaaagggggcgcctaatgcacgactaatcgcgtgcctggggccacgcgcgactgatgctagtaccttttactactactatttaatatattactactactagtctactattactactattagtactactactataaaaaatatatatatacattaaaaaacctaaaaaaacgtgtatataaactttatatatatgcatacaaactttatatacgtgtatacaaaatttgtatac

SEQ ID NO: 33268 - DNA, 594 bp, Oryza sativa
acgattttaagagatcacatgtcgctgttaaagctgagaaaagacctagtaaaaatactgcagattgcagatttggacatgcaaatatgccatgttctctctctgagactactacataccagctctgaagataatctagacatgcaagaacaggaagagtatttatgtcaagacattacgcagacagccagacgcaacaacgtaatgccactgctcaagagaaaataaaggaacagatcaaggtaattttacccaaatccagatgaggtttcggccgggtgtaaccagcgaggtaggcttatgcgtcgccgtcgatctgagcaaggcgtcgcgaaagaggggcgaggccagatcatcactcatacctacaagggggaaaaaatgtttgattagttctaactcaatatcaaaatccgcctcggatttgagcccatcggctcatcgccgcctttcggcgtccgcatctaggccccaaagtgaaaaaaagaaaataccacagtatatggcaaacaacaagaagattcaaacaacacaactatgtcgagatcaacccaaaatcagaacagcgccgctcagatttatatctcttctagc

SEQ ID NO: 33269 - DNA, 897 bp, Oryza sativa
ctctggcatacacggatatataggcatatataccaattaactacactgacgaactaaacagtggctcgcgcttgctgcaccgagttcttatttggttcatacatggctaagctaatagtggctgatatatatatgccactaggtgatctagctcgatcgatccctagattatatatgtagtagtccattcttaattagttgcaatatatagtttggaaggctagctgcatctgcaattaatattgcaggaggcatattgcatgcctgcaagaggggcttaatttggtttttggcagtttggttaattagcggcggcgagcggccgtctctcgctgcgcgttgaagtagacggcggcgacggggaggccgaggtcgttgtcggcggcgaagcggcgggtgctgaagtagtccctggaggatggcggggtcaccgcctgacggcgcttctgcttgaacagcacgaggacgaacctgtggatgccaatgttgggcttcgggctctcgtagctcaccacctccctccctgcgcatacatacatgcatgtatatatatatataggttattcgtgtaagtttgttcagagaaattaaagatgatcacaagccaataatcagcatgcatcatgcgtgtattgtgcacagccatgggctcatcagagctctcgttttaattattaaacttgtaaaagctaaagcaaggtgtacgtatatatatatatatctgtgaaaaggacttaccaaaggaagcatcagtggtgccaggaatatcagtgacgatcctgccagggtcaatatattaattatgttaaactaaagcgcatactttatcagattgagcgctattttatgagtagctgagcatatattatattagtgatggccatttgtgttggttca

SEQ ID NO: 33270 - DNA, 833 bp, Oryza sativa
gtttggttcttttcttattaaaaaataagtaaatttcataaaaactacagatactttgcacgatatatcacaaaactaaatatttaagaacttgtttcatgaaagtacatatttcttcgtttatcacaaaactacatgtactttacacaatatatcacaaaactacagatttaagaacttatttcacaaaactttagatttaatattttcatttgtcacaaaatgataaataagtacatgttaagtgccttcattatcataaaaccataggttttagcattgttaaaacctgtagttttgtgataattaatggagacactaaatctgtagttttgtgataaataaagactaaatgtgtagttctgtgataaacgaatacactgaatctatagttttatgaaacaagttcttaaatctgtaattttgtgataaacagagacactaaatctgtagttttgtaataaattgtgcaaaataatgtagttttgtgaaaattactcttaaaaatttaagtatgtcattttgttgtagcttgatttattactcaaggaacttttaagcaatatttatatttttaagatttctataaaattttttaagtagaacgaataaccaaagcatatagcaaaagttaacggtaccatatattaaaaaccagagggatccggagtatacagaattgtttccgaattttcagaaaaatacgcactatttgaaaactcggaaattatgcatcagtactaagcaaagaaaaacagggcgacggctgattgcattctgctacgtgttcttctttgcttaaccgcgtaaccacagtacttaatgtgcgatca

SEQ ID NO: 33271 - DNA, 1095 bp, Oryza sativa
attgtgatttttgagtgtattgaattgtttgagtgaactgacattgaaaattcttctgttacagtcagattcagtactccatttatcagttgactcatctcgcggaaacggcatggctaattcttctccgatgtttggcgtttgccttcttctccgatgctgtggtgcggcaacctgattatggttcccatgtaagcaaatcatgttcagcattatcctcatacaaggttccttacttccttatgtccactgctgtatagttatcgtggtctgttcatgttgagcaacacctgccattttcttttcagggcatgcccagaacttgcaggtccatttcgtcagtgcaccggctccagtcagatggtccggacaataacctgacgaagagtcgaagattgcttctctttgtagctgtctgacactataatgcaatgaaaagattagcttagtttgatcccataatcgtcttgtcctggaatccttgttgctttcattgtctggattgtatcaaatttgaagaatttgaaacctgggagcttttgtgcaatatcatgtttacgtacactattcttttcctaagttctattctcctcccaggagtacccagtagcagtattccccgaaatcatgcagaggccttttcgaaaacgcacgaattttactgtatttccacatgtttaattcaaattccgacttggttccaaagaagacctaagctttgatcagttcgtttcggaatcgaacacgaaaaccaaactaaataaatcctaagctcagccctccaagacgaaaaaaaaaagcccattgccgcaacgagccaaggacacagaccaactctagacaggcctagaaagatttacaccgtccgatcagcatcgggcggcggagagggatccttgcggaggaggaaagaaaaaaaaggccaaataaaaagaaaaaaaaggaggagaaaataaactccccgcatccacgcgagcttctctcttctctcgcattcgcacccccaccttctctccacgactccacctgaagcgcctctcgccgccgccggagaagacgcgcagcggcagcagcggcggaagcggcggggagcca

SEQ ID NO: 33272 - DNA, 1501 bp, Oryza sativa
gtagataacaaaggaaaatccagcgcgccttgttctttcttccaagatcgagtgcacccctgttctttctttcttcttcgtactcctgtgaagcagcttttgttctgagtgtcctactcgccatttacttgtcccggttgcatatgttacaattcaaaaggctatattatctatgtgaaaatggtttgattttgttcctagcaatgttgtattcaaattgtcatgcaaaacatttattactagtttgtagtactactatttgtgagactgccccctctgaatgctgagagtggattaaagtggactttttcctcaatttctatgctctccagtttataaagaatgcctgaggttgcagctaattacctcaggcatctctattgttgttactttatatttggttcattagcacagtgatacaagttgaaccttggatgaattttcatatttgctaactgtgtttttcatttcccatcttaacttgacaagttatccgtgacacacactttgctgcatctttggcttccacttaaaatggcatttagtgtattcttgttgtttgtgcccttttatatgtcctcaatggatgtaactacctatctacatttctactattttccttcaaaaatatttttgctattaatattgttgctctagaaggttttgtttgtgaattgctcctgattagcatgcattgtcagtaagactaattgtgctgtatttgttgtgggattctaaaacattctatatctgtttaatctgcttttgataacatcggcctagcaaatacactatgcattttctattttattttgattaatgaattaatttgtaccctgctttagtcacgcctcatatggacagcatgatagctgaaagccacaactttagaaatctgcttgacttttgccttgtttgcttgaacatgatcatgagcagtctctcaagtaacactcactcttgataatagaagcagatgcctacttaacaatttagaaggcccttttatttttgtatttgtgagactatgccccctctgtatactgcatttgttggtaaatactgtgtaatttgttgcgtccgtgtgcagtggcggagccaaggcccagctaccacgggcaatggcccaggctctgcctggcacatgcagctgtgcatccatagattaacacttaattagcttgctaattacattgcttagttcactgctaggccgtatgaagcaactccacatcaacacatatgcttaacacaaacttataaagcaaatgctcatgttaaaatgatctatgaattatatagacttgtatattcttggtttgtttgttaggtttacccgagctcttaaaattttttgaatctgccactgccatgtggatatttacgtttctgattacctaggtatcttgttctgtctgttctgatagtattttgtatatcttctacattacacctagtggctttgtcagcaatcagcataattgatagtcccatttttctg

SEQ ID NO: 33273 - DNA, 1501 bp, Oryza sativa
aattgcctagtgccgttcaatgaaaagtcactctagtgctgttttccgttaaaaaaaattagtaccaattctaaatctaatgggtacttaaaaaattttaggtaccacggtagaagatcggttctgctcatggcctgctgcctgcgaaatgtaaggtcttccttttgtggctcacggcgcaggcgctgtacgttgttggatcgtagatgtcctggtcagcgagtgtggagattatgggtacctcatatccacacggcatagctatccgactagtcatagaggatagcttatatctatggaatatgtaaccgatcatgacttgggtattacgtttccttttatattatggagcggcctaaagtcctgatttgataatattataaaatagatttaggaaaccgataccgtattggttaaggtttctatattgtaatcatgccccccatcctatataaggtggggcaggaggccctctagggggcatgacacaaactgatcgtcagatcaatatacacccggcggattcaaatccccaaacaggagtagggtattacctctcatcgagagggcctgaacctgtctaaatcctttgtctccgcatccatccactttcaggtctcgtgcgctacccccttttcatattgccgaaaatttgtttcgacagttggcgcgccaggtaggggttgcgtcgagttacctgtcgacaagtgcgatggaatcaacttcatgagtcaccggcttcatcttcgcttcgggagttttttcgccgaccacttcaacatgctcctgctcttcgactcggatccaatctagccgggaagatcagtctcgacatgttcgatggattcaatttccaccgccgtcaatacctccatggaagacctcagtttaagatcaaataccatatacacatgccctgccgccgtcggaatccgatcattgccaggacgagtcccacgccaattatccgttcggcctaatttcaactcagctgcgattagccagacgcacaactcagctgcgattagccagacgcagaacgacgaaaggcagtcatctatccaatcggaatagtaatcgtgtgcgatttcgccatgtatacaatatacatgcatgtagcggagtccactgacaacagattgatctggaatcataattagcagactttgcagcacgtgtctccaattactgaagcaccagcatatatactatcgttattcccaggcagatttgtttgttttgggagcttggactttgccgccatgcataggcaacgttgtctaatatggagtaattaagattcatgcaactactacttgatttaatcaccggatggtattgatcaatccacctctgtccgagctgtacacgagtgcctgatctaaatgcacagagacacgtcgccaggaggacgagtcggcagagtcaaaccaacgagctgggcagacgtcgcatgctaccacatggatagaccggcgggagtgcgaagctgtttctccgt

SEQ ID NO: 33274 - DNA, 797 bp, Oryza sativa
cctaacccatacacgcggagcaaaaacccacgaggggtcggggtgcctcggccctcggggccgaggcgggtgtggcccgaccccctcggggggactaagaggagggcgaacacatcaccctcgggcccgacgtccctcgggggtgccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaaggcctggtgacaggtgggaccggtctccacaattgggcagaaacccaacggtcacaaaccacgcacatcggcaatggtaattcggctgtcaacaatgagcagtctcttcaagactgccacattacttgagtagcacacgaatcttgacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgcca

SEQ ID NO: 33275 - DNA, 1446 bp, Oryza sativa
cgggtgccctcagcacttgcttttttactgtagcctattagttgtattagttaaattaaatttggaaactaaaatttagtatttattttgaggcattttcatttatttagtagtattgtgtcggtgacatgggaccgggagtatcatgacttagagacttgaggcagacacgatcacccacgtggcctaaccccctcggggggtcgggcccgagggtgatacggccgcccttctctttgtctccccgaggggtcggaccgctcccgtctcggccccgagggccgaggcgccccaaccccttgtgggttttacgccgcgtatatggggtaggtaagcatagcggggctcacctaaccgcatttattgcggtttggacgagcgcgtcacgccacatgtagcgcagtatggcacgctcgtttatccggtctgtgaccggtcacagatcggtcagattgcgggttaggtggcaacaggcgatctgacacacgcctcgccccgtcccgtcaggatgagagtctctaggcactcgtccctagccggagccagcgtgctagctcctggagatggcacgttggtcctggtcagatatatgccaggctttatcccaaccattataagcaagacgttgtatgaagaagggcgaacatgcagattgctaaactgacacgtggtggacaaaggtgaccggtctgtgactggtctgacactggttatgtcgccggaagacaaccgtgttcccacgttgcacctgcttccggcggagtggaggtaggtatgggccgtcccgtcagaagggtcactcgggcagcagctgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggcccccacccaaaaagagagagaaggagaagtggtgcatgtggtatccccttgagatataaaaggagaaccttgcccacttaagagagggggctggaaggggggatgatctggagaggagatcccacgagaaaaaaaaagggagaagagggtttttagaataagagctctctggctctccagctctttgtagcttcttcatacacagatccaccagaacacaggagtagggtattacgcttctcagcggcccgaacctgtatacatcgcccgtgtcttgtgctttttccattctcgcgaactttccacagactaggagcttagaatctcacccagggcccccggccgaaccggcaaaggggggcctgcgcggtctcccggtgaggagccccacgctccgtcatctggcgcgccaggtaggggggtctgcgtgtgtttttctaagttctcgcattctttcgtgtgcgccaagcttttcctgttcagcccaa

SEQ ID NO: 33276 - DNA, 914 bp, Oryza sativa
cctgcagccccacgctggttccggctagggacgagtgcctagagactctcatcctgacgggacggggcgaggcgtgtgtcagatcgcctgttgccacctaacccgcaatctgaccgatctgtgaccggtcacagaccggataaacgagcgtgccatactgcgctacatgtggcgtgacgcgctcgtccaaaccgcaataaatgcggttaggtgagccccgctatgcttacctaccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacagtagcccccggcgttatgtcagggcgatcgccctcctcgagggaagcggtcgggcgtgacgccactttctaaggcctggtgacaggtgggccggtctaaaaatcgggacaagccggttcgtttttcctggagatatgatgatggcgcttcggtcggcgagcgtaattaacgcgcgcacgatatgttccatctcgactgccacagccgcatatccacctcatgcaccgcaaacgggcgaatgggattagtggaagcgtgggcgcgagaaacgagggggcgaaatagtgggcgcgagaaacgaggagccgggcacagcgttggcaagggtataaagtcgccgaggaagagatttgcttccttcctctcgctattattccccttgtcttcgccgcttgcgccctaactccttgtttcctgtgccctaccttcgccacacgtgctcgctctcaaacatctcttcttccggcgtca

SEQ ID NO: 33277 - DNA, 1501 bp, Oryza sativa
ctacttcctcgtccgctcagccaaacttttgactgcgcggcagtccgcgaggtcgtgaagggaggtgttgtggacgatgcaccacttgccggttgggcgctccctactgggagcgccggcctccttctttttgtcgctcgcaggcctcccctttcgggtggcccgcgaagcgccctcgacggcgaggaaatgaccctcgtcgtcggaatgggctgacctcttcttcctcctcctgtcacgccgccatgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgaggtgacactccagacgaggaggcgccctccgttgcgtgggtagcacgtcggccattacgccggcgctcgatactgatgcgggcatccggccccccacgcagatcttcccgggtcggaggcgctgacgaaggagtggcggccgaatggcgaacagcggccgccgctcgccgcgccctccgtcttgacgacgtggagccggtggtagcagtaccagaggtcttggtggcggaggaccgcccaccagtatctaggcgctgccgcgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagaggttgtgcgcctttgcttgttcggcc

SEQ ID NO: 33278 - DNA, 208 bp, Oryza sativa
taagaatccaggtcctgtaaaaaatactaagcacctagcatgctgggactccttttctttttcctataggggaattcaacttttggacaaaacatatgaatgaatagaattggcgagtgcagggccatgcttctaatcattcattatataatttgtatcatatttgagggggaaactatattgtagcttcttaagtaatcttatttaa

SEQ ID NO: 33279 - DNA, 180 bp, Oryza sativa
gttgttatcactgttttgaatagcttatagtggctttgcttcttttgttttgcatgtgagtcaagtatacatttgaatccacaattgtttttcttcatatagttgtccaatgagaatgcacagatcttgacatgaaaagttttacagtgagcttgttgaaaaatgaaaatcatgtggagc

SEQ ID NO: 33280 - DNA, 1501 bp, Oryza sativa
actacagtagtagtacagtaattaacaagcagaggaggcagtaggcatggcgtctgtggtgttgaaggatctgaacaagcggctgctgggcctctcctgctcctccgccgcctccacctccatcgtcctctccggccactcgccgccgcacctccgagacccagctcgcaccagcaacagcagcaagaagaagaagacgaaggcgaacaagagcaagcagcagctggttagccctgcaagctcgtccaggttccttctcaactcctcccggatgcaacccagcgcggatgagttgccgccgcccttcgtcatcccggttgctgtcgcggctgcggcggaggagaatgagatcgtagctgctgcagtggaaggaggaggaggagaagaggaaaagagagagtcatcgtcgcaggtggaggtggtggtcctgcgggtgtccctgcactgcaagggatgcgcggggaaggtgaagaagcacatctccaagatggagggcgtcacctccttggacatcgacatcgccaccaagaaggtcaccgtcgtcggccacgtcacgccgctgtccgtgctcactgccgtctccaagatcaagcccgcacagttctggcccatctcctcctcctcatcgcccatgcctccacgcgcttccgcttccttctgatttctcatccaccctgcttactgcttgcttcacccttaattttagattattatgtgcactagtatctgtaagtactactgtatacggaaatttataaaagccattttttttcatgaaatgtgagggggtatcaattcacagattatgaactacgagaaagttatcgatgcatcttaatagctagtgagagaaatatcatcgatacaacttacctcgtaaatgctctcaaattatacttcaacaattttcattttaaatataaaaaacttactattagcactaattacgcctaacacaactgaaccatggttggagacctatgattttgaataggatgaaacgagtgtaggtaaaaagtacagtctgacgatattttagatgatgtggaacagtagtactgtagtacaatacaaattaatatgacgttgaattagtgtgaaccgaacaaattcctactagtagctactagcatatctaacttgaaacgaaaagaaaggggaattcttcttctgtccgcccggcttaggtaggtgagtggagaagaaaaagaaaagataagttcaagttggaacttatcctggtgctagcttgtaccacgtatcattttttttcaggatctctattagtattaattaattgaagtaatcagtgggtggatggatggatgagcgcgtagtacgtgttcctgctagccactttcatattctctgctttggttagatacgatgcttcctagatacagtacttacagagattactactccttccatgtctcgcatgcatccccagagtaatcagcgcgttttttttgccttctggctatcaattacagtacatttg

SEQ ID NO: 33281 - DNA, 1501 bp, Oryza sativa
ttattttcgattattcctccggacctaaggtgtacaaattaacgagagtcggagcttcaccagaagccgccgatggtgcatagcatgtgattttttttcttttcttttcttttgcggccgggggtttgggccttgggggctactgtctacactagtccactcgtcaactgaatttgcttagcttttgattaattctagcttaatcagtgcgtgtattaattctagcttaattagctagccgtctcctggcgttgccatttgcctttcttttttcttcctttctttcaggggttaggctcgaggtgaagaaattcagggagcaattactagctagtactatatagtatatactaatgcagtgggtgcctatatatgcttacattcttaatcttgttaaaattttgtgattcattcttttttctcttgaccaacaagaagcaaccatcatcagccttttttctgctaaaaggagtgactgactgtctaactacttgctccattcagatgcagcagtaggaggagtgtctccatgttgagcatatgcacttgagatgggagaacacgtagtaagactgggagtaattaaagatgaacaagtaagtataggtgacaggaacggagcaccgactgaagagcttaccgaccgattgattgttcagttcagtgcagacaatcatcatttgatcatgatgaaccaattaatgactcaccaaattaagtaagaaagataaacccaaagtcgtcaatatgtagggtccctaaagaaaagaaaagagcagtaataagtaccaatgtcaacaaagcaaattgctcagctgatccgtgcctatttttttattatttatatatacttaaaccactgactcatactaattcgtaaacaagtaatcctgcactgcatgagtttcaaactgatgggccgaaaggtaaggtacgtgcagatgccttattcatttccgcggaggaagaaagagtggttctccttcagttgagtcaacctttactaatccaatttctacatttcgacggcgacgtacctgcagtctaattagtaaactgtagtagtgagcaaattgtactagaattttaataatccgcttgcatcattgcctagttgcctcttgtctcatctctcatctctcatcttctagttgtggtacacagtctatcaatctgcatttgactagcttgcagctagcacttggtctatgtctctctgattatttcttttactaattgtttgctaattaatgaatgtatggcggcctgattagttgtagtaattagcagagaaaaattaaaataagtgtggtagagcagcatgtatgtacgtcctgttgcgcatgtgaaggaatctgtatacgtatgtatttatgcagtgtggatgccatctcttatactgtattcatgaaacagacaataagacaaaactaaaagacccgatgttgatctcgatctgtacgtacttaattattgcatagtatatggagtacagtatata

SEQ ID NO: 33282 - DNA, 1501 bp, Oryza sativa
gtcagtaaaccacgagacaaatttattaagcctaattaatccgtcattagaaaatgtctaatgtagcaccacattgtcaaatcatggagcaattacgcttaaaagatacatctcgcaaattaatcgcaatctgtgcaattaattatttttttaacccatatttaatactttatgcaggtgttcaaacgtttgatgtgacatggtgaaaaattttggggtgggatctaagcctaaagattctcgcaacttcatgttttccatactgaatttttatagcccacttaatgaatttcacactctgttagcaaaatgggcagaactctactctaaattccaagtgctatagttcttgtcaatgatttccatcatcaactagagcggcagagacctaggagttcgggcggaagaggatttcctcgacgtcggtggaggagaactgggatttcagcaagatatgcggtcctaggggcggtggaaggttgggagtccgggaggcggaagaggatctcgacaatgacagctgctctatatgcggcgaaggcgcggaagcggatcccgtctagtcggctagttttgactggacgacaactaatgagggtgggctaaccagcggcacgtggcatcaattcaactcacctaaagcaaatgtgtaccgaggtcatggtttttttatggttgtatgttctcttcttgttttttttatggttatatgttctcttcttgttgagatgcgagtctaagtgttttaggtattcatttcgttatatataccctatgtggataatttggttatgtatatccttgttggatattgagactggattaatgaaaaatcattattttaaaagaatcatcaactagagctgcgaaacaagttctgttgaacagtagaggacaagataccataacgatttttgcagatgtaccactaaaatgaaatttaggagcacacgaagtagtattgatttcaggactacgggaattatttcagagtttagattaagtgctgaattcatagcttagattcaggaattccacaaaagttaagatttgaattaatgatttcgaaagaaaaatcagaacactaaattcagagctatagcagtgtgcatttcccctgttcaacaacaatgaaagcagcatgcatgcatgattaacagctcatctccctctacagttcatctcctagatgtaggagacaagaaaacacaataaacaggttattttgtgcaatcatcatgcgtccatctattatgatctatcccacgcacactcgccgcctttgtttgttagcgcgggcagcggggatatatggcgcccattcatgcagccaatttgttagattcatatatatcgcgcgcctctcagaataacaactccactccactgtaaaacaaacaaaatctgataaaaccagttcgttcatgcatggcagatcgaatcgaacggctgttgactttaaaacagagttttaaaaaaataaagaggacatatgcatgat

SEQ ID NO: 33283 - DNA, 1501 bp, Oryza sativa
actgtgcgggcttgatcttggagacggcagtgagcacggacagcggcgtgacgtggccgacgacggtgaccttcttggtggcgatgtcgatgtccaaggaggtgacgccctccatcttggagatgtgcttcttcaccttccccgcgcatcccttgcagtgcagggacacccgcaggaccaccacctccacctgcgacgatgactctctcttttcctcttctcctcctcctccttccactgcagcagctacgatctcattctcctccgccgcagccgcgacagcaaccgggatgacgaagggcggcggcaactcatccgcgctgggttgcatccgggaggagttgagaaggaacctggacgagcttgcagggctaaccagctgctgcttgctcttgttcgccttcgtcttcttcttcttgctgctgttgctggtgcgagctgggtctcggaggtgcggcggcgagtggccggagaggacgatggaggtggaggcggcggaggagcaggagaggcccagcagccgcttgttcagatccttcaacaccacagacgccatgcctactgcctcctctgcttgttaattactgtactactactgtagtttgctgctgattttgctttgctctcgcatcgcgcgcgcgtgcctcttcttgcttgctgattgctgctgcttcttttaaactccccaccccagcagcagcgacttcagcataggcccaccaaacgaacctttgctttgcttctctgcccctgcccccactgtgctgtccatttcttattcgttttaattttagctaccacagtatactgcgctagtgttttactcctatataaacatcatcttttgtacttacctatatactgtactccatatactatgcaataattaagtacgtacagatcgagatcaacatcgggtcttttagttttgtcttattgtctgtttcatgaatacagtataagagatggcatccacactgcataaatacatacgtatacagattccttcacatgcgcaacaggacgtacatacatgctgctctaccacacttattttaatttttctctgctaattactacaactaatcaggccgccatacattcattaattagcaaacaattagtaaaagaaataatcagagagacatagaccaagtgctagctgcaagctagtcaaatgcagattgatagactgtgtaccacaactagaagatgagagatgagagatgagacaagaggcaactaggcaatgatgcaagcggattattaaaattctagtacaatttgctcactactacagtttactaattagactgcaggtacgtcgccgtcgaaatgtagaaattggattagtaaaggttgactcaactgaaggagaaccactctttcttcctccgcggaaatgaataaggcatctgcacgtaccttacctttcggcccatcagtttgaaactcatgcagtgcaggattacttgtttacgaattagtatgagtcagtggt

SEQ ID NO: 33284 - DNA, 1501 bp, Oryza sativa
tttatcatcttaattactttctcggatttaatgcgtgacttcattcttccatacaagattggctacatggacatcgagaaatgtaaatattaatgaatcacttatttacgagaaataacccgtagtatgtttaaataaatgacaagtagaattacttatcttttatttgtgtgctaatataaaatataactataaaaatagatagagggagtactacatgaccctgcaaattccatggatgagctctcacaaccacaacacgagcctccatttcattattatagccagacggtcagataaattattgaatccagagagagcatgcagccacgtcacggtcggcgcctcagaagcgaccctggccaaccgtttgtcctcgtggcgcgtccctactggccaggaggcccggcctatcagcaaggacaacggctgggcggcacacatcgccttcttcctttgtttctactccctcccctcctctcactcatcgttttctataatggacgattcctttctaaaagaaaaaaaaatacttcagttattatttattttacaggttggtactctcctatattagtccaaacaatttctctagctccgtatgaatgcatttcttttctaaaatttctgagcatcttttgcttagtacagtatattataagggagtggttatacattatttgatatattttacagaaaacttttaaatgtaaatatagtaaaaataactatattccaattacaacatatagagcaatttatatgtagttcgtatgttattgaattaactcgagtgtggcctggtggctaagagcgaatgcatccgctcacgacgatgagggtttaaatcctagcttcaggtacctgcttgtttttcgtagtcaagtttcccttccttttcataaggaaaattgcttttgagatcttttattttcggacgatgtatcatggatttacttcatgtgaactctgtctttaatctataatattatattgagttttcaaaaaaaaaagaggtacctgcttagtggtttttttttctcacatggcacaaatctcaagacgacccaacggatgagaaaaaaaatgcaatgttatatataacgatactctcagccaggttctggaagaagttttgtttggacgtttttttattccttctggataggcatctagtctcagaaaatctctgaaatacaaataaaaaaaatcatagaacacgtccttatccatggaactgtctgcaacttttgttattgatgacaaaaataggcgcgcaaagggcggtgaagaaactaattaataaaatgaaatatggatgccttatgcatggctttggcttggtttggtttggtttgaagaggtcatatatgaatcactcactctccctccttccctatatatagtagtacaaagatgggagagagtgtggaggggagcaatataatagccgcgcttagcgtaactagacgaacgtactagcagaagaagaagaagaaaa

SEQ ID NO: 33285 - DNA, 1304 bp, Oryza sativa
atgcaacagtgtgcaatccctttctaaaagaatatttatacgcgaaaaaaaatctatacatagaaactttatacatagatattttatagatataaactttatgcatagaaaatttctgcatataaattttgtacctataaactttgcacatataaatttcaacgaattaaaaaacaatttgcaaaaaccttatattaagatcattaaggcccatatgcccatcagatgtgcttgtgttcacgatttcacgtgtaccagcgttttcgttttccacgtgagagcaggcaggccgtggggtgaacagaaaaggaaaatcatgcgtgaccctagaaatggaaatccggattcgttcgctgatctcgctacccgcgaacgttcacgcattaattagcttttctgatcatctgtgttaatgacatatgggctaagtgggacccacatgtcagtgactcaaggttctgcttacgtcctgtgtcctgtttagagagcccaaaattatcgaaagcaaaaacagctagtgagtagttaacctatataaccgattcatgcatcccttttactctttccgtcaaatcatcctcatcttcttcatatatatgatagtgttcctataagcactggcacagtagactagagtagtgtggaagccttcgtaggcacagtgtcacttctatctctatatcgccatctccgccaatgagttgtcgtcgttgcctccgaatactagcctcatggttagcagttaagaaaatccatccttgccctctacatttggtggttattacgtacttggcggttggccaacaaaatatattgtcttgatggttttgatgctatctttgaccctttttggctaccaagaaaattctggtttcttgtagtgagcctcgaaaaaacttaagtaacgatatcaacggcagactttaaaaacgaggctccaaatcaccgcctctataggcttgctatcggcccagatcgctgtctgcgctgacgtgttgtcgccgctacctttgcaagctagctgtcactagggtttaatatttcattttcggcatttgtatcgggggtgcgatataccaaaattttggtctgaaattatttgaatttttgaacaaaatttgatcaaatttaaacaaaatattgtcaaattcataaaataatgaaaaattttcaaaattttagccgaaatattatcgtatcggggggaggggggaatccgatagaatcgaaatttcattcaggaattttgaagccgtggcacgagattctacctccacggctttgtctttcgtttattggcgaga

SEQ ID NO: 33286 - DNA, 1501 bp, Oryza sativa
cggtgttggtggcaagggcaaagctagtttatgggcagctgttgtgatggatccgatgacggggagacaccagcttgagtaggagagggaggaaagggagggaggtaagggggagaagccagccggtggggctcgccgcgccgttgacgccttcccgcaagccattgaggctaggtggcggcagcggcatcaagtactcaagctcgtgtcgtggggccgctaagggggagaggagatgaggaatggtaggttatgtttcattaggtaggtgcacacaaatattaaagcaatatgacggttgaaaaattgtgagattttttaggggttctttttgtcaaatactacatagacagtccaaaaaagggtgcatctaaaattatacccatagttttttttaaaaaaaaattgtcaaacataattacaatataacttgcatgtaattatagtataattacaaggtaattaaagtgtaatttcaattcaaatcagaaaatgttcattccttagttggtccaggcgtgtggtgcgtgaaatatgtgtgaaatcgataaaaactatcgatggtttttagcttttccatcaaaataatttaaaaagaattgagaagatagattagtatgagacatatcactccgtacacatgtaactttaaattttttaaattttttatgactatttagatgacatgatggaaatatgttttcagtcaaaaaaaaaagaatggacaagataaattaacgagacatatatatatatgactctacgtacaaatatatagttcaatttttaaaaattgtttttatgacaaaaaagcgagggatatctctcgatgaatgaaaatccatctcctaaacataatactatatcagtggaagctgacgcaagatacacaaacatatgatatgtctctccatgcgtgcccatctgtcatatatactccaccattacattgatcggagtcgtcacaacctttttttttttttgacaaagcgtcgtcacaattatattcactgcgatagatgtcactatcgtgccctacgacgtcatatatatgtggacattttaaagatttaattaattagcaccatccatcatcgtcagtgatggccgatttggattagaggaccgtctatattctgatattcaccgttaattaaaatgatgaaaagaatagtatacatgaatcatcgatgatgattacttcctccgttttctaatatatgacgctattaatttttaacattattcaaaaggttctataaacacaaaatataagttatgcttaaaaaaaacttttagataaattttactagaggatactaaaatttgatgtaattttacagtatgagaaaatgtccgttcaaggaagcccaataagcagcccaggaggggagacctttagggccagtgggccggtaggttgggccaaaagactagtattacccttataaacatacatgtcacaaagacggttgtgtaaactcactaacagtaccttaga

SEQ ID NO: 33287 - DNA, 235 bp, Oryza sativa
aagtttataggctcaaaatttatatgcagaaattttctatgcataaagtttatatctataaaatatctatgtataaagtttctatgtatagattttttttcgcgtataaatattcttttagaaagggattgcacactgttgcattgtttaaatttgtatgtacaaaatttacatgaaaaaaatttacatgtacaaactttctttgtatatagtttacatatgtgaagtatatagt

SEQ ID NO: 33288 - DNA, 1501 bp, Oryza sativa
agcgccgcaccccgctcctccgacgagccgacctaaccgcgcctccccaactccaatgagaacgacatggatgccggcagcgaggaggcgaagcaggagcagcaccgggtgctagcccacaagctcttcctcctctcccaccccgacctcaacgacctcgccaaggttgccctccgctccgacgccctcgacgccgtcaagtccgatggcatggcgctgctatttgagtcgttggccgtcaacggcgtgctggagccggatgacgcgctgctcgtcgagatgcgcgtgcgaatcgatgaggaggtcccccaagccatcgtcgtccgcgcctagctcctcccccgccacccacgcccgccgcaccgaccggccgtgcccagctgcttccccggcggccaacgattcgatccaatccggcgagagagaaagggagaggatgttgctggggtcggcggcgcttcttttctttcttctatcctcttctcttctagtcgccggcagcagatggggagaggcagccgttgtcgcctccgcgcctctcggccttgtcggcagcggcggcgtcgtcctccaccgttgttgccctcctcacgaaggcctcggtggctgacgctgcggctggtgcccgccgccgctccgccggccaccgccctttttccgcgcggcctcgagcgcgtgtgtcgttgtcgggtgcagcgacgtaggtggaggcggaggctgacgctgcggctggtgcccactgtcccttctctgcccagcctcgcgcctgtgcgccatcgtcgtcatcggtgcggtggtggagcttggtcatcgacgtgccccgcctcgcccgcacagagaagacagagagaggaggaagggagagaggggaaaagagaggtgacgacgtgtcacctgacaagtgggtccacgcttactcagctgccacctagaccaaaaccggggtcaaaaccacagaaggacctcgggtgactggttttgtagagtcaaaggaccccgcatatctggttttgtggttcgatgatgttttttaatcccgatgacaagttaagggaccttcggtgtactttttcctaaaaggaaacctgcattactccagtatacgtaaagtaaagagtcgcttcccctggctccaagcctccaacaccaccatctttgtttcattaaaaaaaaaacagcaccatatatattctcaggcatcaataagatcatccacagttaaatcccccacaatccattccatgaagacctacatactcctttctcatgcctttcttttcttttaacaaaggaaaaggataatcaattggaatacatgttatcgccatgccatcaattcctcctaattcatcgacggaacaaaggcgaaaaataaccaaagtcttaattttgatgcattcgattgctggctggtacgttgtggttggtaagctgagtgctagtacgaagcatcatttgctatgcgtcggtactcaggcatgtgctgggtgacaatcatctg

SEQ ID NO: 33289 - DNA, 1501 bp, Oryza sativa
ccgtcgttttgtgggttctccatgtctacccactcgatgaagttgcacattggacgatatgtctgcgtaagatgttacaattgtgtacgaagaagttagtttttttatccatttgaactttgaatagatgaatcatacctgatcaaagttcgcacattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattctcgttagttgtgtgctagttggaaagaagatatgaagaggttgccttcagattgtcaattatatagcatcgttttcagtgcaatatatgtgcactcaatgagatacattattcattagatgtgacaagacgagcacgcgcgggcgtgattcactttatgtcagcaggcagcgccgaaagttgatagtgactactcgagctgccgcttttcatgtgtgccgtgctggactgtgcgcgctactggatctgacactaccgtgaagcgccgaaagtgtgttgtcgtgagcataagttgttctagcaccatatgaatgaaaagaactatgtaggcgagagaaacacaagtagtactgcagtagtaatagcaaaagtagtattgctttacaagtttgtaagccaaaagaaacggtcacataaggactgaagaggtagaacactactgacgagacctcttacccctgtccctcctaccctgcgccctaacgtgcccctgggagtacgtgagtcggtccggtggtatggcacggccaacccgtcctgcctgtacaggtgtgacctctggctgctcctgagtgtgcacctctggagctcctccaagctgagaggagcctagtacgttgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagcatttcagtaattacccacatattaaattaatcattaaatggtctgtttttaatattgttaaatactttgggtgtccaagtatgttcaagatttttcttggaattatttgagcataggaagtatttttaaaaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctcg

SEQ ID NO: 33290 - DNA, 1501 bp, Oryza sativa
cgtctcgtcgtcctctacgtgttcatgtcctccaaagtcgcagccgaccatccaatctccggcgaggtcgccatcttggtccggccattgatgaggtcatcatcatgacgtcatcattgtttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtctttttctttgttttgcgtgttagcttgtcgtttccgtcgttgcgaaggttcgtgagtgcgccggaagtattcaagaagattaattgaagatcgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgtgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaa

SEQ ID NO: 33291 - DNA, 1501 bp, Oryza sativa
ttgaaattacactttaattaccttgtaattatactataattacatgcaagttatattgtaattatgtttgacaatttttttttaaaaaaaactatgggtataattttagatgcacccttttttggactgtctatgtagtatttgacaaaaagaacccctaaaaaatctcacaatttttcaaccgtcatattgctttaatatttgtgtgcacctacctaatgaaacataacctaccattcctcatctcctctcccccttagcggccccacgacacgagcttgagtacttgatgccgctgccgccacctagcctcaatggcttgcgggaaggcgtcaacggcgcggcgagccccaccggctggcttctcccccttacctccctccctttcctccctctcctactcaagctggtgtctccccgtcatcggatccatcacaacagctgcccataaactagctttgcccttgccaccaacaccggcccatcaccctcctccatccccatggctccagtgccgccgccaccacctcatcatctgcccgtgtccaccgcccaccgtcggcccgcgtcatccctctaagctcagtgatctccctcctcttcccctagccccccctctcctcatccaaccctcaccctaacacgggaccctaaaccttaactcttctaccttcgttggggttgctgaagctggcggagctagggaagaaggtgttgtcagagcttgaggaggagaactgggatcgccggagcatgaatcataaagcaagtatcaaggttagtaatttgtaagattttggctccccaaatctatcgtcagctatttagctattttttattgattattttaaggtgacatgaggatatggtgagagggatgaaaatactttcccttaaatgtatcgatcgatggctaggaaatatgaagtattttctctatctcaaaataagttaatttagtatgggatgcgacatctgttagtactacttcctctgtcaaaactaacctcatattaggatgtaaacatttgtatgtccagatttgttgcactagtatgtatgacgttgactgtttttttaaggacggagggggtacgtactactagctagctagatgccgacggatgatgatggattggaaaggcaagtaagctggagtaggtggtactagctagctaggtgtgccacgcactcgcactgcacggagtagtactgctgctgcagagaggcgcacgacgactataaaaggagagtgcaggtatcttcctatagtagctagctaattgtattatactagcttgcttgttcaattcaatcgagcagtagctaattgcatagtgatcgatcgatctgtatagatggtggtggccggcaagaagcagggacggcattctttttctgcatcatcatcgtcgtcttcgtcttcttcttgttcagtagtgcagctgggtcatcatcagcgcccacagggtgaggaccctctcatcggcatcaaagcagc

SEQ ID NO: 33292 - DNA, 1501 bp, Oryza sativa
aatgcaaaaacattatcattcatgtcatagagacgacgagaaaaagaaaaatagcaaacaacctccatcaccggcggactccaccctatcctctgcggctagtcacatggagcacgatatacaaatgtaggacctgtgcagcccatcaattcaaataaggtaatattggatattgcacgttaatttaattggcaaaaagaaattggggctttacgcgtgaaggtgtaggagagtatgcagatgcaaatcgaaatgtcattttcttacttgcttcttctgtcaatgtcgccgacatggagcaaccactggttgttgctcttggcccaggtgaacacatccttattggaaaaatagaatatatactgaaagtaaggaagttgtttttattgaagtaaatcatttactctgataatggtgggagcatgatgatgagacatagggtgggatcgaaagtaggaaagttgtttttatcgaagtaaatcgtttactccgataatggtgcgagtgaggataatatgatgtagggttaggtgggcctgtgctgatatacgtttggctagtagtatctctataatagttaactaataagttgaccaataggaaatatttttgactgaccttaatctttattaaaaggaaagtttgatatggagagtactaatatgtactccctccgtccaaaaaaaatcaattcctagcatcccaaggtagtattagtggagagtggaaatgactataatgcccttaattattgaaaaaaagtagtaagagtgatatatataaagggtattgaagaaataaaacttctcgttttacgtgctgagtgtaggtaagatggtagaagttggtttttttgataaaatttaaactctagaagttgagtttttcgagggtaggtaggatggtagaagattttttttttataaaattcaaactctataatttgaattttttttgacgaagggagtactcatctcgttccataaaaaatagtataggatatgacatatcatagtactataaatctagatatacatatgtccagatttacagtattagcatatatcatatctcgttatttattttttttatgggacagagagtatttcattgtttacacataaatatccgtgaaatcctctttggaagaatgtccgcataagcaaaattcagcattcaccattgatgtgacggatcaagttgttaaaaaaaaaaagaagaaaaaaccatgtgcgcgcgtttgagagacgaaagccgagccgagcaagctgatacggataggcagccgctgatcgaaccgcgcatatgcccattgtttgtttgtttatccgtcgtaatctctcgcttacaaaaatatctcccttctccgcatcactcactactcaactagcactactactagtaagcaagcagcagataagcatcactccctcccactccaaccaccacatcagcatcagcaagcagcagcagcagaagcagatcgatcgatcgatcgcca

SEQ ID NO: 33293 - DNA, 407 bp, Oryza sativa
acagcagttaagtcagaggacctgcttccctcattaacatatacttgctgatgcccacaggtgtattcggtattgagggttgagaaccctctctcagaataaacgaatcaatagattagcatataattaattaagtactaatttaaaaaaatagaattagattaatatattattttttaaaaaaatatattgtttatcagtctagaaagtgtgcacgcaaaaaataaaggagtggtggttgggaagagggagtatagaacagatactattgagcttattggctcaccagcaatctactaagctctatggaacattacacggacatttgagtgagttttttctctacgggttacaaatccctaatctaaaactggtttgtaatgtgaagcaaaatgctcccccaaaca

SEQ ID NO: 33294 - DNA, 960 bp, Oryza sativa
atggaccccctaatgacggtggtatttatgtgccaagttgacttgtacaataacatttcctgaaagttctatttgtcgatgatattttttaataataaagcattttcaattatatttgttggattttcttagatagataaacatacagtagagagtccatgtcgtctatcaatagcattggataaggagaagctcctctaatgtatagtcgtctgacgtaggttgttgatatatgagctcacgagcaggctcacatgttagtttattgaagctataagttactccctccgtttcatattttaagttattttatttttttagtcaaaattatttaggtttgactaagtttatagaaaaaatgagcaacatttataacactatattagttttattaaatttagcattgaatatttttttgataatatgtttgttttatattgaaaattttagtaattttttttataaaaaaagtaaaacgagttataatataagtggaagggataagttagaagattgtttatcgttggtagcagcatagcgaggggtagctgagattatgtgccctgggtccctggcattgttcgtgtaggggcaaaagtggaatgtcatgttgctactactagtatgctattgtcctgttgcaattgcacaaaagaaggccatgcagtttaggccctgtttagggtctgtcttgatcccttggcaagtctttcccctcgcaagtttttccaccctatcatatcgaatgtttggatacatgtatgaagtattaaatatagaaaaaaactaattacacagattacatgtaaattgcgaaagaacgaattcttttaagcttaattgctccatgatttgataatgtgatgttacattaaatatttgctaatgatggattaattatgcttaataaattcgtctcgtagtttatagacagattctgtaattcgttttgttattaga

SEQ ID NO: 33295 - DNA, 447 bp, Oryza sativa
tgcacatgcaggggagtgtgcagtactgcaggggatctcaattgcacaccaccaccatcaccacctccaccagtgtctgcttgtgtaggctgtaatatatacaggctgggaggatattaggatttgggtgagtcagtagtttgcaattctgtaggtacctctttaattttctaagcatgatatttctttcgaaggatgaaagattttgtttcaattaattaaaaaaatatttttaacaagaacttaattttgctattttaacaatccgttgcaacacacaggttttcggctagtagatataaattaaataacatggtaaatgaacttaataacaatatcttagaactagggatttgagcaatacttacataatttttttaagggagcattactcaattggctagttttcttgtgttgtaaccagccctctcgggttcaaattctaga

SEQ ID NO: 33296 - DNA, 899 bp, Oryza sativa
aatatctttagtcccggttgttctcaacaaccgggagtaaatatcttttcccgctatttcgaaattctttttaaacccggttagggttaagaaccgggactaaaaattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 33297 - DNA, 603 bp, Oryza sativa
aaactgttgtgaaatatgtaaaactatatgtatatgtaaaagtatatttaataatgaatcaaatgatatggaaagcattaatatttatttaaatttttcaaataagacgaatggtaaaacaagtttaaaaaagtcaacggcgtcagaagaagggagtaggaacttgtattaattaaccaatatagtgcggatcagttccaacgataggtttaccaatggagaaattttacggttattaaaagacaccaaaataattaagtgtaattaaattcgaaattgcggtaccgctcgtcgtcgccttaagatagtaaaattactaaaattaatggaggtcaggagcttgttaaccgtgaacctgcagactcgatcaaaccaggtacagattggattgcgcttgatgattgttttacatatataagtaagccgtgccattagcactgtatttacaaagactaatcgaaaatgtaatagtaactacgaacaattttgatagttcagtgttagatagttacagtgttacacccttttcctgatggaactttgttaggcagccacaatataatctagaataaacaacaggagggataattataaaggtagtac

SEQ ID NO: 33298 - DNA, 1501 bp, Oryza sativa
aaatgtctttcttcgatcacatccttcagatcgagattcgagggtgtagatcgagcgagtgcacgagtgcaccgaagtgcctgagtgcacagaatacgttgccgtactattaagagggatatcacatgcatataattggtcaagtactagtgctcaaaatgtttcatccttgtgtgagttgaaagggattcaagatctcttgaagattttagaccatgttttatgttggggttgatagcccataaaactagctttccataaatattacggcttgtttggcaacttgagggaaggggattgggagtttacacgaggaaattgatggtgagattaagatgggaatttgatttttcatcccagtctcttgtttggtagaggtggtggaaattgatagggagtttagttggagattagatcattaatgaaaacggatggctgagatttgtttaggcgaagtaaaagaggaattccctcccaattacctgcccctacccaggtattgaaaaggagagaattcattcctcaattccccatccccatcccaccaaaattgccatgtcccctaaccaaacaaaacagttaatagcctcatccctttaaactcccaatccctcctagaaactcccttcaaccaaacagactgttatagaaaatatttaaatcaaagaagcattcacaatacattacaatccaaaaacaatgttgcatgtacagttatatttaattacccatcaaatcgtattcttaatggttgcgtagagcctcacacactatatataaaacgtttccaaatgaatcatctatcacataatggaaatatattgtagtatacaagcccatgaatttaccgtagcctcatgtcccataaaatccatttattaataaacaatgagaatatataccaatcttacttccttatagataaatttttcttttaaaaaaattgacacatagggtgtaatgttgtcattatttatcatatcataaatttgaactaaaaataatatctgtatgaaataaaaaaaagaaaatgtcaatagggtgtaaacgaactgtcacataccacaagtttggatgtatggaaaacatggaaatgatggatgaagtaaaatgaataaaatttttgcctaaaaattttatgtttaattgcttttgcattttgagatgttttgcatatgcattataggagcatatttattcttaagtaaaactaatgagcttaagaaaaatatttgtaacaactcaaaaatctggggaaaatctatgtaaacttctaactaaccttagaaaacaaatgtaaattttagttcgatttatcaagtcattagatggaccaagcaactctccaaacacaggattttgacagattctctggagcacacattgacaccttgccaaaattcgaccttggactcctaggctgtaagacttgatccaacctgtagagtaaacattgttttacaactttgccactggtcactaacccaaattctgcctggaa

SEQ ID NO: 33299 - DNA, 1501 bp, Oryza sativa
agcgatccaagagatcgaagcgatgcagccttgaacaacaccaacatagccggtagattcgccagcgccagcggcggaacgtagaacttaccccttcgccggagatcgaactgaaccgatgcagccccgcgtcaggtgccaaattctgccggatgataagtaaaaacctcacgaaagagggtggcgatgcgccgagagtagttatattgatcgagagagatatcttacaatgaccccagggtacatatttatacccatggggagatactagtccttgtaggacaagaaagaaactctcctaaagataaaaggaaaacataaagtccttagaggacactaaacacactttcctaaagataaaaggaactaacaaacttatcctaattaatagatatacttgccatgccgtatcctccttaaactcggactctctagataaatttcctttaattgatccgactctaccaagaacacaactgctggcgatttcacaactcccatcggccgattctaagactctgaagccgatactgactctaggccgatgatgacttcgggcataccaaattttggcattaacaacccattaattggatctatctaaaagaacaaaaactcccaaactctccctttgccataagtacatacacatatctcctctcctgtccaatttcctcctctgtaatttttctatttttaaataacaacataatataaaccaaccaataattagatagctaaataattataatttaaaaagttatatatgattttaattttttaactgttgttttatttataattaaacaaataattcaagatccatattaaccatacttgtcgttattaaaaaaataaaatacatcacttgaacatagcccctatcctttacatgtcaatcaataataataattacaaaaaaaacatgatgtaaagcactcataagtcaccatgtctaaaaaattagaaaaaaaaccttagaaatttcaaagaaaaaaagtaaaaatatttgaccaattattttcaaccattagatttacttctggaacaaattgtaattaacttttttataatttggaacccaaatattttcttgcgcaaatatgcgtgacggaatgcaatagaagtcggtagatatatagtacgtagaccaaactcagggagttaagaataatgcatatacagagtgggagaaggcacaatgtgcttagctttgccttaactttttagccgtagggtgtattaaataggaacaaacaatatatatactagaatgcaaaaaaattaaaataatttatttggtcgttggaacataaagactttctagggtctctttttaaaattttatggtagttggatcggatatgcattgtgggctttacaaaaagcattatgtaatttaattctaattaattcataccaagtaaaggctagctaaaacaaatacagagtgattggtttcgatctcacaattcctaacatttaataagaaattttatag

SEQ ID NO: 33300 - DNA, 1501 bp, Oryza sativa
agctgagtcacagtctcgatcatccgcataatgtgaggggcatagaccaaccccttcttgtactgaattgaagccatgcggatctcctcccacacaaagtgatagacatggaagcgatgaggaggaggatcaaaccggagaagcatggtcctagagagatggttcatgctgctagcatcaccatcgttaggcacaaaagaccggcgaaacatccggttcaaataggcaaagtatagcttgaggccgtcgaccttgcccaacaccacatttggatcatttcgagtgtaacggggaagcaagtctgtgttggcaggaatttgaagattatgaaggtcatcaaggtttagcaaagaacgaagacggaagccccagatctcagccaactgctgataagaaacagagtaccaggacccctgagtcatccagtgcatggcacgatagcgatcaaagtatacggtggcataaaactgagcaatgatctcgttgcaccaattttgctgcaatgtcatgaaggagcggatacccatgagatcacaattggcaatcacagagttgatcaccggatcgttgtgtgcctgcaactcctcccaattgatccattgcatgggaacagtgggatgagctttggacttaattacagactcataaaagtcttgttgaaagagagtccaaaaccgcggatccgtggcggtgcggcgaagggagcgcggatcctgtcacgccctgaactagtcccgaccggaactagcccgtgacgctccaaattaacctgttaatcgataccagtcccaggaaacagtgctggtatcacaggaagacagaatatcacagcaccagaggtctctttattatagagtaggagtacagtcatgttgggctacggacagatcccgagctcacaactgcattacaaaaggggaacggaagccaggacttggaccaaacatcacaggcacttgggaactaggccgaaaccctaaaactcatcgtagccggcttgctcctagaagaactcctcgtcagcgggatccgcttcatcttcttcaacaactggggggattatttatatagagcaagggtgagtacgggagtactcagcaagccatgggaaataagtgtttaatgcaggcttcaaagaaaggctgttgtttttgcaattgattttatttaaactcttttctgaaacaactaagtgagtgcttctcaaacgacacggatgagacagtgcgtctcgtccggtcggagtatgtgcaatgtttcagtattttgaatcgatcaagattggcacccggccaacagctttcaaacggccacccgggcctggctgatcccatcagtcgcagattttccaaacatcaaacccattccacaacagcaaatttcacaaggcagtagtcaaacaaaactacgctaggaatcacctcacatccgcccatgaccgtgagcacggctattcgaacagttttaataacctctgcagaaggggtacactttacccaca

SEQ ID NO: 33301 - DNA, 1501 bp, Oryza sativa
atcattatctctctcgggtccaccggtcagtgactatacttttgcgcataagtccctggttctcgggaaatagatccagcagaccctgagcacgtgttccaggattttattcaaaacggtacttgagttttaagttatttactcgttagtacacaaccccacatgtaagtgtctaaatgattttcttaaacaccctggaagttttaaaagattgcaaggttaggcccttgctcttgacggagcagaggggcagctctcccgcgagcttccccacattgccggcggcgaacggcggcgattcagttcgagctcccaaaacaaaaagtgtagaggacaaccgtacgaacctatcggtagctttcttgcaagatttggtgctctatagcggctgttaaggtgttagaggtggcggctagcttttttgtatggtaaggactctagggactactaggaagctcaccaagcaacgcgaggtcttggcgatggagagctggtcgggcggcggcgcagcggcttcggtatcgtcggcgatgcaccttcgggcttgatctgttcaaagcgattttagatggcacaagatagctctaggcttaaaagaatgcgccgaagctcaccagagaaggaggaaaaaggaaaatggcgtcggcggccagagttgcggatgaaaaaggggatctcccgccgaggtccaactcagatcgattcctttgggattcttgatccactactaaaaaaatgatttttcatggcgtttggaaaatatttttcatggcggctaagtgaaaaaccgccagcgcagaaaatcgcgggggtcgggggtcacgggccgccagcggaaacacaacttcgctagcggtcgccttaagccggccgccaacgaatatatggtattttcactggcggccctcttaacttgacgccagcgaaaatcgtcattttcgctggcggtaggttaagaaaaccgccagcaaaaatagcctatttttgctagcggagttgttaccattttcgctggcggataatggagagcgcaagataaaaaatcaagccattaagaaatcaccgcgcgcatccacctacccgtccttatcctctctcctcctccctcctccctccatatctagccctctcttccttcctagtccctccaaatccaacacctcctccctcggatccacaggcggcagcactcgcgagcgatcggaggagagggcggcggcgagcttggggcgcgggcggcatgctcgggcgtgggcgatagcgctcgggtgcgggcgacgcaggagagtgcggcggcgagctcggggcgtgggtggcgaggtcgggcgtgggcggcggcgctcgggcacgggtgacggaggagaggacggcacgaggtcaggcgtaggcggcccgggcggcggcgctcggcgacagggaggcgcgaggcaccggatccggcgacggggaggtgcgaggcggcggatccggcgacggaaaggcgcgaggcggtggatccggc

SEQ ID NO: 33302 - DNA, 1501 bp, Oryza sativa
aaatctaatggttgaaaataattggtcaaatatttttactttttttctttgaaatttctaaggttttttttctaattttttagacatggtgacttatgagtgctttacatcatgttttttttgtaattattattattgattgacatgtaaaggataggggctatgttcaagtgatgtattttatttttttaataacgacaagtatggttaatatggatcttgaattatttgtttaattataaataaaacaacagttaaaaaattaaaatcatatataactttttaaattataattatttagctatctaattattggttggtttatattatgttgttatttaaaaatagaaaaattacagaggaggaaattggacaggagaggagatatgtgtatgtacttatggcaaagggagagtttgggagtttttgttcttttagatagatccaattaatgggttgttaatgccaaaatttggtatgcccgaagtcatcatcggcctagagtcagtatcggcttcagagtcttagaatcggccgatgggagttgtgaaatcgccagcagttgtgttcttggtagagtcggatcaattaaaggaaatttatctagagagtccgagtttaaggaggatacggcatggcaagtatatctattaattaggataagtttgttagttccttttatctttaggaaagtgtgtttagtgtcctctaaggactttatgttttccttttatctttaggagagtttctttcttgtcctacaaggactagtatctccccatgggtataaatatgtaccctggggtcattgtaagatatctctctcgatcaatataactactctcggcgcatcgccaccctctttcgtgaggtttttacttatcatccggcagaatttggcacctgacgcggggctgcatcggttcagttcgatctccggcgaaggggtaagttctacgttccgccgctggcgctggcgaatctaccggctatgttggtgttgttcaaggctgcatcgcttcgatctcttggatcgctctggtttggttgatatatttgcctacctgatatctcaattctatctctaattgcattgtgtttagagacgcatcggtttagctgggactgtctcagttaggtccgatcttctgtcttagccgatatatctttacaatcacaatggtgttctaaatagattttttatatccatcacattagacagatctatcggctcatcgggtattagattatcatatacaatctcgtgctgtatcggttagattcgacctactagattgttcttgataatataaatcttgttaagccgataggttcatgctagtgttttatcggggtgctagccgataagttagatttagccgatgacaacaaatactttattgatttatctaatattgtggattttatgacatcggacctccagccgatgtatgctttaaccttcggatcaatacttgttctattatatcatattgttagc

SEQ ID NO: 33303 - DNA, 306 bp, Oryza sativa
ggggagatttaaagtgcatctaggcccctaatgatgttggtgattaattacaatgcaattagagaggactaacatttttatgtaagcaaatgtgaaggttgttatgtcctcaatgagttagcgtaatgcatatcccgccgaatacgttgatgtgatgtgatgcggcaaatgagcaaatggtatgttgtacgttttcgttttcttgagttattaggaaagccgcactattaagagggatgatgcattgacttacgaggagtgatcaaagtgctgaaaatcttttttaaaaaagtgtttctcctcagt

SEQ ID NO: 33304 - DNA, 1501 bp, Oryza sativa
ctactatgtaccagttatgaaaaccggcacctatgcaaggttctcaaccgaccggtttagtttcccgtagtagtgaaaatacttgattgattcgatgagttaatggttggctgttgattaatatgatagacccggtctctaggtatggggtgtcatgagctcatagcttggccactcacctctcacccttccaatgggtgcttccgtctctaccttggttatttcctagtttattactcgttcatgtgatgccgtcctctatttattccttaccacatattataattatgtcggtcgccttctcatatactatggtcatagggcgcatcattaagaaggctctaccctctaccgtgccgtcctcttcaagtcagctccacactttcctggttaggaacacacaaacaacggtgtcaatacttcaggtttgccattcacgtatgaatgagtgttactatattttaggatgaaaggagtatatatttttcgtgaataatatatctcaacttccttcgaggaaaagcgcggaataagggtatgatagtaaagattgaggatgatcgcgatggcatatgcattttccaaaattcttctcttcgctgagatggcacgatcagccatataccttttcagaactaaaaagtcaggtgaaatattatctaaaaagaaaagtctggtgaaattcactttaactagcaacctagctatatatactaccgggaaagcagataaaggttctcccatactgatcaaacgcgcgttttgaattaattgagacagtacagtctaacttaatccatttttaactgttggtcgctcgctctcaaacacagacgagaggcacgagagaaatgcacaccagctgctgctgctcatcagtccaagtcgatgatcatgtgtactgtatcctcgatctgcaaggcatctacagtttttcctaattattaattcgttctttccccatctttgtcacctaacactaccatcttttttttctcttctggaatcggatgccatatgtgacatatcccatcatgccgtgttaactctgccaagtgtcatgtgtgtctttgttgataacatggcagacacatgcatgctttggacgcgtaatggagtctaccaacactaggttgtactcctttcttcctttttcttacttattttttggtgcatccaacccaacaaagccacatatttcatctcaatttattttaattatatatctcttttaaattattaggggtagcttacttcatgcataatttattaataaatatactagagtggctatctatagcgtactatcgtggatttatcaacgcgcggctccatcttttaagttaggcagcgaaatgagaataactcaactggttaggttaatggtggtgtaacatgtctactaaaaatttaagtcatagacttgacacagttacacatatttatgactaattattttttcagtaatagacggcgtccatcaccaacaacgtgcttacgg

SEQ ID NO: 33305 - DNA, 1501 bp, Oryza sativa
aaaccctggtagtaaggacctgtaatggggctataaatagtcccctagggctatctaatggggggatcccaaggaaaattcaaaatttagtacacttcattttcccaaccactgttgagtaaccacatccttcgacgtatatagttgtcgtttcgacaacacggtctaaccgagagattcggttcggttcctcggtctttttgaaaattcggtctttaacgaccgagcacttcggtctttggttagttcggttcggtctcggtcatagaccgaactaaccgttacaaaagttcgaacaacaaaaaagaatggcaagtaatctgtacatgatcaatgaattaaaggaaacacacagatgatgcactactatttgatgccactagcaaatcgagcacgattctgagaaaaaaaaagcagatcgatgggattctgaagaaaaagaaaaaaaaagaagcaaatcgatactccccatcgatctctgccatcaattgttctagatggctccagggaccaagatcccatccatcccatcgcctcctgccgttgttgttactgcggctcccatctctttgctcatggccgatgtcggcgaggtctctagctcccgcgcacggcctccacgaggtgtggctggccggcatgcatcagagggcgccgagatgtggcggcggtggcaggggttgttggttttggggtgagaggcgagatgcggcggcagcaggggcagcacatcgcagtcacaggtcgtcaatggcagcaccgcacggtgggggaatttgcagtcttcggagatgcgcataaggtggggattggggatgaaaagatcttgtggtggtgcagcagggagttggttgcctccggatgaggtggtattgggcttagtgggctgagatgtcatctgtattatttggccaatgatatatttcgatcaatttggttaaccgacgccaaagacagaattaaccgatctaaattcggttagtgaaaatgcagaccaaattttttggtctcggttagttcgatatgattatttcggttcggttttttttttctgcccatccatatccactatcataacgaccctcagtccttccaccaccgttatcaatttgtttcaaaaattttctataaatatttaaatactttttaagaaaaacgaggagatatattctcgagggtttaaaacggcttggtaaaaaaaatatccaagattataccatcacaccactctgggcaaagacttagccgagcctgctcatgtcacgacgcatgcatgttggctaattaactaattatagttaattagtgtcgtggtgcatccacgtgcgttgagtgagttaacgacaaaaatgaattgtcgaataaacgtaagagcccgttggttaccctaataagtcaaaacgaagttaaattttgaattcttaaatttaattttggagttgattttaaaatattttcaagttagttttttcagcattagcttttaattcgttaagaatac

SEQ ID NO: 33306 - DNA, 1501 bp, Oryza sativa
agaggagataatcatacagcaggctaatgcagcagagagtattcacaagagtcaaaaaaaagaaatgaccattcaggagccgaaggagcactactgtactactctagtcccaccgcaaaagacatccacatgtttttttattaaaaaaaatcaaaatttacaaactttaattaataattgaactaataatttatatgtattagggagcacgggtgattataagaattttatgaaatcaagaatacactgttttaatagaaatttagtgaaattaagaatgtatggttggtttctgtctctttaaccgtgtgttaaaagatgggttcacgagggtgtgcgagggtggtgttgtgtgtacatgtgcatttgctgtattataaaaataatttatatgttttgcaccatgtgacattattacattcatttaaatgtatttttcatatgataccaaatttatatagccgttgatagtaaaagaaatatattaatattcaaaactttatgttaaagctaccttaaaaaacttacgagccttatattttaaaacagttaaagtaaaatgaagtagtatagtaatcaactctgttaacgtcaggaattagctccatgtcctgtcactcacgcgacgtttacctgccataaacctccgttccgtacaatgataaacagcatcttgtacgtccttgtgtactccacacacaacacaagcttgtcctgtagacgcgtgacacggacccggcaggaaatcagaggagcatgtttgcaactgtacgtggatgggcatatgaccatatgtaggccccaacttcaattcccaaatcccaagctatgatcttcagcaggcagcatcgatcgagagcgatggatcggatttggatgaaattaagcaaccgtaattaggcgaccaatgcgatggcagagcagcaagaggtatcattaatgggttttttttttagaaaatagaggtatcattaatggtggcgtttacttgttgaaattatttactcaagatctattttttagcttaagacatgatcatcaattctaaatacggaattgagataattactgaccagatgaattgaagttttgctaatttcttttgattcttctgttgtccttcttgattcacctgcacaggagtggtttgcactataaaccctttccactgtttgagatcaatcgggctcttttttagggcttcagaatttacacgtagagaattagtcgtcacctctcctcaatgccttcatttctttttatttgcactggtgagactcggggtcgatccggataagactcaaaatttgttatcaccaatcacggtaacgtttatctcttgtcccttcgtttattgtttcgtttctttcctgttaggaaaggaaatctggtaggattttaccccttccctagctaaccggtattagccgataaaaccaaccaacattactttcttatcccatgagctgagataattttagaacgttgttaaactgtactt

SEQ ID NO: 33307 - DNA, 1501 bp, Oryza sativa
aagaaaatttgtggagaaatagtacttacaagtctttcaaatacaaactacgatacatacccgcgtaaatacacaggctagttaccttgctagttttaatgacgaccaaactcgtacattggacgttgtgtagatgttcgcccttacgtgtacatgctctcaaggtaaaatccatattacccttatcaataatatactccctccatttcacaatgtaaattattctagcatttcccacattcatattgatattaatgaatctagatagatatatatatatatctagattcattaacatcaatatgtatatggaattgtgaaacggaggaagtatgaccgttggttaattcaataaatgaaggtagtattccagaaggtcggcacatacagcaacaaaatcatcagcaatacaggtgtaccgtgtacatatgttgatatgtacgtgtacttcaagttttcaacagaccaggaccagtaatatttctagaaactagaaaccagtaaaatagcttgacgtacgggaccttgaattatctgtcgtcgcagagccgagggcgtcaaagaattgaaaaatcagcaaattaagttcagtttactcgacctcgcagatcgatagcgatcataatctatctatctacccatctgtcttacaaatctaccacaaatttagctttcaaatccttccaaccccgtgccagtttcgtcaacttcgttgaagcatcacggcaattaaacacagtggccggtctgaacacagcagccggttagctcctagctagctaccccgtgtatattgagagatcggcgagagagcgacgttgtagcagagacagagagatcgaatgcaacgtgaaacgcgggtaatctagtaatgtgttgagttggatgcaattttcaagggaatatgggacgctttcacccacgttaatgtgtgtttctggctgctgtccccttcttgctgttcagtcgccattgctgccattcatctcctgctcttgcaaattgcaatgcttagcttctgctgcatctatttacactgtttgccttgcgggctccgccaatcgccattgccatgatggctcaagaattttactcttggttttcgtacgaattacttctactactggtatttccgtttctaacaaaagttgtctgaaatattcatgtttttccaacttccaagaaagctctagttgcccagtcacacattgaagtatagcaaagtataatcgattgattaatcagcacaggtgttgattaattagcaaaaagtagggttagcagttggtaaaaagtgaagaagggtaaaaaaaaaaagtcagatttggaaaggggaagcagccaggcaggatactgggtgagagctggcaagcagctcgagaccacaaaagctgggggccatggagacacgtgaccacagatgcctggctttcccgggctataaaaccccagccacccttccatccattggcacaagatcacagaagctcacagttcagtt

SEQ ID NO: 33308 - DNA, 790 bp, Oryza sativa
cctctgtgcgcaaaaagtagtgggagcactggccatgaggaaacaagttccagaatcatttcttattggcctggttgcttgagtcaagaaagagctgcctatatgcagtgtcctctcaagatgttccatgagagaagtgacatatgcatgaaaccaaacaatttctgtggtagactggccaaataaactcagctgaccaaacaaatcaaaatctatgttggaaaccagtccatctgaggcaggcttggtgtgtccagacaggtcatccagcatacagggaaccagactcacccatactgtttagatctcctgttgatgactaaatgcttggagaaaatagtgttcattttaacgtattcttgaaacattatctccttgctttgtgtttttatgataacttttttgtgtgtgctttttaatttgaaaccttctgcgcttcaagcgctattattgtttagatttcctgatggcgattaaatgcttggagaatataatttttgttttacatgttcatgaaatattatctccatgatttgtgcttttagtgaaaatataaattccttgtgtatgcttttgaactcaaaactttctgtacctggggttatgaatttgactagtgtaatgattatcagtggctgaaatactgcatgaatgacatgaagtccgtgtttttttttcccacacttcctagtatggaactttagacgtgttaccttacaaatggagtgatgtgacttattacaaatgactattctatttgactcaccaaatctttttgtatccacacagg

SEQ ID NO: 33309 - DNA, 1501 bp, Oryza sativa
gggtcagctggggtgtccggttgtccagctgctggattcaccgcggcgcatgaggggactgcccactgcctgttgagggttgggggtgaaaccttagcgtggtgtggatggttaggggagggttatgcgaagggtcttgtcacgatttccccctttgcactatcatggtgatacttcggggcatggcgacatgtgtggaatcgtgtcttgtgggtacagttgtacacctctggccagagtaaaactattcgaatagccgtgcccgtggttatgggcgatcaaccagattcaccgtggttagtcttaccccgagtttagcttagtgaactggtgtagttcaggtggttggttgggcatgtcgcaacgtggtgtagcgttggacagtgattggttaatatggactaattactgcaattgttttactgctttcaactactgtttttaaatgcctgctttatgaaaatgaacctttagcctcctttggatatatcctgcatcatacctcctcttccagtatgacttgctgagtacagtgggtagtactcagtcttgctctcttttcccacacaccagagcggaagttcttcccagttggagatgtctcagaaaggttggtttcattgctgccgttaaggatgcctgtggagtggagtcgcccgctacagaagtcaagttttcaagcttagctcgttttatcttttccgctgcatttgtaatctcttgtatttttgtaatcctggatagaggttttaatacatattcagcttagaaattctgattcgtgaatttctgggcgtgacagggcatcgagcggcggaggcggctcctcctcggcctctgccggcacacgcctcctccacgaccacctcgtgagcttgctgccaccgtctcctacactcggggatgctcacagccagcggcgcacggctcgtcctcggcttccgtcggcgcatggggctcctcctccggtccgtggcgtacaactcatctgtggcatctgagaggagagcggcgagcggcggagagagagagaggtgagagaggataaagatagagagaagagagatatgacatttgggcccatcgtttttttaataaaagaattgctaactggacaaccacgtaggaccataaccgcttgcaaagttgctcagcttggtacttcatctcatattgacagttgagggtaaaagatatctggttctcgggtttacggggataattcgtactcacccaatagtttaggggtgcaattcggatttttcccaaccgtatctatgagtcgtcttctattaaggattttgtagcagtgtttaggcatgaggcatcttattgtcttgtcttcgtgactaggctcgttgtcttaggtactcatcggttgcccatattccataaaaatccaaaacagcttattagccaataaaattaagttattgataaaacttttatatatgtattcttaacgaattaaaagctaatgctgaaaaaactaacttgaaaa

SEQ ID NO: 33310 - DNA, 1501 bp, Oryza sativa
gagacgacctatcaatccatttttgctggtttctcaagagattccaacagtgcatcatgtgaaatggcctatggttctcatcttcggccttgtacagagcacatgcatgcataatctgcacatatcaaaatgtcatattaaatgtctagtcactatatgaaaaatgaggaactagttttaaggacatatgagcaaaccttatcttgacttgaaacccagctttgctttctatccccaatccggcttagacaaccctcgaacttggtcacattctcttgaatagtagaccagcggtgcatgagggaattttgagaacggtctgaggtgaagtccttgtttgcgtggaagtaatcgtaaattctcttccagtatgcacaacgagattgttcgatgccttggactacatccttactaacattcaaccatgccgaaaccaacccttcgtcttccttcccgctgaaattctttgttcttttctggtttcgtctcacgacaacaacttcttcgaccgttgaatgttgctcctcgggtggactagcccccatcatggtgccatcatcccactctggcgagttgattttaacaaccagtgagttaacataacaactgtctccatccatcgctactgttgaatttataacaaaaaatggcatatgttcagtctatagagtgttgtacaaaaatagaatgtagcacatatttttcatgcaacagtcatttcagtaaaaagttcagagaacgcacatcctcaatgtactaaaaaaaatcaggtcagcatttcaatcacgcaccaatgccagcttcctttctccacctaaaatcagcattagtttcaatcagatcaactgatccagtgcacaagcacatacaaaaattcccaactcagcatatcaaatttatcaataaataaacatttcatcttggcagccgggagcacatatcaataaataaagagccaattcatcttggcagctgggcgggggattacctccgcttccaatggcgcgcgggcggtgatcgacctgcgccggctgcggccgaatttagagccaggccgccggaactagggcagaaggcctaaggaggcaaaggggtcggcctccgggcggcggggacgacgtccggtgcccgaggatggaggcggaggcgagccgacggccgggccacggcggcggcgggcggcggcgccggcgcagcggagggagatgcggattgggagttggttttggggctcgccacaactagcgaggatggagccttatcgttttaaccctaaatctctaaatttagccagctcgagttgggcttggaccggcccgttcgaaattgggccggcccattaggtggatgggcccactttcaggccgaccagatagtgagataggcttggtcatcaccattcctcgaccagctcacgcaaaaaccccccgaaacctcgaaaccctagatcgccatatggcctcctccgccgccgccgccttctaccgcgacagggaggacg

SEQ ID NO: 33311 - DNA, 1501 bp, Oryza sativa
catatgtgaaaagaaacttgtggaaaaagaaaaaaaaataactccattattaatatattgtgatgtacatttaatccatttatacttctaaccttgtcatatatatatatatatatatatatatatatatatatatatatatatatatatatatatatatatatatatatatatataacttggaccacccatataaaaatactagatacgccatggacccaaagatgtgcatttcaggtgtcacataagatgctaagtaaagatactcaaagtaactgacatgcaacttccgcaaattgtaatgttaatgcataacaagggaaatagtaaaatgaacctcaacgttcagctgctcaattgtcatttcaacaatataaggcagtaaggcacaaacaaacaataattcaaaaaaataaaactcctacatcacttgagatattacagacaatttgatacacctagaatgctttggtcctagcccaattaagggtgtagtatagtttcaaaaaaagcataaaaaagaccaccccaatctttactttaagtaatacctggttgtagtttgtgtatggctctcgtagaactggaggcgacgcagtaatgaacttggggcaggcataggaaaagagttcatcataaatagcatatgcctcatcatcatacctatgcatctttgtcattttgtccccatacttttccttcagctgagtgccaacgttttcatctatgagcttgtcctgtggacacaatgagaggcagatcgccaatagtgcatacatctgctcattcttcttaagtagctggtcatactggggggaattctggtggtattgcttacacttcaggatatacaacagaattttgttgaattcacgtataccatcaatatacctgaaatccatccagaaatatggtttatcagataaaagaagtcagacaggacaattcatgatggtgaactaactagtaacatgactccattcatccattaagcattaggttctcatatgggacagaatagcatgcttcacagtaaagtttttttttttttttgggttcacagtcaacaggactacctaaatgttggaaaatccaaatttttggtaaggttgcaataagcaataacaaattttggtaacaatccaaatgaacgaatactccgttagcattatcaatattaagtaggcaattttggcatcaaagagaaatgatcctaagtacttcatcagaggtaagtaggggaagtgtcgggctaagctcaaccttggattcttggaccattattaagtagagaacagcataagcactattgactacaaaaggactgcccagaaagcttttgccatattccataagatgaaatgatgttaaacggcaatgttacatttagttcacatacgcagagcttaaaagtaggagtaatatactatataataggaccacctgcaattatggtaaacataagcaatttatatatatatatatatatatatatatagga

SEQ ID NO: 33312 - DNA, 1501 bp, Oryza sativa
tggttctatctctcactttttaaacgaaatctgatcgggtgaaaaaatttacaggattatatatgagatattccgggacctataatatcgacatgtatatccgttttttatagtgaatgtttcagtctacctatgttttccattcctccaaacatcaagcggctaactgtggttctcaaaaaaaaaaaagaagcggctaactgtctaggtacaaacattcaggctcctgtgccagaatgatggtggtcatgcaagttttcaccaattttaagatggagatatatagtaataggattaagtgttgaataataatgtcttttcaccatatatatagtaatagggttaagtgttgatgcaactcaaacatctacaggtttcattcacgcaaatatttgagttgcaaactttttaattggttatagcttctaccaaaacaaacgctgagtttttgggggagtactcccaaaaaagcaagcatctacactaaaggaattacataatcaaacaagggtatggtaataccttcgtcccgataggtatgtctagattcctcaataggtatgttcagatttgtagtttacaatgtgtctaattttattttagttactatacattttgcgtaattccaagaaacagagtacaaattaattagtttatgcgtgtatgcgtacacgagtgtgtgcctataggcatgcatgcaagtgggtagtcccactatcaaaaaaaaaacccgcttgcatgctagtctatttttttttgcatgatatatagtacgaagaaaaaataaactagaagtgggataagcggggaaaaagcgcgcttgtccgcccctcttgtatccctatgtgcctactcatcgtttactaactaatgtaggcgtgatgtatatagttcgtatgtatacctgcgacgtcgaggtatggcagcttcttggccggcgagaaggccggcgagcggaggagcggctccatctcgaacccgttgggcaccaccacgcccaggtacgggccccgccggttcacttgccggacgccccgcgccgcgtccgccgccacggccgccgcctccgccgccacagcagcggccgccgccgcgaccaccaacagcaaagccagcgtcgtcgtcgtcttcgccggcgacgacgacgaccgagcagccatgtcgttaattaattaaccttgagctaatgaactaagctaataacgcgtatgcgtataacgtgacgaatcgaaatagctctagcaatcgatcatacaagtctcacacaagatgtgtgtgtgcgcgcgtgtgtgggaagaacgagatgaagagagacaggagaatggtagggtttatatatagagctaggaaacaggaagaggatttgatttgagtcagagctcaaaaagaacaatcgtgctggccatctccaattaaatactcctatttagcttccaggacaagattacatgaatggaatcaatgcaattacactaaaagaaataacagaggggtttctata

SEQ ID NO: 33313 - DNA, 186 bp, Oryza sativa
cctgcagccccccttttgaaccgggactaaagatcatctttagccccggtttttattgcatccgggactattgtggaaatcggccgaccgacgaaagatggtttctccaccagtgtacatatcctcaatttgcttgttcctatgcacacgtactcacgtagccatgcttcttgaaatagaacggca

SEQ ID NO: 33314 - DNA, 675 bp, Oryza sativa
cggttggtgctaccaaccgggactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgccgtaaaaggtttgcaacttcatcctccaatgttttttttgtcatactacatttgcacctatgttttgcacacttttttttgtctccaaaatttagttgtaagttgatgagagagaaaatgtgtgtggggaagaaagaatattaaaatttagttcatttgctaaacaaggtttttataaaatagttgaaaaggaaaactctagtgaaagttaatcttaaataatagaaaacaaattaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggttttttttgactcatgtaga

SEQ ID NO: 33315 - DNA, 1501 bp, Oryza sativa
  unsure (1)..(1501): unsure at all n locations
acatggttaatggcaggtaaacatcgcgtgagtgataggacttggagctaatcactgatgttaacagagctgattactcataaagatggatgcacagttacatgaatgcacagttctgaccgtattgattttctcgtttgtgcagagggtaaactcatgacaatgctgtccatacggagttactacagtaattagcaggcacacctggttgaccaagagctggttacttatgtcaatcagtttataaacaactaaaaaaatgatttgcatgtaaatttttacatttatacttatccttagtaacttaaaacacattgtaaaacatacactacgttaaatatactctaaaattagctttaaaataatgttttaaaatttaaattttagcaatgactcattttcgttgtatggcaaaaacgataaggctctaggcctacaggtttcttttggaactcgcattctagttgtttgctcaatggcttttaagggttttttttattgtagtccattttctaattaatattgtcttctaaaaccatgaataatacagataaaagtttacccataatatttttttcgttattcacagcaaataagtcgtagctcaacccaatcagagactggaaattttttaaggaatttgtgaaaataatttatgtagaaatttagtttcctgcattcatattggacacgatctgatagcacataggttcgtttaatatatttttaggaaaggtagtagctattattagatcagggaagccaaatgttgttataatactgacaaataatatttgttctcaccagctgataaaatttttcgaggaagtaccccctctgtctctaaatatttgacgccgttgattttttaaatatgtttgactgttcatctcattgaaaaactgttgtgaatatgtaaactatatgtatatgtaaaagtatatttaataatgaatccaatgatatggaaagccttcatatttattttaatttttccaataagacgaatgtgtgtaacaagtttaaacaagtctacggcgtcagaagaagggagtaggaacttgtattaattaaccaatatagtgcggatcagttccaacgataggtttaccaatggagaaattttacggttattaaaagacaccaaaataattaagtgtaattanattcgaaattgcggtaccgctcgtcgtcgccttaagatagtanaattactanaattaatggaggtcaggagcttgttaaccgtgaacctgcagactcgatcaaaccaggtacagattggattgcgcttgatgattgttttacatatataagtaagccgtgccattagcactgtatttacaaagactaatcgaaaatgtaatagtaactacgaacaattttgatagttcagtgttagatagttacagtgttacacccttttcctgatggaactttgttaggcagccacaatataatctagaataaacaacaggagggataattataaaggtagtac

SEQ ID NO: 33316 - DNA, 261 bp, Oryza sativa
aaaacattagttcctattttcacttcatatggctccttataccacttttttgtgttatggtggaatattgttttaatgttttgtgaagatgagtatttgatcttcttaccttatttcacagcatggtaattcagtttatatatgtcttgtgcagaggatgccaaatgtatgaaccaaagcccttctcaagcattgtactagctcacaacgatccagtttcccacaatcaacaaattgaacgtattaacaacaatgtagtat

SEQ ID NO: 33317 - DNA, 1404 bp, Oryza sativa
ggccggtggctcatgtcgcgcgacaatgcgctcgccagggacagcccggtgagcgtcgtcgacggcagggtgaagcaggaggtctccctgaggctgcagaatgtggagtgcggataggtggacctggagctggagtggattgctctcaaccagtagagacttctggctacatcagtgtgatcttcctcctttttttaaaattatttttcgtaacaaaaattaacactcttagcgtctgcaccaactatgaatgcgcaactaaaatgttggcttttatcccgatgtatgttactggattttggtgtagcctttgtgttactgaaattgttgtagcctgggtgatggtcttcctggactgtggtgtccaaaatggcaaaatccatgctgaactttctcaacttggttgaattgtacgtgattttgcttattgtaactacagttgtttggtttaacggcacaatcatagctttaaatagtacaagatcacaagtgtgatattcagttttatgtcgtggttttggcacgagtttacggcaaaaacgttgttaaatatgtgatccgaattttgggcctacagtatattcggattagttatctaataagactctactttataggattagtttcctattagtatatcccttgtaagccgcacggggagggtgcgacagcccaatatatcccttgcgtttgtatcccatttctctatagtgatcattgccggtcggcgcctgtggtttttttccgcaagggtttttcacgttaaattcgtgtctccgttgtgcatctattttcataacaaacgtgggtggcaaagtcaggcttgagccaattttctacatgaatcaggtccgcaaacatggccgtgtttggagaagctttagcagtaaagcttctttcagagccttacggttactcatattttctaataagccaaaaaagttttagagaataaaaattattttgtaggtaaaacttttatatatttgttcgtagcgacttgaaagccaactctaaaaggattatgttaaaaatatcttaaaatcaaatttaaaatcgaattaaaaaattcaaattttggcttattaggccaactgatgaggctctgaaatatcgagctctgcggacaatctaggttctttcatctttttttttctttttttgttaaaaaaaacaaattctcactgactctgcttaccatctgtttttgggaatctctgtccaaataaaggcctttggctcatctctgatgcaatcatacaccgtccaaagtaactccaggccaagcagatgacgccacgtgtccaacccccaatctgactgactcacacgggtgttggctcttcacttgtcctgaacccaaaataactgacgaatccaaagctggaagacacgaaaaaggaa

SEQ ID NO: 33318 - DNA, 1501 bp, Oryza sativa
tggacatgttgtcgcacgctggatgtggcttgcttgtggggaactggatgggggttggtgtggcgtggtgttaggtgggagaagcttcatggaggaagaacagaacatgatggggaagaggagaaaacaagagagaggataatgtaacgcttggaggatacaggatactgatacggagttactacagtaataagcacgcacacctggttgaccaagagctgcttatatatgtcaattagtttataaacgactaaaaaaataatttgcatgtaaaattttacatgtatacttatgcttagcaacttaaaactaaatgaaaaaagaaacaacgttaaatatactctaaaattagctttaaaattatgttttaaaatttaaattttagcaataactcatttttgttgtatgccaaaaatgataaggctcaaggcctacaggtgtcttttggaactcgcattctcgttgtttgctcaatggcttttaagggtttttttctattgtagtccattttctaattaatattggcttctaaaaccatgaataatacagataaaagtttacccataatatttttttcgttattcacatcaaataagtcgtagctcaacccaatcagagactggtaattttttaaggaatttgtgaaaataatttatgtagaaatttagtttcctgaattcatattggacacgatctgatagcacataggttcgtttaatatatttttaggaaaggtagtagctattattagatcagggaagccaaatgttgttataatactgacaaataatatttgttctcaccagctgataaaatttttcgaggaagtaccccctctgtctctaaatatttgacgccgttgattttttaaatatgtttgactgttcatctcattgaaaaactgttgtgaaatatgtaaaactatatgtatatgtaaaagtatatttaataatgaatcaaatgatatggaaagcattaatatttatttaaatttttcaaataagacgaatggtaaaacaagtttaaaaaagtcaacggcgtcagaagaagggagtaggaacttgtattaattaaccaatatagtgcggatcagttccaacgataggtttaccaatggagaaattttacggttattaaaagacaccaaaataattaagtgtaattaaattcgaaattgcggtaccgctcgtcgtcgccttaagatagtaaaattactaaaattaatggaggtcaggagcttgttaaccgtgaacctgcagactcgatcaaaccaggtacagattggattgcgcttgatgattgttttacatatataagtaagccgtgccattagcactgtatttacaaagactaatcgaaaatgtaatagtaactacgaacaattttgatagttcagtgttagatagttacagtgttacacccttttcctgatggaactttgttaggcagccacaatataatctagaataaacaacaggagggataattataaaggtagtac

SEQ ID NO: 33319 - DNA, 766 bp, Oryza sativa
acatggtctaatagctggaagaactttagagatcatgaaagatctcatagtttctctaccaaccttaatagtattcctctttctccattacagctgctcctttgtgcggattcctattagtacatgaagactaacaagaacccgcacaaagaagcatctgacgaagaggacaccttggtaacggtcgagttagcttgtcccatgccaagagccacatcgcagctcatcagctcgccaatttcattgcctcccttccctagtagtactgttagatttaattgggtaattgatccatttaaatcaattaaatcaaataaattccaaggctcattacgctaggaattcatgtgtattcattctcttatgagatatcaatgggatgaggagttttgagaattaatccatttgattagggaattggtaacttatatcaattactcctaattgatgcatggttgatggttgtgtagtggaggatggttcatggccagttgatgacaattagttgctctattcctcttcctattccattggtaacctacatcaattactcctaattgatggttggttgatggttgtgtagtggaggatggttcatggctaattgatgagaattagttactctatttttcttcttattccatgactcttactcttcatcttccattcctcatataaaatgagaatggatttgatctgcctaagtagaagtgagacactttcatccatttccaaggctattgctgctacgataatcccatcctga

SEQ ID NO: 33320 - DNA, 1501 bp, Oryza sativa
ccataaaaagaaatatagactaactagatgggacattatctgtcagccaaaagatcaggggggtcttggtattcataatttgggaattcaaaaccaatgtttactaagtaaatggttattgaagttaataaatgagcagggtgtctggaggaccttttgaaaagaaaatgcattaatagtaaattaataactcaagttgagaaaaaacatatgatttccattttttgtcagatctgatgaaagttaagagtaactttctaaacatgagttcctggataagtaataatggtgaacaagttaggttatgggaggataagtggttaggaaatttttcctttaaggatagatacccatctttgtatgctatagtcagaaggagaaatgatacatttgcgaatgttatgagatctgttccacttaatgtgtcttttagaagatcattagttggtcagaacttagacaaatggcatagcttgtgtgcttcaattgtgcatattgatctgacagaagaaagtgatagtttcagatgaaactttcatcaaaatagtcaattcatagttcgatctactcaaaggaatttttatgtggtatctacttaaaggaattgtgttagctaaggataatttggctagaaggaattgggatggtaatttaagatgttgtttttatatgaaaaatgaaaccatcaaccatctattcttcaattaccatttttctatatttctttggagatcggttcacatttcttttggttcatcctccacaaagtatgtctcatatgttcgggaattgacttgttggtgttgataaaaagattaagaatcttattcttgttggagcatccgctttatgttaggctctttgacttagtaggaataacatggtttttggtaaatcaccatcaaaatcttattgaaggtacttttcagggcaacgtattggctctagtgttgggctcaattacaaaaggtatgaagaagatattaacctaattaatgatgcatgtcgtaaacttgagccaacgattatgcagctggaggttctcaaatagaattcaatagttgtgggatctttatcttgtgttggtgtctattagttcgtgcttgtttaaaattttcattctgtggttctagactcgttgtgtgagtttgctattgtgtgaactatgtaataattggttataactcgtttgagtaaatgctgagatattttattctattatcttaaaaaaaacatatagttacatggagtcaaagggtacattcatgcacatgcacagtgcagatcgcggccatgtgaagctttctccatcgcaaagccaaaaccgcctacacagagccaaagtaagacacagtccagcctctcacctcgccaccaccacctctcgtctactcgtctcctctcctttatagcccaaaaccacaagctgcaccacactctacttcaccctctcttctcttctcctctcccgtgatctcgatcgccatggtgatcaccacgg

SEQ ID NO: 33321 - DNA, 415 bp, Oryza sativa
agagcatcccctctatgtatccacggcccccttgcaagacaaattcataatatccctctgccatgaaagttacgatgaacatgctatcccgcagcgatttatagctaatgtccgacctcaatcttcaagccctacgcatatcatcaaagagagctacttggtttggaatccttaacgagtagaatctcgctaagatcgtaacgacctgctatcttcaccacctcctccagattcacacatagagcatcctcctcttcatcatcaaccactccctctgtaaaggttgtcggtccctgcgatggattgatattcgggctctccttcgatctcttcttgtatgtcgatgtcttgttcggtctttggatagatcctccttcctccgccataccctccacccttaactcccgccctaaga

SEQ ID NO: 33322 - DNA, 1501 bp, Oryza sativa
gcatgccgtctatactgtgcgagttctgtcatggacaagtggagttacttatctatcaatagtttcatcagtacaaaaacaccatctatcctagtttgatcattatctaggttttctcaaaatgaatatcatctgacaaaatatctttttctttatttgtgcagagagtaaatgttcatcatggaatgttctgcatgtatgtagccaatcaagattaatttatgttggtttaacccatgcaacatttaaagtgcgaattaatttctgttggatataggacattgatcgatgatgattaattttgcaataatatggatattttggtgttttctatttagtggatgattaaattaggatagagtagtttccaaattaaatccgctgcaggtaggactaaactgtagtgatcgaccttgttgtcggaaatcctaatcggcgatcgatcgcctaggatgggggtagcgatcaattcccctcccccctccctctctccactggtttcctttttttttggcaccgcattactttcctattttagtaaatttatgcacctaaagtttatacacctcaaatttacacatctagagacccaaagttacacatctaaagttagagaccaaaagtttatatatccgattcaaatttgaatttgaattcaatattttttatatatagtatttctatacatctaaagtttatatctaaagtttatagacccaaagtttataagtcaaaagtttacatacccaattcaaattagaatttgaattatatctgattcaaatttgaatttgaattcaaatattttctatatatagtatttttatgcatctaaagtttatacacctaaagtttatagacctaaagtttataagtcaaaagtttacatacccgattcaaatttaaatttgaattatatccgattcaaatttgaatttaaattcaaatattttctatatatagtatttctatacatctaaagtttatacacctaaactttatagacccaaagtttataagtcaaaagtttacatacccgattcaaatttgaatttgaattcaaattttttatatatagtatttctatacataaattttttaacttttttattttttttaaattttttttgtgatgtactgtagtaggaagagaataaggggaggagaaaggggggagatgagggaggaatgtatcgagtataggggaggggggcggatatgatcgcttgatcgcccattagggcctccccttgttgtaccatcgcattggctgcctaattacggctgctaactgcaaccaaatttgatcccatcgatcgctctcaactctgcaactcaagatttgggaatttaagttaggcgtacctatgcccagttgcacaaatgctctcttgatttccagccgggattaatggtacttcctccgtttcacaatgtaagtcattctagcatttctcacattcatatagttggtaatgaatctaaacgtctacattcatta

SEQ ID NO: 33323 - DNA, 1501 bp, Oryza sativa
atataaagattttgccttttgccttgcgagagaaatctatatagttttatgtgtgtggatactaggaacaactagaaatatatagcgaaaggtttcaatgaaagaaaaaaaaggcagagtaggaaaaggcgtggaaggacatggactcctggccgtagaataggtctttgtgaataaacctggactcctggcctgctccggactgacctggactttgtagaatgcgttctctcacgcactttgtccctaccatcggtgatcgctttccccgcggaaaagaaaaacacatctgcacagtgcgggattggattcttgatcgactcggatcgggattgaatggatcgtgttagctccctgccgccactggcatgcctcctgtcgttctgcgcagcggcgaccgccaccttatcgacgccctccctggtggccagcttgtttgccaggagcacctccgcgacaccgcccaccacgtccttgagtgttgtggccttattaatcttctccctgtcatcattgggtggtgcctcatattcgcctcgacggcctgagcaccgcagcaaccacacagccggggatgaccctggacaggaagaatagccccgtggcgctcatctcggcaccctgcactgccgccacattggcggggtctataggcttaaatcccggggaaggtcgccgatggttgtagtagtgacatatcaacactgagatacatagcaaatgcaaattcgttgagctacaccctccaaatttatcaccatagatggctcatcagtaatgctctagatcaatacgacaatatggaattcacacgatttgcacaactcatatgtataaaatttggagatatttgcgagatatgtacaaattcaatatttttgtgcacatgtgttataagtacaaacaatcttacccatcaatatttgtttgatatttacccggtgcaacgcacgggcatatttgctagtatggaaaaaaaattcaaaaacaattgttacgttgatgaggatggcacaattatgtatagggactacctagtatctttcgacatattttttttttcttaggtctcacacgaattttcagtcataggataaaaaacaaaataacggacaggatgtttcgacacattttctaaatgatatcactcggcttttatttcttacgtggcagtggcagtggcaggtctgcaatgcaccgatgcatccacggaagattgttgggctagggaacacttgagtattctattcaggctatttgcaacacaaattatctaagcgacaatgtttagcatatcctcattaaatagaagactggatcttatttacaattcaaaagttacactgtaaatttaaaaattacactgtaagatacaaagaaattacactataagtttgaaaaattacaatgtaatttttaagaattacattataggctataaaaaaacactgtaaaaattcataagtactcgtatactgacacgatagttaattcattgaga

SEQ ID NO: 33324 - DNA, 1501 bp, Oryza sativa
accaattgttttgggcctagccctcacattttgtaggctaaaatattggggcttattaccacccgtatgttgaccacgccgacattgctagttggagccacacttccgccggccactgccaagtctccctcgcccctcacttcgttgatgattcgtcaggcaggcaaccactttgcctcaccctcgacctcaactcctcaagctgactgatttgttgggagaaaagaaacaaaatgtgaacaagagagaggcgcttttgcaaaattactgagatggatgagtgacgtggaaaatattcctatgtggagccctttggatcaaagatgcaccgatcttgccattgaaccaatatatttaatttttaagttgttgcatcggaatgcgctcacagattaagttgttgtaccataagtgtaatttactctttaaaatatatgttatagcatgtccaaagaaaagaacctcctggggcctgggccaattactctggtggtgatgagaatataaaattcacatgagccaaaattctagcatagagaaagggccatagagcctatagaaagctcaaaaccattaccactatttatatctggttaagtagcaatgcaacaatgtttagcaccagtacatccatgcccagcatagaaatctacacttgactcaagattttgagcttgtttatttcgtggtcaaattctacgtaattttagcacattttgatattaccaatttttggaagcattgaattgtttggtttgaagctttgccaaatattagtggagtttttgtgagagaaaacttcggaaaatattaaaatttgataggatggtatcgataaggctatgttagtttattacctcgctaaattttatatcatcaaaattttagtatggttgaaattaacaaaaaaaaatgtccttcatttcctcccgttgcttttcccatcctttctcccaaccattgcttcattgcttgtcctccgtttatttgtcacctggaggcaagcccatatgactctcggcccactgagtttcctgccttattttctctacggaatgagtccactttgactctctcaaatatagttccaacctagtttatatctctaaaccgtaataccggatatcttgaccctaaaaactattaaaaccagtataatttgactttatcagcggttttggaggtcggtttcactgatacggtgctttgactggttcaacttgatgagtcctcctgtggggcccacctaccagtgacccttatctttcttctctgtcttccctttcctctactcgctttcgtctccgacggaagaagcagggcgcgatagtgacgagaggaggccatcatcgtgacgccgccccctcattccccttccgctcacctccgtcgtggaggagggagtaggggtggatattcggtctgaccgaaaatttcggtctcggtcttcggtcttttcgggctttgaaaagtgaagaccgaatttcaacacaaaaatatc

SEQ ID NO: 33325 - DNA, 1309 bp, Oryza sativa
tgatcaattgccggatcaagcagggaagctatccgtgacagaggaggaagttcagaagaatgcagtggttgcagcaaggaggcaacaagatcaatatgtggcagatacttgtgatggtaccgggaaacctccggcttatgagatgattcctgctatcaaggatctatacaagcaaccatcctttggggatgtatcttctgaggagattagtgaagggaatcaaaaaagatcttcggctcagatagagccctagaagctgggaagagttcaacaagctttgctagaatatcaacaaacagagttctagcttggtgtaggtggattcaaggaagtcgcctagagccctgaagagatttcataagacataggtaggaatgggatcggaagctatggaggcaaccggcccaggggccgctggtcaattgacaggacctaagaaggggtcccgtcaggagcaatgagttgtctagcttggaactatcacggtatcgggaacgccatgacagttagtgatctttgtgccttagtgaaagaggcaggttcccaaattgtattcttaagtgaaactagacaaaaggaagaaagagttcgtcgtttgcgtaatagattggggttgagaggttttgtgggggttagtagtgatggcctcggtgggggccttgcattgttttggcatgaatctgttaagatggaaattataggtatgaatgaaagatatatcgatgtgcatgggcgtttgtctttggatgatcctatttggagggtgaccttgtttatggggaacctagagtggaaaatagacaccacatgcggtcattgttaagttctctgaaacaagtgtccaatctcccatggatggtggtgggtgattttaatgaagctctttggcaatttgagcacttttctctgaaaccaaggaatgaatctcagatgcaatccttccaagatgtgctacaaactcgtgatctgcatgatttgggtttttcaagggtgccatacacctgtgataacagaagagaggggagaaacaatgtaagggtacgccctaacagggctttagctgatgaaggatggaggaaaatttttagtaatgctcaagtcctacatctgacatcatccagatcggaccattgcccaatcttggtcaatttatgtcctgaatctattcgccaagagcgcactaagtgcgtgcattatgaaatatactaggagagagaactggctatatcggaaattattaaggactcatgggaaagtgctggagataagagtaccctgggaggcattaagtctgctttgagcaaagtaa

SEQ ID NO: 33326 - DNA, 282 bp, Oryza sativa
atgttgagacgtcttatggatgtctcatttctatggaagaatataatatattctttaaaaaataaaagcaacgtagtataaaaggaggaattataagatattttatagatggggtaaaagagaaaaaataacaatgcaaaaaaaacaggactcgagctctcaacctaacgcacacaacattaccagcttaaccaagtgatctagaagaggaacttgttggaaagttaagttactcaatatactgcaggtgtgtcgatttttttttgtttcctcctttttaga

SEQ ID NO: 33327 - DNA, 1143 bp, Oryza sativa
tcctgcagcccgtaatcttattggcagttacaaattacaccctcttctaagggtgaatttataagaactagctgggtggcccgtgcaattatgtggctaccacccaaacaaaatcatatatttttcagtatgattttacttaagatttattaaatagatatccccgtatttctaattatatagtttaaaagtcacaacagctactactccttacttctatcatattcttcattatttgattgctcggtctaccactatttctattcattcttcttaaaacttttaaaaattagatcttatagttttttgtttttattatctcgttgggtttcttctttataatttctagaagtcccgtcaaacgctgccattatactctcatgtacggcccgtccactgtatttttccctttattattattgggattttataaatcgaacataattatcgttcgggttcatttttttactttctataagtcccaccaaaccgtcagtggctttgccattgtacccctttatggcttgtccgctgcctctcctttttattgtcattgagattttaaactccaacatgattatcatttttttttactttttagaagttctgaacctttaaaaattgaaccttatattttttagagtttattgtcttgttaggttttatttttataacttttataagtcccatcaaacgatgccactgtactcctctacggccatccgccgcctattctttattgtcattgggattctaaaaatcaaacataactattgttggaatttatttatttttattttctagaagtcccgccaaccgtcggcggctctacaactgtactcctatatactccgcacgctgcttctcctttttattgtcattgaaattttaaaaatcgaatatgattatcaatgggttttttttttactttctagaagtcccggcaatcgccttgtccgtttgcttcacggcctgcttgtcgtccctccttttaatcatcattaggattctattttgtgtgttattaacagtttttatatgtcgtatcaactgccactgtcgacgtttgatgtcgcaattctgttatttgcatagtatggggatcgttggtactaggatatagcgagactgaggtaaaagaga

SEQ ID NO: 33328 - DNA, 151 bp, Oryza sativa
gccgtagatcccaagccttagctatatttttaaaaataaaaatcctttattatttgtgaaaacccgctattctctctttgtcttgctgcttcatttatcgtcaaaatctgaccttcgaaaatgttgcttttcttttgtttttgtttgtaga

SEQ ID NO: 33329 - DNA, 177 bp, Oryza sativa
ttcaaaagtacaaaatttgtgacctcgtttccaactgtttcaacttatcttgcaagcttggtttactttatttacttaccttttactttgattttctaactttattcaaattaatccaaaaacttgtgctattaattggataaatgtcttaactccctcctttcacttgtctttaga

SEQ ID NO: 33330 - DNA, 1501 bp, Oryza sativa
gcggtggtggtcgtgcgcggggaggagtcgcgtgggcggctcaggttcccggcgccagcggagaagggcggcggtcggcggagctccaccgcgcggtacgccagggagacggagtcgtcgcggcagcgcgggaggtcggtgtcgcggccgccggccgagaggcgaggcggagccactgctgtcgccaatggcggggctgctgccgcggggcggcagcggtatgcatccgtcgaccggcgcgcttcgatggatcggcaccgatggtgtgattcggatgtaagtgtgaccagcatttcacaatctaactcgcaatttttagttgtaataataataatagtggtgttcggttttgtataggagttgattgcattatgccgagttaatttcattgggattagcggattgcgtgtgatatgctttggatttgctgtcatatattgtcataaattttttagttagtcctatcgggcattttagaaataaatttgtattagcaatgaatgcaaaatctcgctacgattctatttaacgatattagacttgtttaattgttcattgtgctatgtttaaaatctgtttggaaatttgatacatgcttcatgcctgtaattcatgtacctctactggttgctaagtttatatggtattattcatgcttgttcatgaaacgtgaattagttcaatttatggatgtgttgagttgagattataagaataataaaatcaagcaactaggtaatacaacaaaaatatacacaatgctttcatatgtttttgtatgacacgtatccgttcagtttgttggtcctggatgatgtttgttatctatgcgatatttgcttgactgtataaaaatgtgttagatcacttgtttcttgctacacacaccatagtagactgccgtaatcgacaagaggatcttatatcgcattgtctgtgatggggtagtattcttgtcctcaaaagcacaaatggacctgcttttctgcttttcaactggaacattgatcttgatgaccataggtagttttacctcatcagcttgcattcaatagctatcatatttgattatttgtttattcaataataactatcataaatgtaatgctatctatagcttcaacacatcatgattttacccaacagtatgggagtgcttggatgcataaatagatgattgtaattgttcacttatatataatgttagccaatgtaccatttaatatttatggtaccacattatctttaatcttcatcagaaaattaggtgaactatttccttatttttgctttgcagtggtctgtgaatcccactagtacctttgtttttaaggtttggcatcctagatttcgtatttccttttgtttgctatcgtgtaacttatatgccttcacttcattgctactagttgtctagtatgtgcaattctacttctgtttaaatctgtgctttatgtttatgactgcagaatgatatggacatttctcaccggtatggttc

SEQ ID NO: 33331 - DNA, 475 bp, Oryza sativa
atactccatacactcctccctcatcctcctccttttcttctcttcttactacagtacaccacacaaatttttttaaaaaaaccaaaagttagaaaaaaattatgtatagaaatactatatataaaaaatttaaattcaaattcaaatttgaatcgggtatgtaaacttttgacttataaattttaggtgtataaactttagatgcataaaaatactatatatagaaaatatttgaattcaaattcaaatttgaataagatataattcaaattcaaatttgaatcgggtatgtaaacttttgacttataaactttggttctataaactttaggtgtataaactttagatgtatagaaatactatatataaaaaaattgaattcaaattcaaatttgaatcggatatataaacttttgacttataaacttttggtctctaaactttagatgtgtaaacttgaggtgtataaacttta

SEQ ID NO: 33332 - DNA, 1501 bp, Oryza sativa
tgcactgtggcacaaacagctacattatgcactatggtttgcatcacatggaacatgtcacaattatattgctattttcacatgcaaggggaaccacccaaataactattccattttctgcatccttagaaagcagaatttcttaagtcatcacaatagcagcaggcaaaagaataatatgtgatgtactcactgagctgctgtctcgtgaatgtaagaaatctttttgacttgtagacttcctcaacgattgatttactttagccgtcttatggaatgatgagttctgcaggctattattgctggatttggtatttattcccctagaaccataccggtgagaaatgtccatatcattctgcagtcataaacataaagcacagatttaaacagaagtagaattgcacatactagacaactagtagcaatgaagtgaaggcatataagttacacgatagcaaacaaaaggaaatacgaaatctaggatgccaaaccttaaaaacaaaggtactagtgggattcacagaccactgcaaagcaaaaataaggaaatagttcacctaattttctgatgaagattaaagataatgtggtaccataaatattaaatggtacattggctaacattatatataagtgaacaattacaatcatctatttatgcatccaagcactcccatactgttgggtaaaatcatgatgtgttgaagctatagatagcattacatttatgatagttattattgaataaacaaataatcaaatatgatagctattgaatgcaagctgatgaggtaaaactacctatggtcatcaagatcaatgttccagttgaaaagcagaaaagcaggtccatttgtgcttttgaggacaagaatactaccccatcacagacaatgcgatataagatcctcttgtcgattacggcagtctactatggtgtgtgtagcaagaaacaagtgatctaacacatttttatacagtcaagcaaatatcgcatagataacaaacatcatccaggaccaacaaactgaacggatacgtgtcatacaaaaacatatgaaagcattgtgtatatttttgttgtattacctagttgcttgattttattattcttataatctcaactcaacacatccataaattgaactaattcacgtttcatgaacaagcatgaataataccatataaacttagcaaccagtagaggtacatgaattacaggcatgaagcatgtatcaaatttccaaacagattttaaacatagcacaatgaacaattaaacaagtctaatatcgttaaatagaatcgtagcgagattttgcattcattgctaatacaaatttatttctaaaatgcccgataggactaactaaaaaatttatgacaatatatgacagcaaatccaaagcatatcacacgcaatccgctaatcccaatgaaattaactcggcataatgcaatcaactcctatacaaaaccgaacaccactattattatt

SEQ ID NO: 33333 - DNA, 551 bp, Oryza sativa
ttcctccgtttttccattcctgctattcaaatgggccctaaaaagccagactagaagagagagggtcatattccttcgtttttccattcctgctattcaaatgggccctaaaaagccagactggaagagagagggtgagccagtgactaaattgtcgcccgctgcacgcgcgctccaagagcgttgaagcttgcctatcgacggctcgcagccaatgccagcggcaccccacgcggtttgttgggccgttcaactgatgcggcgtggccatctcaaaacggggatgtcgagcaagaatcaggacggaagaagcggtagagagaagaactaaccaggaggaaagaggaaccgatgctcttgagctttggcgaacagtggcaatggtgcggcggccattttatttggcagcacccgattcaatctactaatctaataattaataataatccgtactagagatgtactatgaatgaagtaatgaaagtgatcctaacctttttgaaacagcacgtaaaatcagttgacactttgacacctattgattgcaaaga

SEQ ID NO: 33334 - DNA, 818 bp, Oryza sativa
attttaaaggatagtataggattcaatcctttggttcaaaggcttttataggaattttttccataggattgaaatccttcaaattttctacacttttcctataaatcaaaggggaccttagtctacgtgtccaccttgttgtcggctaattgctctctattgtagctctcagtgctcatgccatggaagctgctaccggcggtcttctgcattatgctgccgctgttagtgatatgccctagaggcaatcatagagatgattgtatcacatactatgtttacatatttttccgattttgttccttgaaatagataaactcattattggttaatgaatatgtgattctttcataagactttttatgttatgtgttgctatttctaaaggatccctgatcaaatatcatatgtggaacaaatatgtttagatgatcaacacatgtattaattgatgatcatgtctcatggatcatggtatagagataccaaattaataatgtggacacatgttagtgaacatgttgttggatagacccaacatgagacactgcaagagccatatgtgttgtgtcatcagttatctcatttagtgttggtgttgaatccttagacctgagattatcatggttcccaacatgtgtagtagcttacttagggactgctaaacgctactccgtaattgggtagttataaaagtagttttcgggtatgttatgaaacatgtagtgggatatgaataatcaagatgggatttgcccatcctatagagagatatctctgggcccctcgatgttgtagattatggaaatgcatgacca

SEQ ID NO: 33335 - DNA, 1501 bp, Oryza sativa
ccagcggatcgggtcgggtcgggtggtgggtccaggcccggatcgcgaggcaggaggaggggtggcccaccgcagcagcgcagagccaaggcacagcacgcacgcacgcacgcgcgcgggaggcccggtcggtcgtcgcggcccaccggctgcggccggtcgctttgcctggctttccggttttaccccccgtaaaaaggaaaaatgttcagaagatcgatatgcacgaaatcaccctggattttcgtgaattcttactttcttctattgcaaatgtacgatcaactacacggtaggagtatagtgccgatcaaatttagtatggaacatgtttttcttttttttttaccatccttcttttgggatagttacatatgacgaggtaaaaatcgatctcaaaagaaacagcttatgaaccaagaatagggtgtgattatgtttgatcatttttcctgtttaaaaaatttagtccaaatataaaaatgaataaatcatatttaaagttcctttaatgataaaaagtcgcaatgaaataaatagtgctaaaatattatagttttttcaataactgatggtcaaacttgagaagttaacaccatcacatgttataattataattaaataagtagaattaataaatatgattaaacatgtggatcggataaattttaaggaattttagagggatataaataattatatgaaaatcctataaaattaaaattcatgaatcccaagggagactttagagctactccttgcagtgaacaaagcttctactgtatgcctactagcatgtcttgtgcgcatttacttttttgcgtggaggtttgtttacttatcatggagatgagctggtaattccatttactccctaattaaaatctgatttcataattttactgcctttagactattcccaaccaagacactagacatagttttcataaactctacatcatcaaaaaactagtactatacattaatctttcaatgcaaacaccactattccatacttaaatttaatgttgcttatctcacatgatgttcttggatgttatgtagaaacaatgtctcttttctcacgcaaagacatggtttccttctcttttctcatttatttacttgtcacatcaatttttatcctatgtggcagcttatttaatgttatggacaccattctaatcattgggttgggaatagccataatactactttgcatgtttatattcttaattgcatgcatgcttcaattcatttgttcctctgtgtggagctgcactttcaggaaaaagtcatcactagatcatctcagttgaaaatcttgttccatcaacgtatcgtctgacagtttggaaaaaatgtagtagcagcttactagctagatttggtcaaaagactttaacgtcacaaaaacaaattaagtcatacaaacagataattaattccactctcctccatatcagttaatcaatgacatttgacactttccagaccatat

SEQ ID NO: 33336 - DNA, 167 bp, Oryza sativa
ttttgagaaatcagaaatggacatgcaaaacacatggagaaatccgagggcgcctagatggaaaaaaactagcaaagttgcgtagttctctctgttttttaagacttaacgagaacaatatgaaaaaactacaactaattcgaaaggccagatacgtgtatttggca

SEQ ID NO: 33337 - DNA, 1501 bp, Oryza sativa
cgttaggaacacatatataaattatttttacttataagttaatttttatttcctaataagccaaaatatgagcaactgatgactcccctagtagcatttttccatttaccattcatttcactgaaatatgcgcttgagcccacataattgaggctgttgctgaaggtttctgtgattcatcaaggtttctgtgattgcagactggatggcacagcaagtcaggaacagagtagcttggcccctggctcctggctggcctgatcaatcttgcagggatccgatggccacgtggcagaatcctgaccctcaacacgtacgggcatgagctcgatctgcaccactatactccaaacatctgcacgcgttgctgcaggcaataacttctttgtctcgatggaatttactaccgtcagaggaattcagtaaatgaacagtaaattcacatttttctcattggcatttttattgcagtagaaaccaaaaggttcagataagtttgttgggttaaacaagaagagagatgtccataagcttattgatgtttttaaataaaaaaactagtagtgttatcttgagctttatcatggccaaaatgatggtgaatcttgacctttttttgcagctgaaaagttgaaataaatttattggattaaacaagaagggagtgtacttttgttccttctttaattaaactatttcagtgaccttgagctttaacatgataagaagagaaggatagtccatattgatatgtgggtccaaatgtccaatacatgccacaagtcggtcaattagcttctagatgcattacaaatgtcttacaaattcctatttgtaagactagaatactagaccttcaagtctatgaatgacaaacagttcattctacagtatttttttcttaaaaaaaaatcattcagtttgaaactagcagttgatgaaatttccatacaatagaatatgctagaggtgccaacaacacatgatccacaaaattcttcacccaaacagtatgagaggcaggaccactacatgagaaaatgtttctgcagttcagtccaaccagtagacaggctactgaaatgctgccaaaattgaatggcagcttttagccttttatggtttgtttgggatgcaaaaaattcatataataccagagaggaaaccttgctgcaaatattttgataagacccataaatctacagtatatcagtatgctttgaattatcagtagaaattagtatcagtattaattaactggagaagaaaatgattgccggtggaatacaatttcgcgcatattttctaggaaaagcttgggattgcttgcaacactggaaagagtacagtggtgagaccaggagatagtacaatcctattttctttagattgatcacttccccatctcaatctatcatgttcagtgagaaaaccaatcattttcatctgatatagagtatcatgcttagtgagaaaatcagcatggcagcaccatttcctt

SEQ ID NO: 33338 - DNA, 1501 bp, Oryza sativa
agtgcctgtggtcgtcgccctagtcttccgctgtttttcgttgtctttgagtgtgctgggccttcgtcgcccatgtaataattttatatacgcttccgcttgttaaactctgtaatgtatcaacttttggtgtaccttgcctcctgggacaaggaataatacacgcacgtcaggaacgcccgttgggtgatttccggtcgtgacaagttggtatcagagcctcccttgaccctaggacgagccgtagatcccaagccttagcaatattttcaaaaataaaaatcctttgttatttgtgaaaaccgctattctctctctgtcttgctgcttcatttatcgtcaaaatctgatcctttgaaaatgttgcttttctttttgtttttgcttgtagatggccggcagcgttacccgtcgtggtttgcacatgactggcttcgtcttggagctgcgaggcatgtgcgtggtcttggggtatccacacggagtggattaccaggccaggccgctcccggatcaggagggtgaggatgcagagcctcacgctggttgggaggtcactgcggtgatcctctccggctctcccgagcggacttcgctggcagtcacagcgggtggggactccttcccagccgcttgccagaacgccgctctcctcgccatcggcaccctgcaccagcgctacccggacgagttgcagcactcgccctaccgctaccaccctcgtcgcggaggagcccgcgactacgccaccttccgagacgctagctcggaggatgacgctaccgtcgtgcatctggcacgcatggtggaggcgtacgacgcggctcgtatcgacttccaccaaatggtgcgtcgtggcatggtggagaacaacatgaagatcctggagctgcgtcaggagaacctgcagctcaagaaggacctcgacgcgctggaggcgcagctgcaccagctcaaggtcgcccagggagagatcagccgtcccaagcgtcgccgcgtctgccgcagccagaagatcaccgcccgcaagagcacctcccggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcttgcgcgtgtgtttttcctcgtttatcttcttgagttgtgtggggcatggttacgccggtgtgtggtgtaactatgtcggagcctgtctttatttgtttgcctaagcaacttgaaccttaatgaaccaatttaatagcagtgataaatttaagaataatagtagtcgtgggtggttagttttaatcgtcagctctccttctctgcttgctggttctgtgtggagttttcagatggtgacgaccaggagaaatgttaacaccggtgaaggcagccaacccaaga

SEQ ID NO: 33339 - DNA, 1501 bp, Oryza sativa
ccggcagcgccctcctctctgctaccgattttttttgaatttttgattcattggatttgatctgtgatgtatgtgatattggatctaatctgggaattgtgatgtatttcttttaggatttgtgatgtattttttgtttgagattttgtgatgtgatgtattgtgatttgtgatgcatttctttccaatatgtgatgtatttctttccagatctgtgatgctactttgatttggggatgatttgggaatatgatcggggatatttagggagcagatcgatttgagaaaaaaaaaataaccgggactgctcgtaccaactgggactaaagatagatttttagtcccggttattttacccaggactaaagatgggtatctttagtcccggattcgtagtcccggttgtataaccgggactataggggggttttcaaccgggagtaaagcccctttcttcatcagtgaataatatataagcaccgtagaagtgttggtccattggaatttctttgaactttgagggaataaatgatcagttgcaatgtggagccacaggttcattgcatgaaggcaatatatagattcattgattctgatgtcggcatcaatttttttctgtttctgctacatgtaacactcatggaagcaaggccaacctttaccaacatttgtctctggccaagaaattgcctcttagattctcaagtattttttttttaaaaaaaactgaacagtttgataggcatgagtgatgaagaaggcaaagaaagtgacctacaaggcaactgcaaccactacatatataactgatagtgacatctatttaattatatagtatacttttgtaaatagctttgattttatttttccaagccaatatatgtaactaacttatttctagaaacagacattcatggaattccaaggtttattttttgcaaggctggaatgtatgctcatggttgtctgcatcgcaacaatattcatttggcaataaggttacattgttacgaataacggttattatgcatgtttatttttgaagataaaatgcctcttcgatttgtatgaaaaatatagtagttttagaggatttcaatcctatgaaaaagtttcctgtaaaagccttaacaaaggattgaatcatatcctatcctttaatattcttatagaatgggtaattatagattgtagagaaaagttggcaagaggtccaacctattgaaaaaatttctttggatacatctctctcatccgattcatatgtttttcctgtggtccaatcaaatggtcacttatgtgtttttttactatgttttgtaattctctattttacactagtattcatgttggaattacatggtttagagaaacgcttggggtcttccggctagctccacaaggtggtgggctagacgatctgggttcgaagtctcaccctttctaattatttgatattaggttcttttctaatattcgtgtcttttataattacttggtt

SEQ ID NO: 33340 - DNA, 1501 bp, Oryza sativa
catcaacgtcttcaaatattttgattcacattttggaagtgatatagtgtcacgaccggaaataacccaacgggctttcctgacgtgcgtgcattaatccttgtcccaggaggcaaggtacaccaaaagttgatacaaatcagagtttaacaagcggaagcgtaaatagttaacttattacatgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaattaagcaagactgagtacaaccaccgtactcaacaagacacacccacaaatgcagaataaatgcaagggagtacaagggaattataatataaagggttagggttgcagtaaacagcatttaaagacatttagttgctcaaagctactttgtaaacgcgatcctagaacgctacaaagttattaatcaaggccgtgaacccacacgaacctgccttaacccaaggcctatgatgattcagaccgaactggcaacccgaccctgggtcccagctcgtcctaagccaacccaggccaaccattccgcattttagttgttaagcaggttttaagaattaaaacgctaacttgggtacattgctcggcttgcccatatccgagggctcggctattcgaatagatttactctgatcagaggtgtacatctttacccacaagacacatcttcctcacgtgttaccacgtgccacataccaccacggtatacgggcggaagacgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagtcttcatttgccctggagaatgtccatcgacgcccgacttcatccatctccaatccgtgtacttttgtttatgactagactgagccacaaactaagccttacccattagacatgtggaagtacggtagtgctttgcaacagaggcccgaagaccggtccttaaacggccgaggtgctaccatcaaaaccatgcaccccgagcccagcctaaaaccattttagggggattttgaatagagggggcggtgtgaggccaattccacaataaaccaacaattccaaagtatccaggtgatatgagaatttcccaagtctagagttgtaaaaccacctaaggttacctaattagattgcgaagcatctacctaaaattatactagggataccatgagtagagtgtccactagttgaggttttgtttgactagggtgaacaaggtagtaataataacaataacaataataatatggtcataacaaaggtaaataggcatggctaagtaaaacagtgataacgcggg

SEQ ID NO: 33341 - DNA, 301 bp, Oryza sativa
taagtatggtattcaaatacaaatgcaaaggatattggaattcaaacgcatagggggttcaaatgcaggcctccattgctgctgttgtaattaatcaacagaaaaataataatttgatcatacaaaatttcaaaaagcaaagcgctaatgtctagcgctgcctccacgggagacccgactgtatgtatgccgtatttgacatcttaacgtatttatatggatgcagcctaaccggcaggcgcctgccgtgccccgtaacgggaggggaccttatgactgctccatttttaatttttacagc

SEQ ID NO: 33342 - DNA, 160 bp, Oryza sativa
agggcgaattcgagctcggtacccagcttggtctgcgcgactcgcttcggctcgcactgaatccatcccgcaattagttttgtcccacctggctgattttgcgacagagcgaccgctttataaactctggttgattctgttgtgttgcctccccggagac

SEQ ID NO: 33343 - DNA, 1501 bp, Oryza sativa
ggactattaaacagacaaaaaggcaatccaactttccaagaattgataactgaaaatttgaagcaaacataattagatgctgtacacattaaaattctgagagaacttaaatactataacacatatatatctgtacacatgaacgttcaacttttttttaattcaataaccaatcaagcataacacattgacatgtttggtctgactaagaatatagcagcaagaatctgtctcatgtttcactttagcattatcaaaatacattcctaggaaggatttctgaactatacttagcacaagtagcatttcagttaacagaaaaaaaaagatgggttagaaacctgtccagctagcagggaagacgcccacgccgtgctccgaaccaccagccgctaccgcgccttcagctgcagccctgccggctgcccttgcccctgccgctgccccaaaaccctagaagaggggaagggggatggcgggaggcgctgagaggggaggacggggtccggcgggaggcgccgcagccaatccaccgttggccgccgtcgccagtatccctgttgccggcctctcacgcccctccctgttgacgcaagccctagaggaggcgcggggggaagggggtcgggggaggcactgagaggggcggaggaggcaggagaggcgggggaggaggcgcaccggaccgccgtcggccaccgtcggttgaggacggagccgagggcagcggcacgtggaaaggatggaggcggcggcgcgtggatacggaggaggcggaggaggatgagcaatcctgattttgtcggcggggtgcggaaaaaaccgactgggtggtgggcccgcgttcggtggatggtggggtggcaccggttcggtggatggtcgggtggcgcggtggtttggcgcgggagggggtacagaataggtatttattatctccgagtatttattgaagtttattgaagtaattctgtactcataataagtgaattcagcactaaaaatagtagtgaatagttatgaattaatttgtgaattaattataaagtggtatcagagcctggtaatcatagagaagctaaatttagaagctaatattggaaagttaataaataccaaagataatatcaacataaggtgtagactaagccatactgaagaacatagttggcactctaataatagccaactaaatttaattgtagatttaatatataatttctatataaattggagtaagagacaagaagatttagagcaaaagttagaagatatatataaagaacaaaagcaatttgtagaacaatattcttttcttaataataagctaaatactacattagaattattagaagattataagataaggcaaaataaaatttcacagaatagtgattatattaaagaattactagacaaaatcaactctagtaaaggtaaggaaatagttttggcttcatctggcatagtctcatcttcacaagccattaattctgaaaaa

SEQ ID NO: 33344 - DNA, 1501 bp, Oryza sativa
cttatctacttgtgcaacatctttcagctcatctatgtcatcatatttgcctttttgtttatcagaacagttatcatctctgcttgctattcttctaaagagactcctagatatgtccatttttcagaattaatggcttgtgaagatgagactatgccagatgaagccaaaactatttccttacctttactagagttgattttgtctagtaattctttaatataatcactattctgtgaaattttattttgccttatcttataatcttctaataattctaatgtagtatttagcttattattaagaaaagaatattgttctacaaattgcttttgttctttatatatatcttctaacttttgctctaaatcttcttgtctcttactccaatttatatagaaattatatattaaatctacaattaaatttagttggctattattagagtgccaactatgttcttcagtatggcttagtctacaccttatgttgatattatctttggtatttattaactttccaatattagcttctaaatttagcttctctatgattaccaggctctgataccactttataattaattcacaaattaattcataactattcactactatttttagtgctgaattcacttattatgagtacagaattacttcaataaacttcaataaatactcggagataataaatacctattctgtaccccctcccgcgccaaaccaccgcgccacccgaccatccaccgaaccggtgccaccccaccatccaccgaacgcgggcccaccacccagtcggttttttccgcaccccgccgacaaaatcaggattgctcatcctcctccgcctcctccgtatccacgcgccgccgcctccatcctttccacgtgccgctgccctcggctccgtcctcaaccgacggtggccgacggcggtccggtgcgcctcctcccccgcctctcctgcctcctccgcccctctcagtgcctcccccgacccccttccccccgcgcctcctctagggcttgcgtcaacagggaggggcgtgagaggccggcaacagggatactggcgacggcggccaacggtggattggctgcggcgcctcccgccggaccccgtcctcccctctcagcgcctcccgccatcccccttcccctcttctagggttttggggcagcggcaggggcaagggcagccggcagggctgcagctgaaggcgcggtagcggctggtggttcggagcacggcgtgggcgtcttccctgctagctggacaggtttctaacccatctttttttttctgttaactgaaatgctacttgtgctaagtatagttcagaaatccttcctaggaatgtattttgataatgctaaagtgaaacatgagacagattcttgctgctatattcttagtcagaccaaacatgtcaatgtgttatgcttgattggttattgaattaaaaaaaagttgaacgttcatgtgtacagatatatatgtg

SEQ ID NO: 33345 - DNA, 1501 bp, Oryza sativa
aatcaactgctgaatctgaatctgttgctgctgctagttgttgttcacagattctttggcttttatctactttgaaagattatggtcttactttagagaaagtaactttcttttgtgacaatactagtgctatcaatattgctaagaatcctattcaacattcacgcacaaaacacattgatattcgttttcactttttgagggatcatgttgagaaaggagatgttgagttgctgtttttggacaccaagttgcaaattgctgatattttcactaaacctttggattctaatcgctttgcttttcttcgtggtgaattgggcgtaattcatccttttggcatggtttgagggggagtttgtacctcatggttttatcaagcaataatatgataatgaaaaaattgataaaagagagctttgtttatgcatatggtattttcttgtgcatgctagcaatactttgaaggtttatttgtctctagcatagcttgtatgtgttctagtcttttcatgagatttaatttttgcttttaagggagatgatgcatgacacttaaattttatacttgaattaagaaaatgtgcaatgttgatgctagcatatggtttgatctataaatgctctatatatatgctttattgacttgttattcctcaaatagatttaattgctcattgtgaaaaagaaaataaaaaatataaaaaaaatgaataccgaatccttggaaacagtcttgacgacaaggacgtattcaatgtgagcaaaataataggtgccgaatccctggaaacagtcttgacgacagggacgtacccggaataaaagagaaaaatatgagcaaaaaggctcaagaaaagaaaaggttaaaaaattctcttggttattttgtgctaaaggttatttgagaaagagtgataaatgcaataggtatatatgtttagtgtttattcttcaacctatgtgcttgttaagatgttgcattataaatcacatgaaatcatgaattttgattgttgatttaagcttaattgtaaaatctttggttcatggttatacttgaatgcatggttgttctgttatagatgggttcatcttctttttattgcaacacgtgacttgagatgctatatgtatgctatgctctttcacattaatgaacataattcctatgcttgatgaaatcattgtcaaaagggggagaagtaatgtgaaattttttggatttttgggagaagcgagatgaatttttggagagttgttgagaagagcatgtttttggttcaattgggaatttctttcttttaaaaagggggagaagttttcttttgaatttttgagcacgatgtgtacatttgtacgaagtgtgctttttaccacttttgttttttatttttccaaacaccaaaactttttatgaatttgccaatgtgttcatcaagggggagattgtaaaatcaaaggtgtttttgattattattctgtgatgaacaattgggca

SEQ ID NO: 33346 - DNA, 589 bp, Oryza sativa
gtatccaggataaattctctaccaccactatgatatatgctttttttttccacactataaaagcatggccaatgttaccactgtaaactcaaagaaccaagagtgccacacctgcaaattaaacactacagatagaagagaccaaaagagaacacttgacacataattaaccatgtcttacaatgggagcagtgtgatgatcagcccagtggtgcaaggcaaggagcagacggacatcatgaacaacatgcaggtaatcaacatatatattaaatgttgcatatatgactaatactactccctctgtcacataaaataaagggttttgaaagaatgtgacacatcctaatattataagggcccctttgatttgtagaaaaaaatgtaggaattttggtggatttcaatcctatggaaaaaaatcctatgaaggcctttgaaataaaggattgaatcctatccaatccttcaaaattcctaaggaatgggtaatcctatgcacattttggaggaaagttagcaagaggtctaacctcttggaacatatcctctgccatgtatctctctcatctgattcctgtgttttttc

SEQ ID NO: 33347 - DNA, 1501 bp, Oryza sativa
cagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgttaaactctgaattgtatcaacttttggtgtaccttgcctcctgggacaaggaataatacacgcacgtcaggaacgcctgttgggtgatttccggtcgtgacaagttggtatcagagccttccttgaccctaggacgagccgtagatcccaagccttagcaatattttcaaaaataaaaatcctttattatttgtgaaaacccgctattctctctttgtcttgctgcttcatttatcgtcaaaatctgatcttttaaatgttgcttttcttttgtttttgtttgtagatggccggcagcattacccgtcgtggtttggacatgactggcttcgtcttggagctgcgaggcatgtgcgtggtcttggggtatccacatggagtggattaccaggccaggccgcttccggatcaggagggagacgacgcagagccccacgctgcgtgggaggtcacagcagtgatcctctccggctctcccgagcggacttcgctggcagtcaccgcgggcggagactccttccccgccgcttgccagaacgccgctctcctcgccatcggcacccttcaccagcgctacccggacgagttgcagcactcgccctaccgctaccaccctcgtcgcggaggagcccgcgaccacgccaccttccgagacgccagctcggaggatgacgctaccgtcgtgcatctggcacgcatggtggaggcgtacgacgcggctcgtatcgacttccaccagatggtgcgtcgtggcatggtggagaacaacctgaagatcctggagctgcgtcaggagaacctgcagctcaagaaggacctcgacgcgttggaggcgcagctgcaccagctcaagatcgcccagggagaggacagccgtcccaagcgtcgccgcgtctgccgcagccagaagatcaccgcccgcaagagcacctccaggcccgagcttgtccgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcagtagacgagcagttagtaggcttgcgcgtgtgtttttcctcgtttgtcttttttgagttgtgtggggcatggttacgccggtgtgtggtgtaactatgtcggagcctgtcttattttgtttgcctaagcaacttgaacattaatgaaccaatttaatagcagtgataaatttaagaataatagtagtcgtgggtggttagttttaatcgtcagctccttctctgtttgctggttctgtgtggggttttc

SEQ ID NO: 33348 - DNA, 1501 bp, Oryza sativa
gtatccgattgtgagagggattggggattttgggaattgtttcccttgcatccgattgtgagagggattggagggattgggaatcgggggctgcgggcgaaggtgcaccgcgagggacgaaggcgcccttcgtccgacttgtgacgaccggaaaaatccgaatagttatattatatatatatatatatatatttcatcttcaatgatataggatattaagctctaattgtagccaagttacttttcaataaccttcatttttactacttggatatggattgatggttttcgttggattaaagcctcccacgacctccattttaccgaaataacatgttatggagagatttttgaaagttacatacaagttacactatagttacagtgtaattacatgcaagttacagtgtaattacactacgattgtactgtaattacatctgtcaaatttttggggaaaaatttgtcgacaaatatatagcaaaatcgttttctctttaccaaatcgttttcggaggagtttgaaccagttcgcacaaaaaatcatacatttgtgtgttcgaaaggagccctattcttggatgaaatattttattaagtaaatttcagaaatctaaatgtactttgatcaaattattagaaagctaccgatttaacactaaatctatcatacaactacatatttaaggtgaaataccacaaaactatatatttagtaacaaaattatcacaaaattaaaggtttatcgataaattaataaaaaaattgaacaattataagtccaacataacattagtgctaaggatttaaaccgcaaaatctatagatttgtgataattttattattaaatcagtagttttgtgataattagccttaaacttgtagttttgtgataaatttattattaaatttatagttatgtgatacatcactttaaatatatagttttgtgataatttgatccaagtatccgtaattttgtgaaatttactctattttatttcttccctagaagaatccattggcttgtttagccgaaatgctaatggttaaacgtttgagggtagcgaatgttccctccaatctagatatgttgtacgcgatgacgatgacatgtttccccttggccaaacgagtttttcccctttgtccctctgccaattgaaaatagggatctatattgtcaaaaactcgctgtctgtataaaaacacgattcatagcttattcgccatttgttagtacaaaataaattaactaataaaattgttacaagcggaaaaaaaaccttcttgccctagcccacttgcatctctaaattaaacccgttgcaacgcacaagcgtctcactagtgcttgtaaaaattgaagcgattgtacacacatcatgcggagaaagatgcacgagggaaccgaagggtgataaggtttgtgtttggatggtgcccttgtctgaatgctctagctgaggctagaaattaaacggctgagaacgatgcct

SEQ ID NO: 33349 - DNA, 1501 bp, Oryza sativa
  unsure (1)..(1501): unsure at all n locations
tgcctaaggtggtgtttggatccagggacttaactttagtccctctatttagacactaatttagattattaaatatagactacttacaaaactaattacataaatgaaagctaattcgcgtgacaaattttttaagcctaattaatccataattagagaatgtttactgtagcatcacataggctaatcatggattaattaggctcaatagattcgtctcgcgaattagtccaagatttaatagtctacgtttaatatttataattaattttcaaacatccgatgtgatagggacttaaaagttttagtcccatctaaacagggtctaaattaagcgagattctcagagcatatgatccaaagaggtgctgaatctttgacatttaagaaactgtgtgtattacagctagtgcaaaacaataattgagttgaatttcaatatttcatctataattttttttcaaatttctggtttgttttttatttgacatgattagaatcattaattttgacaataatatatataattagtgtacagatggctacttttccatgtgtttccattaacaggtcttagcagcttggcccctgatagattttattgaatcacacacatataggattacatatacacgccattaagcggtttttatttgggtatattatatagtacatgtaatcgattcattcgtttgtaatttgttctttgaagctcttgtcggtattctcttgccctcgctgggttaaaaggttgcgtttcctcttatgccagtaatggaataagttggcatctgcatgtaataacatcagtaatcttttgttaataacctcgattaaaattaaaaagaaatacagtctatctccgttttttaatatatgacgccgtgttgactttttaacaaacgtttaaccattcgtctaattcaaaatttttgtgcaaatataaaaaaagtttaagtcatacttaaagaacatttgacgataaatcaagttataataaaataaataataattactaagatgaatgatcaaacatattttaaaagataaacggcgtcatatattaagaaatggagggagtagtaattaacttgcagaaaaattattggcctaagtaaaaggtatatggaccttttttctttacctgcggcggcgttggcgcattaacagagttgccactgagaaatgaggtcccattgaagcatgagccactcacagggacactggtactgttgcctatgttgtggttctagcaaacatagttgaggaggacacatcatgatccactaatatcatatattaatttaactacgtactgtaagtatatatgccaaatactttctnntctcgtaataagagattttagagggatgtaatatattatagtccaatctggatgggctctccatccagatttagagcccctttgaatcgtaggaatgaaaaaacagaggaataggaaaaacacaggattctggtaggaatacaattgtaaaacaga

SEQ ID NO: 33350 - DNA, 1501 bp, Oryza sativa
gttcttctctgatcacttcaaattctaagctgtatgtatggaaaatcgacagagttgaattgtataagacgggaaaaggcctactagtatgagttctactagttcatttcctagcctgaatgccaggtgtatgatgaaatagcaaggcctggtaccaagaggcaaaagaagataagaggttcagattaatagtttttctcctaagtggtagattgctagtctttcttttctgtagggtacgtcactgcttcagtgctgaagaacatcacaaaggttgtgacagggcaaccggcaacaaaactatgttgaaattgtgatgaacaacatggcagtttatcttaattattcttctctcttatcattatatatcacccttgttagtaatctgtagtttatcctctactctggaaatgaatcaataatctaagattagccgattattctacagtttctgtgtttgctgccaaaacagctaacaactgatgaacaagaaaagttattatggttcaaatactcaacagcacctgctttgacaaggcatatactcactgttgtgatgtcttgacatcaacgttgtggcatcttttttcccacctatttgatactgactggatgtcaattaattgttactggacgtcagtgttgtggaatctttattactagtattttcttccatcgtgctagactttgatgaagtgtttttactggatgtcaattcttgacagccaaatgttatcctaagtcctaactaatcttaactctccaagtaaatgcaagaaaacatcaaaacacttacaaatctaactacaatcttccagcctttgttgtgaattgtgatagattctcacaaaaataatttgaacagacgggatcttagaaaaacatatagctcacgacaggaataataacaatggtgtgaaatagacgacacgttccatgagcaaaagctttaaaacatagggaatgttgatctttttgtgggttgtgacttgataatttgcttttgcaaatctcttgccttttactggacgaaagcttgtggtcttttacaatgtcaaacccaatcaaaggtgtaaaataataagagccagcaaatgtaataattcatcatgttcacaatatagataggaattaaaaaaaacatctataaccaagtcactcgcatcataatatatatgccttttttttttgttgaaacaattcattgaagtacatacaccaaaacaataatgaatatgaaacactgctagagcattagagatttgctgcataaaaatgcagaatcagcacccgttcatcctcaatcacaactctaatgaaccttaccaatgtcatgcagcgcattctgggtggcacagactcctaatagctcttgcagcttcaagcagccaaaccagctatcctttttttcttacatggatatgcacatcgagctcttgtataatacattaaatatttaaaaaatataaacttaacatataacttaaaacaagtgatctaa

SEQ ID NO: 33351 - DNA, 1501 bp, Oryza sativa
cattcacagagatcgatctgggcctaaccctagcacaagaaacctagaaaggaaggatgaggaggaggagggggagggggagagcctcgcctgtagctgtcgtcgtcggacggggaccgccgccgctccctccggcgccgcttgtggcgggacctccggtccttgcgcgccttcagcgccgacgacgaggacgacgccgccgccgcggcatccttccggtggccgctgcggtggcgggcgcggcgtcggcgtcggtcgctccccgaggacgaggacgagtcggaggaggagcccgaggtgtcggtgtaggaggacgacgaggaggtcgcggcggcggccggcggcgccatggagggagctcgtcgcggcggcgaagaatcgaggcggatctgtctgcgggagacgggtgcgagggtacgcgaggtaatgggccgaggagcccgtcacgtgacgcacgtgcgaggtggcgtgtggctgacatgtgggcccacgagtaatccggcccatctgaaatttgatgaaattttagattttttttaaaaacctttttagtaacttttagtttttaatatactctcccaaattttattcctaaaccgggttctagtttgaaaatgagaatctgccgaatcgctcatgtcatgatcttctacatcctaggcctcttttgcgatagtcttcctttaaaattaaattttaaaaagtttgaattttctttttaaaaaaatcagtattttatgtgaacttggtatggagaaatcccattcggacggttggttgtagtcatacctacgaaacagaaatgcactatgacttactctccactaacaaataaaatgttgttttagattaggttttcatgtattcagatttttcaagtctttgtaacttccttgaactttaaaattttgaaatatcaatatttttattttgcaaatatctatatagaacattcatacatatgtgtcaaaagcacatgaaattgtactaatttttctattgatgtacggagaaggggtagtggtgaattggtgatcggatgagtggtaaaagagttagactgggctgaaaggagttgtgttaacggtagcgcttgcgcatggaatattgttccgagcaccgcacgtcgcgcccagagtctgcaaaatccgtgttcggttgcccatgttcgttctatgtagattagatatatttgaattcggggtagttgttgaagatacaccgctggaggtaaatcaattactgtgggttaatagggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagc

SEQ ID NO: 33352 - DNA, 1501 bp, Oryza sativa
gttagagtcaaatattcgtttgcagaacaattgtctggaatcatcatcagataagggtttcatttcataaacaccactgcctgcatgttctgcaacgaccttgtttcgcgtggttacaattattttgctaccaagtttagcatcttgcacagcaagtttgatagtatcccacgctgattttttccatacatcatcaatcacgcacaagaacctaaagatggtagcatatacacatgttattgaacctagatataaatcatgtgaagcctgtccaaaaaagataggaatatgtatcttgcacattgaatatcgaaaatgatgtgcagctttaaatgtgtaattttccaacaattttgacacaataagtgcagctttgtgaatttctattcacaaagttacaaagatacttaattatgcgtaaatagggcagatttctgaataactatgtgttccattggaaaaccaaaactttatttacaagccagttatattataatagtataaaaacttgagctaggattcccggttatattagaatacaataaaaacttgagccaggactcttattcgtacaacaaaaggtatcttcaaataatgataaaaggtaggtataacatagaaatgtaccttctattgttgaggaagtctctaattttgtcgatgagctgcttcgtttcccatgtttcatctatgtgggaatacattttctcatcaagttggagaagaatgttcttgagaatcttgtttatatcaggattcaaggacaccgaaacaaaacaatagctgtcaaattttgccttaagctcctgaaataatgaattggcaagagttgtctttcctaagcctccgaatccaacaatagaaattatatttgattgttggctggatgagccgtcatattccaagagttgcttagttagctcattttttggcttgctaatgccaatgagttctgtcgcctttcggtacatagcttctaggcgagaatcaacatccacaacagttggcctggcagcattgtcgtcgactatgtacctatcacgacgttcgctgaccttcttgacctggtccatgatgtctttcatgacaccgtggatctgatggttggttttgaacttgttgaacaaattggtgaccttcttgaagctcgtggcaggttcatgccccttgcactttaacatgaaggtgtcgatggcatcctcgatgtcgtaagatagctctctcacctcgctggcccagatcttgacctgctggtcaagttgatccacaggtgtctcagccaccttgtggagtgctgcggtcatacctttcaactctttctcaagttcttcgatctctcccttgacacccttttgcagcttgtattcgccaaccagcagctccccaagcttggggaggagggtgttcattgcccctgtggcgatgttcatcttggcctatctgatgttgaatgcctgcacgggtacacacagatgcacttaaatgagcctcttgagtttat

SEQ ID NO: 33353 - DNA, 720 bp, Oryza sativa
cctatctcgtagagatggcacgttagccctggtcagatttataccaggcttcatcctaaccattacaggcaaggtgttacacgaagaagggcaaacatgcacgttgttaagctgacgcgtggtggacaagaatgaccggtctggcaccggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagaagggactttttccctagaacaagggaggggaaaggaagtgaatcctttgtaacttgtccatacacaaatccacaaaaacacaggagtagggtattacgcttcgcagcggcctgaacctgtatacatcgccgtgtctcgtgtgtcttgcgggcgggtgatctttccacatacagagagagagagagagagcttgggattgcaccctaagcccctggtcgaaccggcaaaggggggcttgcgcagtctcccggtgaggggccacgagctccgtcatctggcgcgccaggtagggggctcagcgtgtgttttctgagctctcatactcttccgtgtgtgccaagtttcctttgttcagcctaa

SEQ ID NO: 33354 - DNA, 1501 bp, Oryza sativa
cctcgtatacctttttctttcaaattcgatgcaaatagttgtgaaaaattctgaaaaaaatatacaatatagagtataatgatacctacaagtccaccaaaattcatgtttaaattcgatctacacatcgagaaacaaaaaagacaaatttagatataaacagtacgctactattcatacgctgaatttgtcttttttatatctcgacgtgtgagttgagtttggacttaagattttgtggagttgcatatatgtgttgtatggatgttgtcaaatttctccagaatttttcataactgtttagatgttctttaagcaaacgagggaacatcccctcgagggattagaatagtttccccgcatttatctatctttgtaagcagttatggcttggtgttggttggtcaatgatatgatctttgttttcatccatccatatctatatggcgccatgatctgtgttgctaattgctacgaattaagtttggaagcgatgaagagcatgattggtactgacgaactagtaagtgtgcagtaatttgacatcataaatcattgcactcttctttcattgaaaatttcatgtgtatgtttagcttttatttgttttcataaggttttatatttgtcatggcaattcctggttgcctgattagattggatggttcttgactactgccaatccaaaatatccacttggcatctgtgaagctctattcacttaaacaatgtgtttttcgttgttcctgtctcttgctgtttattgatgatttttttgaaaaattttgtccatgattcgtttgagatcattgttttttatttgtgagtaccagatcatatgggttctgtcaaacaggctcattgaaatgggcagtacatgataccaggcagcagaatgcttttcatcttgaaatactaagtttatagggttttatttttcttagtttctatagtgtgataattgtacggatctgtctttgtatcccttattaccctttacaatctgatgtatgcatcatttttcctgtatataatgctgtaaacataagtttttgtgtgttgagagcttacagttgctttgtcctttccgatgctgtttcagagcttgtaattggcttttttttggtaacctgatgcaagggttctgcaaagcagagtaacacatgctgtattgaccttgtatgcagttgtgagcaagatatactattgcactattttacaaggtttgctttctcctctactttcttcagctacctttctgcttctttaatttcctaaatttgaataatgcattgacatggcttcagagatgtatgtgcctttctaagctgttttgattgctcatcctgatgcagagtttcatgttcaggttgctgtctgtttgtctttatatgatttagaacttcagaacaaaaaaaaaaaaacaatctgttggcattgttgttcctcttgaaattgtcacgtctgtaccatcactttaattatttgaatccttcttgac

SEQ ID NO: 33355 - DNA, 1501 bp, Oryza sativa
tcttcgataatacattgaatgcatggattatacaataaagtgaagtagaaaatatgatggcatgcaaaaaatcacaactccgaggaatcacgtgaaagcatgtatggattgaagggctcacaagtcagaccaaaccaacttaattttgctcaatccaccgtgcaccgccataggggtccacatagcagcctttgggacaaagtcggtggagagaggggtggcatagaggttggctgaaccgttatcttcccccctcatatccaccttctacgtggatgtcattgattgcctcctaatgacggttgtgagcgttaaccgacattggcaaccgtcataagcagctactagtttatacctcacgctttgcggcgggatgtgtggatgaatgcatattatacattgtagaaatgatagatatatatatttaaataatgtgaaaaagatatggagataatgatttaacattgcttgtatgacctgtaaaaatataacaaaattctaaatgatatgttatgtttgcatgatattcaaaatactatagataattattgctggtggataatgatgtggtacacttgtatgtgatttaaaatattctaattaataattgttagtgggtgatgacgtggcacacttacatgatgagctttaggagttagtggacatcatctatacatatagtacagataaaggagggaaactctcacttcacaacactcaagaagcaataatagaatagattagtggagtttaggcttagaatagttcttatgtttactagtcttcttaaatattcaggtatgtatttgtaagactacgagctcaataatagaattatcttctttatttaattgtgctcagggattttatgctcggttgtcgatctatgctgcaacattggtccgatgatgttaacgggtcatactagttcttacttgtccatatgtagagtgcgagtcctgaggaaattagtgatattatttagcaatgtaagcatagtgcatagattgattaaatatcgttcgatgtgggtgtgccccacaaaaagtgagataggcggcaggtggtgacagccttgtccgtcctttgtattcctccacatttaggtatgatgtaagatttggtaaatgccataaccatactagcagaccaacaggggatggtctctcggtagtgtctgggtgcatagaactatgtcctagctatatatatgtatatgattgttgtattgactaaacatgataaatatagaagtacatatgaaaccatagctattcattttgtctttctccaatcgctagtttacttattgaggtggttcttctgtgtgtcacgctacctaactattgtcatgattatcatttacccatattagaccatagtatattaactatagcatgattttgaatatatcggcctattcttcatattgttgtcttccctacggaaaaacaaataatgatactaaaaaggtcacttaggcctagagggagggtgaata

SEQ ID NO: 33356 - DNA, 263 bp, Oryza sativa
ttattgtgtgcgtatggaatgcggggtcgaatttgaaagaagtccaaatttggtacgttgggttatgtaaagtttctttcttgtactagagggtttcctaaggtgtttaggactcctagtatgagtttggttcgtggctttaggctgcctacctcatgtataaatagagggggagcgtgaggcttcccggtatcgctttagagagcaatagagttgagttttgagctagggtttcgagtttagtcgaaatttttgtaaggagt

SEQ ID NO: 33357 - DNA, 386 bp, Oryza sativa
gtttggaaaaataaaaaacaaaagtggtaaaaagcacacttcgtacaaatgtacacatcgtgctcaaaaattcaaaagaaaacttctccccctttttaaaagaaagaaattcccaattgaaccaaaaacatgctcttctcaacaactctccaaaaattcacctcgcttctcccaaaaatccaaaaactttcacattacttctcccccttttgacaatgatttcatcaagcataggaattatgttcattaatgtgaaagagcttagcatccaaaaattttcacattacttctcccccttttgacacgtcttcctcacgtgcagccacgtgccacataccaccacggcatatggacggaagacatgacatagtttccaacccatccta

SEQ ID NO: 33358 - DNA, 1501 bp, Oryza sativa
tcccccattttcccctctctctctctcattcaaacgagcggatttgctcccgcaaatctcgccggcgccattaatagcggccggacctcccacgccggtttccttcctccccggccgccctctcccccttccaaccctatttaaaccctccccgcgcttctcccgtccgtttccgcctctcgccgcccttcctcctcgccggattcgagctcgcgccgtcgccctctctctcctccgtcgccgacgacctccggccggccctcctcgctcgccgggactgtctcccgccccggcgtcgcctcctccggcttcgccgcaccgccgccgaccccgtccaccacctcgccgagctcgccgaccgccggaacgccgtcgtccccgtccacccgagccgcgccgccgccttcctccactccagccgcctctttcgtcgtcgccgtcgacccggggtgagccgtggaccgccgcctcttttcccccttcccttcccctctctcggccgccgctccgccgtgcctatggccgccgccggcgaccataggggcgtgggcgccgcctcccgccggccgcgccgggaggctgccgcgtggggcccggcagtcagccgcccacgtcctcgggtgcggctgatgcgtggggcccacggcgccggccggtgtgagcccgggtgcacccggtccaccgtggaccgtgaggctgccgcgggggcccactcccgtggacccggtccgcgcgcccttccccctcggctgacgcaataaaccattttttaaattaaaatttaaatgaagaaattcgtaaatattcatttaaagagcatataaacttcaaatgggcataacttggccatttgaactcggaattggaccgttcaagtctctaatttttccttaagaagtcaagtacccatttttgtgctttgttcttgcttgttatatggggtttattagagtaaaagcccttttcttttccgttggtcgtgtagacgctgcagcttcgggagatccgctcttcgtggaggttgaagccgacgtttgggaaagcgagcaaggcaagtcacatcatctttgaacatattggatcccactttgtgaaattattttgatttaaattaatgcattaccgctttatttaaattcccgcgttatcactgttttatttagccatgcctatttacctttgttatgaccttattattattgctattgttattattaccttgttcaccctagaataaacaaaaccccaactagtgggcactctattcatggttccactagtataaatttaggtagatgcttcgctggttaattaggcaaactttaggtggttttattaattctagactttgggaatattcatattacttggacattatggaatggttggactattgtggaattggacacacacctccccctctattcaaaaccctcaaaatggttttaggctgggctaggggtgcatttgatagtagcacctcggccacataaggaccggt

SEQ ID NO: 33359 - DNA, 305 bp, Oryza sativa
cccttggaatactctcgggtgaaatgctataatggtatatccgtgcgcttgcggatgaactctgtaaccataatataccagaagtatttctgcgccattgctgggaattatatttcttgtaatgtcattaagaaataccaacaagaggcgtcctccttagcatggcttcatcaccggtggacttctcgccggttcattgacatggagctgcaggtgtgttgtcctctcggaccgcagtttcaccgctttcatcgtcttcatcgtcgttcacgcttcgacaccctcatcatccccactggtcatcg

SEQ ID NO: 33360 - DNA, 257 bp, Oryza sativa
tagtctcttgaccacttcaatgtacaccttttgaattgtacaatagaggggggtaagggggggggtgcctgttgaaataaaaaatcttctgatcaaagtaaggttatgaaatatgaacaatttttcagtatccaaactgttccatcggttgttaaattcaataaaacagaatgggctacctcgcatatgcccccctcataacaaattattttaggaaggcaaaagatttgatgcatttgcattgacagataatgatg

SEQ ID NO: 33361 - DNA, 1501 bp, Oryza sativa
gagcaccacttgctggccgggcgctccctgctgggagtaccagcctctttctttttgtcgctcgcaggcctcccctttcgggtggcccgcggagcgccctcgacggcgaggacgtgaccctcgtcgccggaatgggccgaccttttcttcctcctcctgtcacgccgccctgtctgagcggcggatccgggggcggccgaagctgccacaccggaaccggaggggttccaggtccaggcctcctccttgcgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcacctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtcccttcagggccatgggaaagaaattagccatgaccctgtcgtctcccccagcggcctcgatcccggtcgtatagatctggagaaactcggtggggttgacgctcccatcatacttctcggtgatggtgggccggaaccttgggggccaacggacattccgaagactcgccacaaaggctctacagccaacaccaccaaccgggggcacggagggctggtcctcacgtccatgtcgaggtgacactctggacgaggaggcgccctccgttgcacggggagtacgccggctattacgccggcgctcgatgttgaggcgggcatccggctccccatgctgatcctcccgagtcgaaggtgtcgacgagggagtggcagccgaatgccgtgcagccgccgccgctcgccgcgccctccgccttgatgacacggaaccggtggtggcggcgccggaggtcttggtagtggcggaccgtccaccagcacccaggcgctgctgggccatcatgaccaagttggccacgtcgtccagccatcgctgagctggagactcagggtcatggacgacgggcgggtgacgtaggagcgcgccagcagcctgaagcgcgccctgaggcgtgctgccgtcgccgtagacgaggaggcgacgctccccatctcgccgttcccctgcatcacccgcaatcggtgatgctgcggatttatcaactctctcgagcgcctccccctgcttaggactttggagtggaggtgggggagtacgagctcgacggcgtgggttcggctccccgtcgtcgccgctcacactcggagagaggtcgtgcacctttgcttgctcggccattaggctgaacaaaggaaacttggcacacacggaagagtatgagagctcagaaaacacacgctgagccccctacctgg

SEQ ID NO: 33362 - DNA, 631 bp, Oryza sativa
aaaaaataaaataatctatttttaagtttataataattgatacttgattaatcatgtgcaaatgattcgtcccgttttccgagccaccaacagctacagccgtctaactaattcaaattgaacctaaaatgaaaataatttgtgggacacaccttgttgcaaatatttttgtgttataaactaaataaattctggaatctccatatacaaatgtatattatgcataacttggagaaaccggccggccaatggcccaatgcactgactcacactccaccaagaaggcaagagttgagttttgggatgtagtgaactagtgataatacaacacagacccagtggcctgaagtatatactccccccgtatgtattttaatgtatgacgccgttgactttttaataaatatttgacctttcgtcttatttaaaaaatttatgtaattatcatttattttattgtgacttgatttatcatcaaatgttctttaaacatgacataagtatttttgtatttgcataaaaaatttgaataagacgaatggtcaaacgttggttaaaaagtcaacgacgtcatacattaaaaaaacggagagagaatttgttgcacatgtgaaccttcttgccacaaagc

SEQ ID NO: 33363 - DNA, 1204 bp, Oryza sativa
ttttttccgacagatattgtatttcggtagatggggatctccaccatgtcgtcctcccggtggctacaccctcgtccatgtccaccttgtagcagctccgttgcacctctacccactcgctcggctggcttgcttcgccgcctcctcgtgccaaaaccctagaggctacgccttgcctagcagtgtggtgagggagacaggtgttttttcttgtcacaggaaccttatcctatccaccccaatatctgacacgccctagtgatatagcaacagacagctcgtcggtccaagatctttaccgagtacctacagatagtccgtcactttcttttactgacagattgtttgacatagttatctttttaccgatagattgttttgccaggatatttaccggcagactgacttgtaccaatagtccatttttcccaacaaactattgccttctatttggtgttgcggtgtagtgtatatactgatcaccagatgatcaatgctatagtatgaatatatttaataattacagcaaatagaaattttaccgttcactaattcaattttagtgtgtcacatcactaggggaggggtaagaataaaagctctaaaaactcgcggctcagctcgaatcaagctcatagtcctaacgaggcaagtcaagctgcgcttttatctctttagtttagcgagctagctcacgagcatcatatcttctttttatacttgcttcttaaccaatacttagtcctttatttattttaaaactatttgtatttagtttttttattagttaatattttattattatattatgaatcggtaaatttaaaactatagagccagtaatattaatataaattagataaaatttattgacaaacctaacaatcttaatgaaccagtttgcaaaccgaggcaagctagcacgtttattaaggtatcgagcctaataagtcgagccttaatgaatcgagctggctcattacccacacttacacatcatagggtttgggtcaacaacatgagcatatgctgttaaaattaaaacttagagaataattatgtcagggttatggatacctaatagtagttgactaaatctcggcaggacccaccacataccatgttttatacggaaacaaccttcgggtatagaaggagttccggataaagaaagataaatagagttctacatggacaacataga

SEQ ID NO: 33364 - DNA, 283 bp, Oryza sativa
cttgagaggggtatcgaaccggccaccgctaattagccggaacgatcgaagttctggtactatgctcacggtggaacgctcaacccagctgatggcccactggtcttcggcgatcagatacaagaggctgcgcgttgactagcagacgcagtggaagcctcttcttagggcacgttccgaccggacagagagagggacgagctgtcactcgccctgcagactccagagcatccaggacgaacacgagcgaaaggggtgattccttggaagattaggttcaagg

SEQ ID NO: 33365 - DNA, 864 bp, Oryza sativa
tgtactgtttatgtaccagcggtccgatggagaccgattaaggttgaacatacatctagaactccaagtgtaacaccccagaaaaccacataagcctgggatgccactaaacaaccatacaaaagtgccaaaataagcaaatttcagcaacaactaccttagataagaaaacatcaatacaacaagacaagcaacatgctaaacaagcattaaagaaatatgggaatcataaccatttgcaatacaaaataatagttggatgcaagttgcaaacccataaccatcctatatgtgcatgtgtgtcaagttaatcttcattttcataaaagttgtaggtattgttctgtagatttccaaagtgtatttatttgcagtcatatcctttttatattttgagatataaatgtttgaatcagcagtgttgtttatagtccaagcggcgttccttgtatttgcgtgttaacgggctagggccataggggcatattatttattgttttatatgcatgtttgagtgtatatgctgaggttgtcttgtgaataggtggtagtgcttcggattatgcttggtatcgtctcttcgttgttagaggcaagtaaacgtagcggtggtttgctatagctttaacctgttattttattctaccttcactttgaaaatatatatcatcaaccgagatattattattcgttacatagaggatttacctatctgaatcacatattgatttttacactgtatatggttatacttatgctcttggttataatacccttatactgatctccatcgaaggaatgtggttccgatattctactctggaattcatactgcatttgcatcacttgcattgcatttgaagt

SEQ ID NO: 33366 - DNA, 464 bp, Oryza sativa
taatgcttgcggcgcgttatagatgaaaatggagttagatactacatggatggcagatgtctcaggcattgagatgtagatataggcatatagcacaccaagggaatatcgtcgatagccatgctttgtgctgcataatttggagtcggattttgagtgttgggaatatttgaatgtcgatgcgacgacaaaatgggcgctgcgcaaactgcataataatgccataatgttattcaactttaacatccatctgtctttaataagaaaatagagacggcaagcatttcttctgcctaaatattctaatatagaaaacccttgattatatggtgcttaggtttccttttctcaatgtacctttgctagttacaatacaaatgtggcacactgtgacctgcaatgtgcagcacaatggcaatggcaattaattcttctcatgtgatttttttccctgcaactttctt

SEQ ID NO: 33367 - DNA, 1501 bp, Oryza sativa
acatctacgtaattcattttcatacaggtgttgggtgtcaggagttatccgatgcaagaattccacataatcagcagaatggaactgtgcgagctctgttggatatgctttgtggggcctctgcataaatcgttgtgtgaaaagtaagaggtgaaaggaactttaggcagttaacaagtgcaaacgaagggaataaataaagttcatactgacatatatctccatcttcttgtgaagatcatatgaaagcacaagatgatgtgtcatacaaagtcgatgtggtttcatcgggtgatttggcccaaagtagacattgcccacatcgcctgaattgttcattgacacagtaaaaaggtaaacgatcaaaacaaaatgagtaataaaaattacacattttgaacaatgaaaacttcctttcacatctgcaaaatgagtggctctctataaacagagatgtaaaggaccatgggtgaatgagggcacaagtcatgaaaccacctagtacaaaatatgtgagagaacttatcatggaaatttatgtgtgatctaagaaataaccacatatggctggcgttggtgaccttttagaaaatggctggcgctaaagaatataggaacttgttaaccaaatctagcctgactgcgccctcttaaacagataaagggatcaacgattctaattcaaatcttgattcaagggttgcttccccaccttatgttactgactgataatgaatcatgcgtcatgcacctagggctagggcaactgaaataccacaaatcctagttgaacaagtcctgggaagttcatagttctggaatttctcataagccgtccaaccgtaacatccactccaacctccacaatcatataacaccactagaaatcagcttaggtactaattgcatgccccttcttcgacgaaattaagccacacaacatcgagacggcgtaggatttcgctctatcatctagagctagagctagggttgctccagtgattagggagaatggagaggagatgaggggggcttagcgaatgcgcggtcgtaccatcgtagaagtaggctatcctgtctttctccagcatcgcttcgctctcgagcggccgctcgccccccaaccactacaagcggcggcggcggcggcgcggaagggtgagaggggagccggggaagcggagtcgcgtcgagaaatagattccgattagaccgagcgcggcggcggcggcggccgtgcctcgggggagagaccaacccgagtggaacgccgctgtagaaaggcaccggccgcactggagaggattggaggagccgaagaggggagttggcatcaggatggacggtcaggatcgtgttgtcaccatcatcggacggtgcgtttgtttccctgggctacttggaaattggaattctacttttcctctctttctgtggtgtgttatcagcaacctgtgggaaacaggaaacgacgccggcggcgagatgtctcctccgccac

SEQ ID NO: 33368 - DNA, 372 bp, Oryza sativa
aatatctttacatagagtagtatcggagtattagccgatacatgctagatccatctgattggctatgctatgaacatatatagtctcgttgttaatatatatttcgatctaagtgatttatactatctcggcatggcgaccgatctatcccaatcacttgatttaagtatatattgacataaggattatatatcgttaatatctatagtcgatctagtagattttgttatttcttacttattaatgattgccgatcgatgcatatatgacatcggctcaaagataaatgatatgtcatcggcacttagccgatcggctatcgtttatggattcaaccgcagtttctttgtctttgttcttgttgattgcagg

SEQ ID NO: 33369 - DNA, 155 bp, Oryza sativa
aatagataagcacagaggatcctaatccaatgaaagtctagttgactaaactcaaatatagattatacgaaactataaacactaatcaacaaaacaactcttggtacttcctatgctcctgatgattggccaattgctgttgcctttctaaaaga

SEQ ID NO: 33370 - DNA, 272 bp, Oryza sativa
ccaagatgacaatgaagacaggaagactcaatggtgtccttctggtatctttacaaaaaatcagaagagaagggtttaaaggttgaggaactggaagcgctttcaggaggttgagcaagaaatcaatcatcggttgaagaaggcgaagccgagacaggtgtggcgtgttagaaatcaagctcctgtagccgatgaagccgcagccgatgaagcgaagatgttggctaaaggaaaaagtgttgtgaccgcatcggttacatggttttcatatt

SEQ ID NO: 33371 - DNA, 1501 bp, Oryza sativa
ttagtcagggcgaagccccctcatggcgaaggctatggaacaaggacggcgagaggtggggaatcgcgcaggtaccttgtcgggctagaggcctcttgggtgaaggatgcagggcgaagagtatatgctgaaggatgcaagttcgcccctgcgaggaccgaagaagccattccggcccttcaagccaaggggctattgcgccgacgatcgcctggcggcccatcaggggctcatgaacctcaattacattatgtacccatgtaaatgtccctttcataagggcaaccatataaattcccctgtataaccaaaaccctagtagtaagaacctgtaatgggggctataaatagtcccatagggccttgtaatagggggatcccaagaaaaattctcaattttatacactttacttcttttccaactactgttgagtgaccacgtctttcgacgtaagctgttgtcgtttcgacaacacaactcaccaggctcatgtgcatatttactggaaagagcatcagcagcaacattggatgctcctttcatgtaacagattttaaattgtaaatccaacaacttggtgaatgctttgtgctgctagggggtgtgtaacctctgctcactaagatgcatcaaactgtgatgatcagtaaggattatgaattcagcgtgttgtaaataagacctccagtgatccacatctagaagaatagctaagtactccttttcataagttgataaacctctagatttcacacctaaagccttgttgacatgaacaataggatgaccttgctgacaaagcacagcaccaatccctgcatcactgccatcagtcgcaatagtgaatgtcttagaataatctagcaatgctagcacaggaactgtcaccagagctaacttgagagcctgaaatgcttgatcagttgcaggagaccatacaaaagaaacatccttcctcaacaaatgggttaaaggtttgctgattaaaccaaaattcttaacaaattttctataatacccagccaatccaagaaatctcctaagtttcttgacagatgtaggcactttccaattgacaacttcctcaatcttagttatcagtagtgaccccttgaccactaaaatatgcccccaaataagccaactgatcttgggcaaaagaacacttactaaacttcactctccattttttttgactggaacttcacccggagatgagacaaatgagattgcatatctaaattgtaaattaaaatgtcaccaaagaagaccaaaccaatttttttagtacaggggctaaggtgttaatcatagcattttgaaatgttgttggtgcacctgttaacccaaaagacatgaccctgtattcatagtgaccagaatgggtttgaaaagcagtcttgtgttcctcaccctccatcaacctgatttgatggtaaccaaccctaagatctagtttagagaaaaacttttgatccaaccaactcatccaatagttca

SEQ ID NO: 33372 - DNA, 1501 bp, Oryza sativa
actattcgaatagccatgcccgccgttatgggcgagttgagcaatgtttttcgtgattagtctcacacctctcacaataattattgatgctataaccggtaataatttgtgtagctcctggtttggagttaggtctgtacagccgggtatggttgttcaggatggttgggcctgtgcagcatgggtgtgctgttcagtgttgattaaaatttctgattaattactctactgttttacttcttttaaatctttgctaaatgctgcttttgcaaatgagcctatattatgccatcctttggtatccttgtgcacttgcatatttgctgtgtggcttgttgagtatgtcatatgctcattcttacaataatcatcaaacctcaaaaaggatccagaaggagaagacgtttggcttataccccagttgagctgcctgtaggagtggagctgaagccatcgctagaccgttattccgctgctgttttcttttcttttgtaagtatgtacggttatttttatgatggatttgtatattaaattgtcaatttgtgtaccttggctgattcctggatgaggatttttatgcacaaattagttcggaaattactagtgaatttccgggcgtgacatgtgtgatccaattcaggagaaggtaaggtgggaaatagcacctgtaggagacgtaggagcagaaaatggctcacgggaagcctgctgaaccacaatctgcagcttctcgaccttgtcttgcaattccaccaccgaaccttggagttcatccacgcgtttctccacgactgtaaaatgagattccaccaccaccttgagagccatgaactcaattcggctcttctcctccgactgctccctgcgcttctcgctctcttcccacttgcgatcggaatcctccatcttcttcaagagtagatctagcttgccatcctgatcgatgactttggccgccatcttggtcacgtaccttggcttgtcgtactccaccgtgatgaaacctggcgttcgatctcgcttagccagttgagggagccaaagcttttgcgggatcagatcatcgaagcaatcaattcccacctctcctaggaattacaacaaaatgaggggaaatttttttcagcgagactctgataccaaattgttagcaacccaacacccaatcactcaagaacatgcaagaacagtagatagttcaccgaatccgataggagtaccgccgccgccttcgctaccgttcttttctttcttgttcgattggaaaggaaatagagtagttatagtattacattccagtctctctctctctctctctctctctcgctcacattactccttgtgggtcgggaaggtgctcatttggcccattccagcccatacactttaggattacatttacgaatacgacctatcttttctgtagaagtctgatgctcccactccagcttgtcgctcccctatatatcatcaggcaagggtaggttcctgacaaaga

SEQ ID NO: 33373 - DNA, 1501 bp, Oryza sativa
aatgaaactattcctcagctaatcggtcctgcaatgcaacgcaagaaaaacctaatccaataactcctaataaattagataatatgttttaagttttactaatgatgaattagatatattgctggactttaacatattttcaaaaacatggtaaatttatctcctagagttggatgtaaagattaaagttagactttctatgcaataagatgtactatacagttcatgaactgaacaaatttatagaaagcacgacctaggaggacatgacccatgaggtctagagaacttttgggttattcataatctctagatcaagattcatggtactaaatgtgtaatcctctatgtggaaactgcaaaatagtcctggcatgttatagtatccaagaacaattttcgtaaactcctctcgaaaaagtaaaaaactgaataattgctattacagctgaatacataacttgtatgtttagagaataagttatataggtgacagaatatgtgcgccatacaaagaggagaacatggggagtccatgtgaacggttcaacttagtactgcaagcactcgtgtaaacaggtaaaaccgatctatatagactaccgagcagagaatgaagaagcacatctagactttcccgcatgaccaagaagaaaaaactgaacacaacttgcttcacatttgtaatttgggcatgcaaaaacaaatggtttgctcaacatagagcaaatgttctagcagcgagaacaattgggttgcaaagacaaaaggaagatctaacatggagcaaattttatagtagcaagaacaattggttcgcggagctaattcaggtaagaattgctctcaaaaacggtaggatttagctatctaaggtatgctcaaatctgacaacatggctgcagaggcaaattagtaaagataataattcacattacactcagtaaacaataattgaagaacttgatgggttttaccttgaatcaaaggtttgatgtaggcaagcaacctttaatatatagaagctaaactcttaataatcatgcggagtgaaataagatgtagtgagataataatatagcttgttatcatgagaagtactccgtcgtatacatgggctgctagcaatccctggctgcgccaagctgccattgcatggatggccaagcaaaccagtttagcagagcttgttgtggcactccgtcgcaggctgcatttgcacagccacacatgcctcttggagaacagcacattcgtatgggctgctaagtagcttgttcttctccatatcaaaacatcaaggagagcattccagcgagcaaaatgtagatggatatatgcactcaactacaaactttaaaatttaagggatccatttggggaaaactcaccggggttggcagaagtttcttgagtggattaagacatacgtgctaactccaactatttgattgtaatgaatatacaaatgatgaggacaacaatcatatgaacacggcca

SEQ ID NO: 33374 - DNA, 1501 bp, Oryza sativa
gcgtgctcggccagcggcccaagcacggcacggctaaacgggccgtgccggcacggcccgttactgtagcaggccgtgccgggccgtgcctgctacaggtccggccgtgccgcgcgcggcccgtttggcccggcccatttggccacctctacgcggaggagaccggggtcgccgtaggtagagggcacatggacggttagatcgagcctatcgtgagatcagacggaggacgttggcgggaactgtcgcgtagttaatagaaagcgtggggttttttctgcaaaagatcggctgacgtggtgtgctaacttttcaccgatcctacggggtttagagaggttaatatacttacacacgtttattcttttcattattcgttccaaattgtactatagaagacaaatgtattccttagaagaaatataagtactccttactatagagggctaatgtactacatagtaaattattatatatatgtttttcgaagaaaatataattttcgggctatcttctttgacatcacatttaaatttactgtcatgcgacttaattcataacatgtttattcttcttatcattctactccctccgtttcacaatgtaagtcattttaccatttctcacattcatattgatgttaatgaatctaaacatatatatttatctagtttcattaacattaatatgaatgtgagaaatgctagaatgacttacattataaaacagaggaagtatataattttggttccttgaaacattgactagaaaagaaattgggtatttcatctatagtctttttttagggatatgtagctttttttttatttcatttttttggcagctatataattcaaatgcggatcatgcggatcgtacattggtcatatattctcaacaagttgtaagtatatttaactagattgttttcactaatattacacattgacaattactcttttaagctcgcagcaacgcgcggggtatcaactagtttatattaggaagcaactaaccaacccaacaccctatttttctagattgagaccatccacttctgcgcctattttcctggatcgaccaagagggaaggtttttccctgtgtgccattaaaaaagatggtgtctgcccttgtgccactaaaaagtttgagcctccctttatgccatcgtcgaattttatcgtgccctccacaccatttcgtcgctattctgtttgggtttaaccatttggtagctctgacatatgggccgggtagaaaaaatgtcgctcctgccctttcactttttcttctccctcgattcccctcttctccctcaggccgccgccgcgcaggcccgaccggcgcccggccgccgcccagccggggcaccgtgccgccgtcgcctcggcccggtcgtcgtcgtcctgatcctcgtcgtcggtgcgctgttcctcatcctcggcccgaccggctcctccagcttcaccatgccgcggatccgcacggagttcaacgaa

SEQ ID NO: 33375 - DNA, 1501 bp, Oryza sativa
tggggttatatgctgtggaagcgaggtgggccgctgatggtgacagctcagtacgggtattcctccgcgcgtgtatatagtcctaagttaatttcctggggagggtactcctccgtatttagcctcggttgtatggtcaagacggattgtcgtaaggaactcggcaatcaggggtggcttctcgaaacaccaagagggcatcagatagagggtattagctaagtagtaaaataattaggatgtacgtataatatgtatgtatactagaagtataggaatatgatgtttctatgttctttctacttagcttagataatcatgagtaagaggatgaatgcttctgcttagtgtcactctaccttatgaattatattaacccctgcttagactttggttattacaaataatatataaattattactacggttctctctattataatcttcccaagggattaaacaaatacgatacccttggaatactctcgggtgaaatgctaaaatggtatatccgtgcgcttgcagatgaaatctgtaaccataatataccaggagtatttctgcgccattactgggaattatatttgtagtaatatcattaagaaatatcatcaaatagttagggggtgttgcctacataattgtacaatagcaagtgtagactaaaatgactatatactagaagtatagaactgatgcttttcttattcttagtccacttagcttagattattattcatcggagcctattttaacacctggctatgaaatttgtcccgaattcataagtatggtttgggataaatctttctctagtctagaccaggaaaacctctaccatcacctccgagagtttgagcagctgtgttcgtgcctcctgattcaaggcatgacacatgagactgttaaatggaaattgttttcgttctctcttcaagagagcaaaacaatggtacatttacaccgttgggagtgtgagcagtagctggaatgaattgcgagacagattctgccttggagggaatagttaggggtgttggctgcataattgtacaattgtaagtgtagactaaaatggctatatactagaagtctagaactgatgcttttcttattcttactctacttagcttaaattattattttagtgagagtattctagttgttcttctgcgtgccaacctatctttatccttgaattgatcaacccctacattagacttcgatatgcataactgacaaaaattagggacaatcgctcgtttgaccctattttgaagtttaatttccaatctgaccctactttttcagatttgctcatttgaccttgtttttcaaaaccgtacttgccgactgaccctactttcactcccccgtcaaatttcatttaattaaaagaaaaaataaatttactagtccgaaaatgactaaaatgccccctgattctacaacattgtccccaaccttatctaggcggctgccacacacacggagggggcga

SEQ ID NO: 33376 - DNA, 1501 bp, Oryza sativa
gtaccacccctcgttctcctcgttctggatgtactccccccaggtggacgagaacggggtgccgtcgggcggcggcggcagcgccccgacgaaggcggcgaaggcgaggtcgtggttgccgcagaggaaggcgtggcgctgcgcggggtggcgggacgggagcgcgaggaggaagtcgatgacctcgcgggtgctgggcccgcggtcgcagtagtcgccgaggaagacgacgagcgcggtggcgaaggcgtcgggcgggagcgcggactggaggttcgcccacaggctctccagcttggagatgtagccgtggacgtctcccacgcagatcaccacgcggggaggcggcggcggtggcggaggagacatctcgccgccggcgtcgtttcctgtttcccacaggttgctgataacacaccacagaaagagaggaaaagtagaattccaatttccaagtagcccagggaaacaaacgcaccgtccgatgatggtgacaacacgatcctgaccgtccatcctgatgccaactcccctcttcggctcctccaatcctctccagtgcggccggtgcctttctacagcggcgttccactcgggttggtctctcccccgaggcacggccgccgccgccgccgcgctcggtctaatcggaatctatttctcgacgcgactccgcttccccggctcccctctcacccttccgcgccgccgccgccgccgcttgtagtggttggggggcgagcggccgctcgagagcgaagcgatgctggagaaagacaggatagcctacttctacgatggtacgaccgcgcattcgctaagcccccctcatctcctctccattctccctaatcactggagcaaccctagctctagctctagatgatagagcgaaatcctacgccgtctcgatgttgtgtggcttaatttcgtcgaagaaggggcatgcaattagtacctaagctgatttctagtggtgttatatgattgtggaggttggagtggatgttacggttggacggcttatgagaaattccagaactatgaacttcccaggacttgttcaactaggatttgtggtatttcagttgccctagccctaggtgcatgacgcatgattcattatcagtcagtaacataaggtggggaagcaacccttgaatcaagatttgaattagaatcgttgatccctttatctgtttaagagggcgcagtcaggctagatttggttaacaagttcctatattctttagcgccagccattttctaaaaggtcaccaacgccagccatatgtggttatttcttagatcacacataaatttccatgataagttctctcacatattttgtactaggtggtttcatgacttgtgccctcattcacccatggtcctttacatctctgtttatagagagccactcattttgcagatgtgaaaggaagttttcattgttcaaaatgtgtaatttttattactcattttgttttgatcgtttacc

SEQ ID NO: 33377 - DNA, 241 bp, Oryza sativa
agtgtatttacactgtgtgacataaattagtttaggcaccagaagctcataatatttagatgttcatgacttgcatactgtatggatggtagtttgtattcccatttgttttcacaatgtttcagatggtgttaatcacaacctccttttaacagctgcactgtgcttcggataattttaaatagtgtcccctgattgtataagggcctacttttcttaagagttctttctttgttgcaga

SEQ ID NO: 33378 - DNA, 1501 bp, Oryza sativa
ctcagaaggaacacacctatatgagctcgactgctagtcacagtctatgagatttgggtgatctctagatactcatgaaagggcatggagtttgacttatatgctccaaacagaggggatgcaaacggcagcccagtaccagtcaagggtttgaatgaaacctgatcacacaagactgacaattcaaggcatagtctattgttcagttgtgctctggtgtagctcttttcctaggtggaagttcaacttaacagtctccaccgaaacactggtatatcaaacaggttcaactttgagaacatttcttatgaaccgtgaaatttggtggggattgttagaataataggctagacctgatttatttctattaaaatctcatgggcccataataaatgttaaagataataatgccaccttggggattaaaagtggagtacctcaacttaaagagggagttattggaggctccctgttgacccgttgagtgggggtcggaaagccacacgcgcgcgcgcgtcgggccgggccgaggccgtgggcgaggcgtgtgcgcacgcgcagcatctgcggctcggctctctctctcgatccttttgcaatggttcagaattcaactccgcgagattacctctgtaacgggctgcgctattaggatgagacagagaccgacgatcagatattctatgaattctttccattgctggtttctcgtatgtgtgcctgtgctgcctctgttctgttcttccccggttttgtgcgcgcaaggctgtgctattaggacgagacagagaccgacgatcagatattctacgaattctttccgttgctggtttctcgtatgtgtgcctgtgctgcctctgttatgttcttccccggttttgatcgcttgcgcgcacaagtgattgggacaagcagggcctctgaacccacaccttcaccagagatctgcacggctaggcgggtgatcagatttttagggagtgcttccgcacgactgctccgctcgcttcttcgtctccatcgtcgttcggttcgttctgcatcatgtctactggtggtggcgcatccggtgcggcaggaggtggtgtgcaaggaataggaggtggcgcactgatcaacaacaccaacgaatgcaaaactgcctcataatccagcggagggactttcacagggtataacatccttctgttgcctttcattttgttaaaactatcagtcgcaatgttattgcattgtctcaatgttgatgcttattttaccttaagcatgctcctggttatgtttagttttatcactagatcacttcacattgtgcaagtcatgtttattgtcttaatattttggattaaaatatgccgatttatgaccatatttccaacaatccaaaaacctgataggtcattttcggtagttggctttgctgcaacactgaaaccacatgcttttgatggttctaattataagagatggaaagcacgtgcactactgtggttgacattga

SEQ ID NO: 33379 - DNA, 205 bp, Oryza sativa
cacattacattttggagtccgtgctgtagctggctatagatctgtagcccgctgctcttctctctcttcctttatctctttaaaatatgttataactggcttatagcctgctattgtacctgctctaacggtattattatgttttcccagatggactatgaatgatggtccagcctaagttagtcgtggcaatacctttttcaga

SEQ ID NO: 33380 - DNA, 174 bp, Oryza sativa
agccctccttgtttatgtacttgttatctgttatacatattaaccaaatttctcgaaatttatatgatacctgttacagtgcaaacaggaattgcatgtgtgcatcatgggctgcttttaatttgacgtgtaagtacagtctcatcttccagttttggtgttatttttctaaaa

SEQ ID NO: 33381 - DNA, 435 bp, Oryza sativa
aattaaggaggtaccatgatattcagtaataccactttcagtttccaaatgccttgttctcaaatcttatcaaaccaactcatatatctcgtgaggaaaacaagatcctttgtgtgtgtgtgtgtgtgtgtatgtgtgaaaatcgtctgacttaaatcagtcccataccacattatacatgcaatatatgcaaactataggtaacactcttttatgttaacattttcaaaatcacccatgcacaaacacttcaaaaatattttctaataaagaacttatggttatttttgaggaattccattagatgctttcgtttgttccttatagaactatgatttactagctttatcttcaaaacatctccattcttttccttaaaatgacttacagacgagttagcagtgccacttgaaactaattggaagctttcttagg

SEQ ID NO: 33382 - DNA, 404 bp, Oryza sativa
tgtaagctttcagggaactgtttatttagatgtatgtagttattctctatttcgatgcaagtccaaatgagtaaactgcaagtcagatggatgccttttttttatctaaactaattaaaactatagcacgacggtgaaccaatcaaaatcgcttaacaacacttaacagcccaaatgagtaaagtgtgtgtcagatggataccttgttgatctcatcctaatgcaccatcaccatagaagcagatcgggagagctaatgaaaggaggaggtgggaaagaggcaccagcgtaggagtaggcgtcggcggggggtgggcggaggattcggtgtcagtagcgggtgggcggagtaggcgtcggtagcgggtgatggggagaacgatgatgcggcggtggtggacagt

SEQ ID NO: 33383 - DNA, 1501 bp, Oryza sativa
tagcatatttggaaatgtacacgcggaaaagtattatcaatgccttataaaacatgaagacatttattttcccagtcctcgagatgtcttatagaaatatgaagtatgattcaggtgctaaaaagcataagaagagacaactataatacttttgaccaaaagtatgccatatttgtattagacatataaatttctcaatatttttagaatctcaatttgtatttcgttccgatgcctccaaaatcctgaacacagccttgatatcatttgacttgctagattttagaagagtgaatccactcagtaccactaagttttccccacttttacaatctaccactgactttgttaagttgaataatatgccattgtgttttcttgaatctctattgcgtgccatcaccatccatgagccgttagttggcacccgtttgataaattgaattttttcttaatgcctaaaatacccttagactaacataccctaggactgaaaaccctagccgtgaacctccaaatcaatctggcagtgtgaggcggcgctgactcccatcgatggaaggccggacgcccaactccccgacgcgccgccagccgccccagcccccgacgcgcggccgagcacccggctccccatcgacgcgggccgcaacgccgccgccacgggtcacattcgcgtccgcgttgctgtcgccgccgcaggcagctgcatccgcgccaccgccggtgtcgcaggtcgtgtccgcgtcgctctcgccgcgggccgcaaccgcgccgccatcacaggccgcgtccgtgtcgccggaaccacgccgccatcgcaagccgcatccgcgtcaccgccgccgcaggccgcaaccgtgccgccatcgcaggccgcgaccatgtcaccgccgccgcgaagggtttgagagagctctgcactgctagtgtctgattgtctgaatactatgcaaaacagttttggcattatcccatcaaacaatgtcgatagattactatacatttctccctggaaaaaaaaccatgtacagtgagttaggggcaaataggtctttttacagctctaacagatgtccaactaacggcttgtggacggcaatagcacacattagaggttcaagaaaacacaatagcatattatttaacttgacaaagtcagtggtagattgtagaagtggggaaaacttagtgatactgagtagattctctcattttataaacttattttaatatgtagaactgaataatgaaaatccggtttcagatacacaaataaacatgaaatgacttttgttttttaacaggtacgtcttccgttatataattatataattattttgattttctttttccaagttaaacatttttaagaatgatcgagtttgtagaaaaaatatagtaaaatttccaacacaaaacaaatgttttataaaaaaaatatattcaatgatacgttcaatgatacatgagtattgtagatgttgctaaaaaaatttat

SEQ ID NO: 33384 - DNA, 1501 bp, Oryza sativa
caaggcccacttcgctggccacgtccaactctgtcggtccggactggattgcgaattacttttggcccatttgttgggatgcaacacgtgcggcctatatagtaattgggccgaaaagggagtgcgggctacgtgcggcccgtacttgttactccggaaatggaattgagagtttttgctccatcgatcagcgcggcgactcgattggaagccggtgggcggcggcgacatccaccggccgcggagaagacgattggcctccgccgccgctatctttcatttgctcctcagtcttcagctgcaacacgctcttcctctgctgtccggatgcctcaactccactcttcaaggtttcaaggtttgaggtactttatcgatgaacataatgtgttttagcctcaaagatgcaaccagctcacaatgatcaattcctctattgaagtttacatgtggtatttctgaatggaaatttacacacgttgtttggaaccacatttcaggaattcaagcaactcatcagattccaaccattctcaggcaggaaccaatgtactgatccattctggctgtgctttctgtgatccatacggcattttgcaacgaattcagtattcagcttacagccaagacatgtgcacatgcattacagtgggctcaaaacagcaaacccaacgtttcagtacacagttgctgactactgacaccaattgctgctggttccaagcttcagagttcagagagaccagatactttgctttcagatcacaagttcacaacatgttgagaaaggcattgatcaatgggataaattgttcagcaatccatccagcatgatgctttgcttgcatccttggactgaatacttaagagatagctaaagtttagcccctctctcccaaacacccccttatgttttttgtgaaggactaaagtttaggtgatgtttggatccagggacttaactttattctctatatttagacactaatttagagtattaaatatagactacttacaaaactaattacataaataaaagctaatttgcgagataaattttttaagcctaattaatccataattagataatatttactgtagcatcacataggctaatcacggattaattaggctcaatagattcgtctcgtgaattagttcaagattatggatggattttattaatagtctacgtttaatatttataattagtgtccaaacatccgatgtgataatgacttatttagtccctcccacccaaacaccacctcagtcagctttggattctcttatcaagagagaaaattcaggcgaccagaatacagtgatcaccagaaactgcagtgatcactgagatctaatagtagtactgtattgtgtacactacacgtgattaggagtacaatgtacggatgacaggacacattttaagctggtcttgtccaatctccaaagaacatgcatctgtgatctgtcactgagctttaatttaattagtagt

SEQ ID NO: 33385 - DNA, 651 bp, Oryza sativa
attaagaaagaggttaaaagaatatatactatgcccttcattagtagggagataaaaagagaaggggagaaaacgaggaagaggaaggagtacttttggttcaatgactaaaaatgagaagaaaaagatgtagtgaaccactctaaaattatgccgaaaaagagagatatatttctactaaataaataaagctaacaacggtaattaaataactagttatacatataaatatgcaaagataaacagtttatccaatatgtatgttgttatttatttattgagaaaggtggtcaaattcttcaaaaaaaaaataaaatatatctcttccattccttccttttgttcattcttcaatgatcagtggctgtgtgtacggatcgaatccccttggcaaaaactagtataacattttagctgtcaggcaaagccagatcatcggcgctcttataccatccaaaattcatgagaattagccctcttcaacccattttaaaattacaaataagaatctgatctcttttaattatttgacaaaatgatagatgttgataactgataagcgcattcatgatgctcttatatccaggtcccagctactaggtacaggtagctggcaatgcaagtcagaaggatcaagaatccgtcaatgct

SEQ ID NO: 33386 - DNA, 1501 bp, Oryza sativa
  unsure (1)..(1501): unsure at all n locations
tgaatctgattgcaaacttttatgaattattgcatggactaaatagtcttgttataaacaggaaccaagctaaggataaagaaattcatgcaatttaatatacagatgctaaaaatgcctaacgcttaattgtgagattaaggggatctttataatgagcatctgtaccatatacagtacttcagctcagttagtcacagctactgtagaagataaatattcgaaattggtggagtcccagttctttcgaaaaggacatgttttatcattttactttcatgtccatctacactatctttcgttgtcagcccaatcttggaggtgtgtcataatatcatctactaagatatgacaaaagtattcgggctagcgggccaggtggttaattagataatcacaggggaggctttagagcccataaggaattgcacgctacagtaggaactgcaataaagaatcccaatatattgaaacgttactgttgactgataggaacatatgagcataaaaattcctgtaactttccagccatacaagtgggttggcctttgaggggtcattttcacagaccatacttacaattgccacaactttgatagagatattgtaaactagaagttagataaggagtctgccgcttacatattaaccattaaaggaaatctttagattatcaccgcatagcccaaaataggaagattctcaccaagttgggcctcatcaattgatatgccggagttctgataagagtcacgcagctactcgaacagcaaatgccagtgtaagattcttcacctgaaataaacatttggacagaaactgatgtagtatagatatcaatagaacagatgaaactcaaaggattattccaaataagtcatcgaatcacatatcatcaattcttatatatataattacccacagggggtaaagaaaaaaaggaaaaagaacagaatcagaggaatcagtgatcaaaatagctccacatatttccttgtttcttttaggactaactggcttacaaatgaataataaatatatggaagtcattntttggnnttnntttgggggtttaaaattttttcagttgtatgtattgaagcatgtagaaataagttcaatattactagtttgggtcccacatataaagtataaaacaaactgaaaaaactatgttacttgagtttcacacggtaatcctccttatcatattttacacacgtcacatcaaataaattattattgcttcaccagacataacttgcagtatatgctaaagcctactttaaacaataatgaaacaaacttacatgcccttaacaacttgactactgacctaaataacgtttacatgatgacagtgcaagctggatgtgatgcatgaaagattgttcaaaaacaaaataatcattcacttacatcgatgctgtcaatcactatcctagtcaaacttaacattttgaagggtttattcagaggctatcattattataaagcctaa

SEQ ID NO: 33387 - DNA, 888 bp, Oryza sativa
ccaacggtgttcattcctaaagattgatacattgcacatactccgaccggacgagatgcactgtctcattcgtgtcgtttgagaagcacttagttgttttcagaaaagagttcaaataaaatcaattgcaaaaacagcagccttcccttgaagcctgcattaaacacttatttcccctggcttgctgagtactcccgtactcacccttgctctatataaataatcccccccagttgctgaagaagatgaagtggatcctgctgatgaggagttcttctaggagcaagtcggctacgatgagttttagggtttcggcctagttcccaagtcgcgcctgtgttgattggtccaagtcctggcttccgttttccttttgtaatgcagttgtaagctcgggatctgtccgcagcccaacatgactgtacctctactctataataaagagacctctgttgctgtgatattctgtctccctgtgataccagcactgtttcctgggactggtatcgattaacaggttaaattggagcgtcacgggctagttccggtcgggactagttcggggcgtgacaagagatggtatcagagcacaggcttggccctagggcgaaacccgacgcttaggacgaccctaaggatactaagttcaaaactacttgcgaaaagctaaggtttcttttgttttctttattttcaatagtttgtttctaaaatggttactgatcttctccctctttcaaaattgtagatggcagtgaacgccagcttcagttcccacggttttggtgagggtcaccacgtcgcccagcttcgtgacctcgcccgtttccttggcttctcatgtcccgagtacacggggtactccgtggaccgtgttccccctcactg

SEQ ID NO: 33388 - DNA, 446 bp, Oryza sativa
ggcgcaagcgcggcggcgtggcaataggagggcgccagccatgctggcgccgccccagggaggagccgccgcctctattcctgtttctctgtatggagttgcaacggtgtcatttttattttattttttcggatgttttttcacactcaggatcacgatacaaccaaccacaaaaaaaatttaaactcaaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatataagttaaacagtacatagagatgcaatttttttatttttatttcatttttttgatatttttttcacacttagg

SEQ ID NO: 33389 - DNA, 537 bp, Oryza sativa
aagatttactgccttactggtagtaaggagcatgttttttctaagttgctaaataaacatgttttcatctagaccagcatggttcatgctagcatattataagggatatgtttctcaagtataccatgcaaaattaatttcactcaatcatacaaccctaagggacaatgatttgattaaggtaatgaacgaccaaaattgtgcgtggatcggagaagaggacgatcaattttaattaccttgaggctggaagaatctgagagcgaacttgttgcgctccaagaccagcttcttgtctaccgtgagtgtgtcagtggtatgcaaacgcagtcaaacagagataaagtacataaacttcttttttcataaccaaactcgcattcttgaatgcaagaaggcgctgctggaagagcaggaattgttcatcgtacatgttgtcatgacaaaccatcagaacatgtcgaaacatgaattcggcaataataaaacggggtagcgcacgagacctaaaagtggatggatgtggagacaaaggat

SEQ ID NO: 33390 - DNA, 403 bp, Oryza sativa
ctttacggggaataataattggtccagtctttgagcatagaagatagactcatgactatgaatccatgtggaatgtatccggaacaagtcccaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaaaacagtgacaccaatcaaaggtaatgaagttgcataaccatggaggcgaagaaacagtcggtgatgacaaaagccaaccgacgatgaagacgtagacgcgcatcaacagtgatggcgaaatccaccaatca

SEQ ID NO: 33391 - DNA, 1234 bp, Oryza sativa
acaaccgggaaaaaagtatatcaaagatccatctactccatgtttcagaatatgcccttgcactagataagcctcatcaatacgtggacgagcggctgagataaaagcaatttggttgctaacgacccctagcccttttgctatccgagtaatcagagaagtgcactcaacaggagcagagaactttatactttctaaccattgccttatcatacatttcacaggagcaattttgatctttctaaccatggcaaacatgataattaattcatctcccctaatgggtctcagatcacctctaggaaacaaagtcatagcaatccatttgtgcattagcctaagtataggattatggacatcattcatcctagatttcttgcaaattggagcaccagaaatgtcttcccaaaacctatttttctcgaacccagaaatttctttctggagatctgtcacgcccagaaattcccgaatagaatttcaagcagaatgtgcattaaaacccctgtccaggactggctagggtacacaaaagacaaagttgacatacagatccacgtcttaaaaacattataaaagtcttacataaatgcagtggaaaaataaaagataactggagctaagccttgacttggattgcagtgggaacaccactccacaggcatcctcgacggcacggacgatgcctactcctcggaatagccaccatctgacgcatactcaaactctggggttggggaaaagtagagcaagactaagtataaccaccgtactcagcaagtcataccgtaatagggggtatgatgcaggatataaccaaaggatagctagagcggtacatttgcataaagggagcatttataaacagtagttgaaagtggcgaccggcagacggcggcggcgatgcggcgaacggcggtagcgcggcggcgcacggcggcacggccccgaagcgaggcggtgcggcaataacggcggtggcagtatgggagagagaaagggatgggaggggagttcctcaccgacggcgaacggcgcgacggacggcggttgcagacggcgagagtcggacgggcttcgagaggacctaaggaacaaaatgggggaagttagagagggagagagagatcatcgagggtaggaacgccggccgaagggggtggccatggccgaactcaccggcgcatgggacggacggggttccggcgacggacggcgacgatcgggcgatggc

SEQ ID NO: 33392 - DNA, 1501 bp, Oryza sativa
gggattatatactatgtgttcaattttagtctcgggactaaagattatattgatctttagtcccggttggtaataccaatcatgactaaagcggtaatctttagtcccggttattgaccccaatcgggactaaagatccttgcccccctgacatacatctgataggggttagtcaaccgggactaaagatcaaaatttttataaccgggactaaaaacaatctttagtcccggttctttttggaaccgggactatcgtggattttgccagaccgaccaaagatggtttctccaccagtgcttcttcctcgaatatgagctcatcaagatcagagatagcgctagatccctcttgtcagcctccgcaggcaccacacggggtctgtcaagacttatccctgatgttgatgtctggcgacgtgtgttggcttgtgtattgtgtgtcaatctgttgttgtgtcctctttcccccctagggtgtcttgtaagttacacgcgacttatccgatccggttacacggagtggagatcgtgcaggcgtccggatcaagcatcatgatatctatatataagttgagccgccgcctctacgcaacatacgtgaaatcaatctagggtttgccacctcctctatactgcgccgtcgctcgtagtctactccatcccactcgtcgatgtgcaccggcgatcgggtgagcagatctccagaaccttcgtcttcgacgtcctgcaccgggagaaggcggcaataaggattttgggaagcgcttcgcgcgattgccccctatttgaccacaacagctcatcttcctcctcgctcgcgtgctacgtgccatcgtcaacgcccgcaaccgcgagtacttcctgctgagcaaccggtctttcggtaccaacgctacgtattcagcatattgtgcatatttgatctgttcatgctttactgtctagtatacatgtgtagatcttacgatgtgtttacactagtttacatttgcaatatcatgatttatttatggaataaattaaatcattatgtgcttttaaattcaacaattcatagggattgtactaattccaacaaaattatgtataattcctgcattctaatgagatcttaccttagctagctttgtaccttagttcaaaattaattgtgctaatttacctccttctctccttccaagttataactattttttctttttgccttggcctgtctcaattcagctccggagaactagcatatggctgtaggttatcaatagttcagctctggacgtctctcctatgcataaaactaggtgattccccgcactttgctacgggaattactaagcaactttcaatacttgagggtttttcagtacttatcataatacttgaggttttttcaatacttatcataaaacaaacaaatgatacgcgtgatttaatgtagaacatattgataagtatgtgctgcgcccactccctctctctcctgcccacgcccgcgttcgaga

SEQ ID NO: 33393 - DNA, 938 bp, Oryza sativa
ttcggattgttcttcttcttctttttcttgaagtcagtggtctgttgaactttgaagaatttttctttgttcttgttttgggctttgtgcatcacattagcactagactacctaccatcgcccttagacacaacgtcttttccttaagctttctcctcaacattaagagacattatactatcaagtatcaaccactcaatggagtactcctgtctcctatctcttgtgtttgagacattatactaaaatttctccatgaagaaggtagtttcacaataatgcatgcagccacaaaattgttgagtaaaacacacttggggagtttgagttccttctattaaaaaattataagcaatatgctcccgataagtgtcctgactctataggcaatgctccgaataagtcttatgttttctggaaaaaggtagttttgcaataatacacgcggccacaaatttattaggtaagacacacttgaggagtttggagtttgagttccctcaactgtctcttgtgttagagtgcacaaccgaagctgatttgttaggtaagacacaattgagaagtactagttttcttaactgtctcttgtgtttgagtgcagtaccgaaactttccatgaaaaagataagtttcgcaataatgcaagcagccacaaatttgtcaagtgaattcaagttcccttaactgtctcttgtattttagtgtagtactgaaactttttcatgaaaaaggtactttcgcaataatgcaagcagctaaatttatcaagtaagatacacttgaggagtccgagttcattctgttaaaaatctataggcatttgcttcggataaccatgcaaccacaaatttgttgggtaagacatacttgatgatgcggtggggagcgatgcagtgggaccggcgagcgagatgtgggacggcgcggatgcggga

SEQ ID NO: 33394 - DNA, 1501 bp, Oryza sativa
  unsure (1)..(1501): unsure at all n locations
gccgccgaccccttctgcaccgttgggttcggggggttgccgggttgggggaaggcggctcctcctcgccggcgctgctcggttcgattcggagggggaggagaccagccgcgagcactgtagtggcgatgtgacgccccttcccttaccagtaaccagtactcactttgtgcctctgtttatctattattcagtttcactagatgttaatttgagaggtagggcgctaggcctgtaaaattttacccaataaggtcagttgatattttttttattcacttcatgtagtgattaaccctaacacgatcctagttgatggctgggcatgggcagaactgcacaagtagtgcttggagttggcaagggaattttatagagggattctgcgaaatcgagtgaaaggaatagttatgtttgcatcgtactttgattggtacaatcggctctctcttcaaagtttttatcgattattacccccttattgcagtgcctcacttggtcatagctatcttttgttcatttattagataagtgatgtcccagcattgtcgtttcagacattctgtaagtattccactgtctacctctccaatacacaatcacttgattttgagttctctatggttcccggcagttgacttcacagatctagtagtgctatgctttacacttacagctgctgtgcaatagatttttgttttggctcctactattgtgaactcaacgaaatagtttccatcaaatagaaagtgaaatacaggggtcaaataatttcaagggaaataaaagatattggagttcagtactttttgcagtaacaataacctgtcagggttgcatgacagaagtcatattccctgaagggctgaatggggagatgaatcttccctgattttcatatactcttaggctttataataatgatagcctctgaataaacccttcaaaatgttaagtttgactaggatagtgattgacagcatcgatgtaagtgaatgattattttgtttttgaacaatctttcatgcatcacatccagcttgcactgtcatcatgtaaacgttatttaggtcagtagtcaagttgttaagggcatgtaagtttgtttcattattgtttaaagtaggctttagcatatactgcaagttatgtctggtgaagcaataataatttatttgatgtgacgtgtgtaaaatatgataaggaggattaccgtgtgaaactcaagtaacatagttttttcagtttgttttatactttatatgtgggacccaaactagtaatattgaacttatttctacatgcttcaatacatacaactgaaaaaattttaaacccccaaannaannccaaanaatgacttccatatatttattattcatttgtaagccagttagtcctaaaagaaacaaggaaatatgtggagctattttgatcactgattcctctgattctgttctttttcctttttttctttaccccctgtgggtaattatatata

SEQ ID NO: 33395 - DNA, 1441 bp, Oryza sativa
taaaatttgtcaggagaaaactaggaggagagaaggaggggttgataaaaaagtgattgtgacctatgggacccactaaaaatagtctgcacagggattttgtactgtgagttttgtgacttgtgaagttcctcatcctacctagcagcccaggaccagcaaaattgcccggcgtattgtaaacgccctaagagcaaggataagagtgagctataaacttacatggaggagagaggtaacaaaaaaaaattaaggatattggctctcacggaagagctagcttaacataagctccaagacaaatataataaatgtacacgtgagagatagctagagagaggagaagaaaattgtagccaatcttatagctaatctattatatatgttggcttaagatgggctaatagtaggaagtgagctctaatattattctcgctctaagtaaaataaaaaaattgaacaaacatctatctagattcgttttaaaaagttgatttttttctaggacgaaatgagtactactcatatttctgaatatgcaacgtacatctttcattaaaaaaactactcataaatattgttgagtttttcaaaagaagttgtttttcagattaaatatgtaagagcatcatcaacagtctagctattacatccccaatcctatatttttgggattttggttaaaaaaactggtccaacagattcccaaaagagctcttgatgttttaaagttcccatctccaattttctcggtacgtgtatttgagggcgagagaacgactcccaatcccctccttccgcgtgtttctcccctccttccgcgtttctcctctccttcccccgtcggggcgatctccttctgcgcacgggaaaagaaaaaaactagaatttctattggtagtttaacagaagggcccacttttagtttttgggattgaatttaggctatctcttggaggaaggggttttttcaacacctattttcagtttaggaatcccaaaaattaaattttggcgatagattattagtagactgttggtgatgcgctaaacatgtgcttggttgtttggtttagaaataaaacaggatgagttagactcatctattcatttggtataaggtatcgggttggtgctaatttttaaagcatgtcctacatgtcaccgagagagaagtggattggataggtccactagtttaaaaggcaagactaacccagatcttatagaatatgtcatgtcagggtccatcccatcctatccatatccaaacgaaacaccctcaacctaacccatctcatcccttaaaccaagcaacccacactagtagtacacccctactgccgatgaggagctattgttggcttgttatatgcgtatttcatcggtcggatatcagatcactcatcgatggtagcagatagtagctgggggtttccaa

SEQ ID NO: 33396 - DNA, 1501 bp, Oryza sativa
tctattcatttggtataaggtatcgggttggtgctaatttttaaagcatgtcctacatgtcaccgagagagaagtggattggataggtccactagtttaaaaggcaagactaacccagatcttatagaatatgtcatgtcagggtccatcccatcctatccatatccaaacgaaacaccctcaacctaacccatctcatcccttaaaccaagcaacccacactagtagtacacccctactgccgatgaggagctattgttggcttgttatatgcgtatttcatcggtcggatatcagatcactcatcgatggtagcagatagtagctgggggtttccaattcatgagtatagtgggaaggattggattgaaggttgtgttgttgtggttgttattattgttattattattattattattattattattattattattattattattattattattattattatttgacaattcaggtcccgttctttctagtcttttttaagtttgaccaaatctatagaaaaatatagtagtgtttttaacacaaaacaaatatattattaaaatatattcaatgtaagatttaataaaactaatttgatattttatatgttactaaatttttctatagatatagtcaaacttaacaaagtttgattagaagaaaagtcaaacaatttatgtaatatgtaatggagggaataccagaaaaatacgatttctaaaaaacaaaaactttgattgcattgtgtaggtcacttgttcaaggtttttgtgaattttatttctcaaaatactaatgtattgttacgttaatcaattaaacaatcaacctcaacaattccagcaaatttttgtttcaaataggtactccctccagttttataataattgatgttttagacaagattgaggttaaacttttgtaactttgaccatcaataactttaaaaatatttactttaaagaaactagaacaacatatatagatttgtatttcaaaacactataataaaaataaacatgcatttatttattgtatatattataatagaaaataaagtcaaatgtatattttgtagaccgtgtcattgtccaaaacgccaattaaaatgaaaccggagggagtagtgctgtagacttttagtgacctcctttatatgaattcattcatgcacacccaacccaatacaacaaattgtcaaattattatttattaaattacttcctttgttttatctttatgttggacgtaataaaaaaaaagaggagggactacattggagttatattttctacatcttttcaaagaggactaacgtaactatttgtacttggttcgatcgtagtggtcacacatgaattttcaagaaaaaaatcattaaataattaagaaatgcacaatcctaattataaaccctcattactaccaaggttaatcaagcacttcaatcaaatcaaacacaagatttttttagataacgagtcatcgagattaggga

SEQ ID NO: 33397 - DNA, 1362 bp, Oryza sativa
gggggggggggtccgcgttatcgccgggcacgttctgcacctctttcgctctccggaagggcccacattacagctgttataatgtggtcttgtctgcctcctcctctcactcctactactactcctttaattattatttttttgtttttctccaattctcctaactaattttgttcccacatgtaaacttttttttttggttttttggggatttaattttgcctttgtaatgatttttttgcctgttgctgatgctgctgcaaagtagtaaaaccaatcttggtgtaattgtttttctgctgccccttggatcctccaatggccctgggtttagtactggtcaccagtgcaaccaatggcttctaactcagatgaattttatatttttcatctcaaaagaaaaggtattgatgagagtagaaatggtgaggtaaaataaaaagggtaattttgaggataatttatgactaaatttccagtgtgaaaaatactcctccagcttagtacagtagatcatgaatcacagaatccaatatattcccccatggggattgaggtagaggagtttttgtagaggtatttgtgctcctctcccttttattacaagcctccacctttctctctcatcccacagtttcctacccctcctttcttcttcaccagtttgtctctctctctctctctctctctctctctctctctctctgtcctttcggttttaactagcattaggcaggtggttaggaggggaggtaaagctcaaagctccctcccctgacagcgcagcatcttgtttgttttatctcccacatcatctccctcatcatcatcatcatctcctcttcttgcaagcacccacaacaacacaaactctctttcttcatctttctctctcctcctcctctctttgttgtactctactcaacatttctcaactttcacttcttcttcttcttcttcctttctctcttcacagctatcatattctcctcctgcttgctgctgctgctgctggctgtttctctctcatccatccaccctattatttattcaaggctaagtgatggtatcttaattcttttttcctctctgcctcctcttcttcctcctcctctctctctcccttgctgttgcaggagtataatttttatttttgccaggcttcttcctgtactggtgtttccttgtttcctccctttcttgtgcttcttcttcttcctcatcttcttttttttttgggttttctctctcctgccatccttttcacctctactagctctcctgatgtactgatcattccatcacctccattccccagtggtaacactcgtgggggaggaggaggaggaggaggtagtagca

SEQ ID NO: 33398 - DNA, 212 bp, Oryza sativa
tcatgcacttataaaatataaggactaaaatcttggtttaatgtatcacgagatgtataaagtacaaacaatgtagctcgggtgctgacatggttgtccacaataacgagaattttgtatttacacctattcaatacaatatgtcccaaaatccggctttcatcactcccaagttgactcctaacacacatgtgggagaggtggcgaagaga

SEQ ID NO: 33399 - DNA, 1268 bp, Oryza sativa
tgtcctgttcgaattcagtacattttttagactcgcacttcctgtacatgctccccttttcttgttttgaatctctgtacatgcaaattgtactccactatttgaaaactaagcgtgtggtccagttgatccttctggatgaatcgaggacaaaaggccaaaattgagatcgcaaatactactaggaagtaattccatcgtttacaagaagtatcctagactaagggggtgtttggaaactagggactaaactttagtccctctcacaaaagtatagggactaaagtttagctcctctctcccaaacaccccctaaatactcgtagtgtggtatatatcatagttaagagatatatcactcgtatgtctactagccgaaaagtaagggctggtttggtttgagacctaaattaggcttaccaatatttgataatttcaatagtgtttagtgtctatttggtttgaagctaaattttgacatgcctaagaaaatatgtcatttcaataatgaacttaggctattttagcttcaatccaaacacaactttgccttaataaaattagtcatgccaaaacttactaaaatttgcactgacaaaatttggtaatgtctatttgaccacaaaccaaaccaaccctaaaacttccaatttaaaaaaccgtggttaaatcttattaaacattagtgcatgttttaattgacccttcttgataaatcgaggacgaatccgaaaatgagctcgtaattaagtaagaagcacaagaagcacctccgcccaaattaaacgttatggtatcaaattatcacggtcataagatctcgcatgcacgtctgccagtgtgaaaggaaacacctccaatttccgcaacaatagttaaacctaaatacaaaagattctgcacgcatacacgacttgccggtggaaaaggaacacacccaatttccgcaaccatggttaaacctaaataaaaggattcctcacgcaagcttgcaagtggaaaagcaaatacccctattttttgcaaccatggttaaatctaaacaaaacaagtttacaaggttaaccaaggtgaaggtgtaacctagagtcacagtcaccctctccatctctctctcctttttgagcccccagcacagcaatgatgccaccgggagacgagcaaaagaactaaactcaaggggatttcactgtcaaagtgtcaaagcacacggcagtgtcagcactgttaagtgcccagctttgcctaactgtctcctcacgcacaca

SEQ ID NO: 33400 - DNA, 370 bp, Oryza sativa
attacatctgcaatcgtacataatttaggccctatttgagattgctttaagtgaagatgaagtgtacgcacgtaaaaaaaactttagcatgttattaattaagttttaattaatttaaacttaaaaatgaatttatatgatattttaaatcaatctatgtatataaatttttcgcatgaaatatagtgtttgacagtttaaaaaacgtgctaacaaagaccgatgtaaaatctgtatcttaattgaaacagtaccttaaacgccaatcaattcgcaaatgcgtcggtgagccaagcttgattcggcagaaccgcaaaaacagatgaaattcgagcaaaagctatactactagtacgaatcttggcaaaaa

SEQ ID NO: 33401 - DNA, 1501 bp, Oryza sativa
tccggccggccggcctttaaaaaggagatcgatcatatcgatgacgatccaacaagatgaagagctagctagctagaaggtgccaagattaaagtggtagagcatatagatatcgccgtacgtgataaggagccagcagcagcttggtacctttgtgcaacttgcctaatttgctgtaattctctcatattacctagcattatcctgatgattagtttactccaactagctagatagtgcttcatcaccatgtagctagcttgcttgctttagtgctgttgtcttgtcttctagcgtgctgatagctaacctcacgcatgcccagcctcatctcatctgatattgatcctcactttcttcttttctgacccccacaatgctagctgctgcttgcaatctcttgcaattttttcttttcttctccttcctgccggcctccaattcgatagctacgtctagcttgacatgggatagggatatgatatatgcactgcacaagaatcttgcggccttcctgtttcttctttttatcacaacatccataaagtcgctttctgtggggaaagatggttgcaaaagtattactactaccctctgtccttcttagcttaagcttagggtcaaatcttctctcatcatatattccaaaaggaagaaagaaaaaacatatggatctagtgacacgcgcactgaaatcatacaggggatttaaggttccttgttttgttgttcacaatatgtgttagtagtttggatgtattttagatatagatagatgcttgttaattagtattccctccgtttcatattataagtcgttttaacttttacccacttgaacttatttagacttgatcgaatttataaaaaaaatagcaatatttacaacatcgaattagtttcatcaaatataatattggatatattttaataatatgtttgttttatattgaaatgttactatatttttctattagtcaaacttataaaagtttggcaaaataaatcaaagtaacctataatatagaacagagggagtagcaagaaagaaaagttcgatatagtgtataccgcaattctgaaactagtatattatgcatgcatgaggataaaagggaggaaatggttctaaacttcgaaggagcgtcccatcgttgtttgctgtgaaaaagctagttaactatttcatctgtttataactagtaatatgtccgtgcattgcaacggatgagatccatataatataggctaggaaggtggattaagatgactagaaaagtggactgaggataaagcactggaggcggtggttacatatacaaaaccgtagaaattaagatgtgtgcgggtggtgagaggaggagataaaaggatgacgactcccttttaaatagtagagatttctcattagtgaacaaaaagctgacgtcttgaggattcagtacatagctgacacttgtgtctctagatgtcttagtgaaagtagaagtgcacttggaac

SEQ ID NO: 33402 - DNA, 1501 bp, Oryza sativa
tttaacgacgttgttgttagatgaagccataatgtcatctcttccagaggaatttctacaaaacaacacctaccatctctttctcagacctttttagctttcccaatagacaaattaacctacgtgtgctagcaaactatgttatacataccgatatgattcaattggtatgtgaatgagttacggtggcccatttccctatataaatgaggttagaattatttgctaatagggtctatatgttaatcaatcacccaaatagctaattaactggtactagtaggaccaatctaattttcaatagatcaatgtagggccattttacttatcaacaataagcagaaagggaagacatgacagccaagatggtgtcacggagtcctctccagaaagcaaagcttggagacaagctcattcgcaagaggaggcgcacatggaaaccacaaacacaaaaaaaaaaaaacaatcaagaaagcaatcttgcaatggcgattaaattagtagcagtgtgttaagcattaaattaatggagagcacaagataaagaagggcccccatcaaaaaccttaggaggggaatcacatgaatacacatgaggctagccggcccatccccggcgagtgggcccccaccctgttcacatgtctccatctcaccccactaaacaactcaaagaaaaatcatattccattccacactaatcctcaacataatattttaccaaacttttgaaataagaaaaaaaaacttttaagatcacttgctttttataatacagaaggaatcatataagaaatctgtttaaaaaaacttgcatactaacttgagacgatcggactcctaactgcagttcatgattttctaaaaatatatatatccaagcaaactcccacagtgaatttcatcttaagtaaaccatataataataataagactaaaatagactttacctgttgcaacgcacgggtatttttttctagtaaaacataaaaataaatgataggattgttacaacttctaaagtgtagccaccccattgaaccaaagtgtaagtactcaactgcaaattcccccgaacacttcggtggcggaaggccaggcgtgaaatagtacaacaccaaagcagccgcgcgcactcaaccgcgacagcgcctcgcctgccctctgcctaccgcgaggcgcgactcatacctcgctcgtctcacctcaccgccaaattccacaccaaaccgaacgatcaaaaggcgaggcgaacaccaccaccaccaccaccacctcaccacgacaccactccccatgtctaatccactccgctaatcaccaccaccccccgcaccaaataagtacacccaaccccaactacgccacaaaagaaaagcttacctctctctctctctctctctctctctctcttctcctttccctctcctcctcttcccaccaccaccaccgccgccgccgcctgattggtggtaatcggaggtggaggtgggcgtgatga

SEQ ID NO: 33403 - DNA, 1501 bp, Oryza sativa
aagtctatccacaagcaccaatccagccccttccgccacaagttacgcgagcgccagtatacttcgtcgggcagccctcgaccgcagcggtgcatccagcccctcacgtgcaactactagctcagccgatcgctgcccaagtacaccctcaaccgcctggccaagtgtcacaaacaatggcagaaggggcttccgctctgcaggcgcagctccaagctttccttcagcaagtcagccaacctcacagcattttaggtacaaccccttcggcccacccagaggagaatacaagtcaagttgcacctagttggttgccgtcgaatcagacaggtctgggggcttcgccttggagtcaaggaccacagttcgacttcatcaatgctgctcaggcaccaaccgttcggccgcaagcaccaacgccaggcttcggagcaaaccaagcaccaaaccaggtcgccatggcatggtcccagccaacgttcgacccatccatggtggctcagcaagcatcaccaatcggagctgggcagccgaatgccatggcccaaccttatgcgaaagccgtgatttcgcccttcactacgccgtacccgcagcaaggtgccgtgaacagggcagggggcgaaaaggggctaccgctgagtgggggaatcaagacccgtccaatcccaccccagttcaagttcccacccgtcccacgctactcaggcgaaattgacccaaaggaattcctctccatttacgagtccgcgatcgaagcggctcacgatgacgaaaataccaaggcaaaggtaatacatctcgatctagacggcatcgcccgttcttggtattttaatttgccagccaatagcatttactcatgggagcaattgcacgatgtctttgtccttaacttctgaggcacctatgaggagccgaagacgcagcagcatctactcagcattcgctagaggccgggggagtcgataagggagtacatgcatcgcttctcgcaagcccggtgccaagtgcaagacataaccgaggcgtctgtcataaacgccgcttcggccggggtactcaagggcgaactcacaagaaaattcgccaacaaggagccacagacccttgagcacctacttcgcatcattgacgggtacgcaaggggcgaagaggattccaagcgacgacaagcaatacaagctgagtgtgataaggcttccttcgccgctgcccaagcctaagcacaagctcaggttgccgaaccacctcccctcgctgttcgccagcctcagatggcgatccagggacaaccgccaaggcaaggccaagcccccatgacctggaggaagttcagaaccgaccgcgcgggcaaggctgtgatggatgtcgaagaagtaaaagcccttcgcaaggagttcgacacccagcaagcaggcaaccatcagtagcctgtccgaaagaagttccgaaaagacctctactgcgcctcatggacgctcttcgcacaccacggagc

SEQ ID NO: 33404 - DNA, 1501 bp, Oryza sativa
tgaaactatggaatgctatacgagttcagcttcggactgtaatgtctgaaaacagcctagtgtgataatttcacaattatagcaaggattggtggtatgtcatatgtcttagcatgacatgcaatgggatggggaccaaatttgtttatttgtgttgtgagctcatgtgccatgctttggtgatatgtcaaatgttagcatgttcaattagttgtaaattccttgtctcaatcagaactcttcaagataaactgtattttgtagtagagctaactaaatataaagaaggcagttttggtttaccgaagcttattttcgccattagttgaaagcttaacaaagcactacaccttttactttgatagattttaatatttattctgcaattctttagggtttcaggtcttttgtctggacagctgtctcgtaccaaatgaaggacatgatgaaactgtcaccatcaacatcacagtttttggtctcagttgcatatttcccttggagtataaagcctgtatatgggtaatgttacttctgtttgcttctgctgtgaactgaaatttaatcatgttccctacaacctaattatgttttttttgctacagagtagtttttgtaatgtactgtttcaaacatcatgtgccttacacagttacaccttagtttcagaaatcttacatgtaattatacttcttacaacaacagagtttccctgacatgtttactgtggcttatctctattgcaagtgattaaagtgtagttgcttacaaacagatgggtgctcaatatttcctgagcaagcaacaattattacttactgccttcggacaatttgtcaattatgacaattataaatattcttttgtagcataagagctaaacaatttgtcaattttatatttactgccttcacacagattaacacgattaattctaaaggatgtttctgaatagggtatatatcaactaattttggaaattattttactttagtggaaaatggattaatatgtgcactgcatttggagacccgacagtaaatgtgaaagggcaaaaggaagtgctgcaagcactccaacatcgatgggtatttttttctgttggatcgcttagttttcctcatgcatttatacccactcaaatgtttgctgcatacttgctgtggagctgtgcattatggcattatgtaacagatagtcctgtgtaacattaaaatcacaggtcttagaaatttcttctatgttgaattgcacggcttgtcggcttctgagcactggctgcccattactgtaaaacatctatatgcgtttgtgtataactataatgagtttcagattgtactgtacaaaatccagatactcgttacttccggatgagtctcctctgactacgtcagagggactttgtcactgacatgtgggacccacaaaggttgggcccacacatcagtgacccacgtccctctaactttacgtcagaggagcgcgatccgttacttac

SEQ ID NO: 33405 - DNA, 1501 bp, Oryza sativa
ccccagacctgtctgattcgacggcaaccaactaggtgcaacttgacttgtattctcctctgggtgggccgaaggggttgtacctaaaatgctgtgaggttggctgacttgctgaaggaaagcttggagctgcgcctgcagagcggaagccccttctgccattgtttgtgacacttggccaggcggttgagggtgtacttgggcagcgatcggctgagctagtagttgcacgtgaggggctggatgcaccgctgcggtcgagggctgcccgacgaagtatactggcgctcgcgtaacttgtggcggaaggggctggattggtgcttgtggatagacttggggtgggacgtagcctaccgaatactggaggattggggccgaagcgaccttggaccgcctcgccgcctcgtacgcctgctgctgttcttgcatctggtgaagcatgtcttagagtcgtgtcatgttctgtcgcatggcttccatgtcgacttcggtttgtatttcggggtcagcgttgacttgtatagcggcgagagcagtcgaggccgctgccggctgcgacggagcggcttgaggcactagcagttggcttgctgcccgggtctggagtacccttgccgccatggctgccttcgccaagtcagccgtgttcggcacctgcgtagaggcggcaggagccgaaggcggtagtgatggcgcaggtgcggaggcagacgacgctcctccatcttcggcgacgcgcgccgaaggctctgctccctcttcggcggccatctccaccccggcttcgctttcctttcaccttgtaaccttctccttcactaccctcttcggtggcattcgctctcagtgttttcgctcggaggtccccacggtcggcgccagtttcgacaacagcttacgtcgaaagacgtggtcactcaacagtagttggaaaataagtaaagtgtattaaattgagaatttttcttgggatccccctattacaaggccctatgggactatttatagcccccattacaggttcttactactagggttttggttatacaggggaatttacatgggtacataatgtaattgaggttcatgggcccttgatgggccgccaggcaatcgtcagcccaatagcccctaggcttgaagggccgaaatggcttcttcggtcctcgcgtgggcgaacttgctatggcgaagtcgtctcccttcggcatatactcttcgccctacatccttcgcccaagaggccctagcccggcaaggtacccgcgcgattccccgcctctcgccgtctttgtttcatagccttcgccatgggggggcttcgccctgactaaccttgatgcctcgggcttgaatccccactggtcgcgtggtttcggcaggtttggtcgaagggcctcatgccataccgccaaaaagttgcaagtggtttctagctaagtccctgtttggctccaggatgtttctgaaggatattatcaggatgagcattctaaga

SEQ ID NO: 33406 - DNA, 797 bp, Oryza sativa
tcagcccccacttcagccaccgccgcccaccgaccgtccgcccccgcgcaccgccgccgcccgtccacccccgcgcaccgctgctcgccgccaaccgcgcccgccaccgcccgcgcccgccgccgctcgccgccagccgcgcccgccgttcctgctcgccccgtcgccctgcatcgcagagagagagagagagagattttgaagagaagaccatatgacaggtgggtcccacaattttttatatatatagaatgctgactgggctgccacgcgtacgctacatggactaaaactactgcggattgggtcgaggggggtaaatggagaaagctacgcatcggacgtctggagatttgcaaatctccggacgatgttccactgtatgttgaatgaatgttgcaatgttccatcgctcgaaaaaaaaaatgtttcaacataaaatctccagacgatgtttcacattatgttgaatgaatgttgcaatgtttcaccgctcgaaaaaaaaatgttttaacaaaaattgtttcttgatgtttcatctttcattgaatgtttcaccgtgtttcaccgctttatcgaagatgtttcaatcgaatgcaacactcgataatgttgtctgcaacaaaaaaaaccaatatatgcaacatccgaagaaaccaaatgcaacatccactaccgatttaagaaacatccagaaaaaatggattgcaacatcaggaacacactatgtgcaacaaaaaacatgtagtgtgcagcctcctcaccttcgtcgccgagctcagaaccctctcaggtaa

SEQ ID NO: 33407 - DNA, 188 bp, Oryza sativa
cgcattcaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggatgagtttttgtcagatgaaggtttccccgag

SEQ ID NO: 33408 - DNA, 913 bp, Oryza sativa
taaccatcaaaggacgtctaagatcttctacctccatggcatggtttcccgcaaaactcatagataagaatgaatgtgtagcaccagaatcgaaaggcactgttgcaggaactaagttaacaagaaacgtacccaaaatcacatctggagcaccttgagcttctgcagcagcaacatggttgacactggcctttgatactggtacggtagagttgctctgggtagggacaaccttcacgcgtcggggcttcggacacttgtcagcgtaatgtcctggttctccacagttgaaacacaccacgggcttgctgccttgctccctcttggcaggttgttgctgtgtcgaaactgcaacagggcgtggagcttgattgctgatgttgttgcctgcattgttgttgaagatctgacgttgcggacgaacaacagacgaagaacctccctgtggcatggactggggtcccaaagtaagacgcggcctctgattattcccctgttgtgtcttgaattgagcaatccggcgtttcttttgctccatgcgattgtacttgtcctcctgacgaatagccttatccaccaacttctagaaatcatgataatcccccgtcatgagtgggtaagaaagctcatcattaagtccttccaagaacttctcctgacgctcttcatcattgcgcacatcttccggagcataacgagccagacgattgaactcgtgcagatactccgtaacagagcgagacccctgagtgagcgacctgaattccttcttcttgagagacaccactcccgatggtatatgcgtcttccggaaagcagcggtcaactcaagccaagtgataggttcagcagtagtcctattcaagcggaagtgatcccaccattcagaggcagggccatgcaactggtgtga

SEQ ID NO: 33409 - DNA, 1501 bp, Oryza sativa
caaaattggatatatagcaatgaaagtttttgtgtttggttttatagcaatgaaattttcttgttcattttattagcatccaactttccaatctgttactacggccgtgtttagatgcaaatttttcttcaaacttccaacttttccatcacatcaaaactttcccacacacataaacttccaacttttctgtcacttcgttccaatttcaaccaaactttcaattttgatgtgaactaaacacagcctacctagagcattcctgatcctaccttctaattctctcctctttctctctcctgagtccccgactggcgctgctccccctcgcgtggcgcacgacgtgaagccgatgctgcaccctcaccttttgagcaccactcctaacgcgtcattcgctcgtcgaagcctgtgttgttgcttggcctccacctatgctagtctgccccctttcgattgaatcattcatgctttgtactgagctagagagtgttttgcttgaactccaactgaagtttaaatgagttgtccatgtcttcttgctacatgcatcttattgattttcctagtgctagcatttgcagatttgtgcaggataaaatcacagaaacttttgttttgtcgttgcaatttgtttggaaattcagatacatgacaaaagctaagttaagcgacacagaatgacaaaagtttagtttatgtgttgccgatctgaacacagcaacaagttttttaatctttctcctacatgaagaatgaacagcaacatgatcgattggcagcagcagcgtcgcgttgctgctagtgataggatggatgggtggctgttggtgagtggtaacaggacataaggggtgggcagttgcggtgggggtaaagcggaccgctgctgccgccgcgcctagagagggatatccagatatatatgcgacacggaatgagcttgacgatacgcactgggggtgggggaaggggtagatcgattaggttagaatataatagaacacaattacagaaataatacacaaatagcgtgtgctagtcggtgactcgggggaatgaaagaggagtgaatgagaaggtaggatcaaatggttcagtcagaattaatcaatctaatagcaatagagctgtaaatgatggaagtgctctagatagtaacggattgggaagttgaaagctaataaaatgaattagaaactttcggtgctataaaaccaaaaaacgagaactttcggtaatatatctaattttgtcatgaatgataaacccatctattaataataaaggtacggtgttttgaaatctcaatccgtgtacgcatatgcgttatttcgtgtgatgaaaaaaaaaggaaaaaaaatttggagatacgcatacgataccatatctttgtgtgagcagaagacgcaaacgctcgccacgcgtcttcttcactccactccacaccacttcccccaccttctctctcatcttctccccaacccaaccctcatctcgc

SEQ ID NO: 33410 - DNA, 1501 bp, Oryza sativa
aggatggattgtctctcttttcactaagcgataaagatgaattaatctagcatccgcgaaggttcttcatccttgttccacagtctcctcaagctaaaagatctatccccttcagctttgcttagctaggtgaactaaggttcatcacatgtattgtcacatatggtgtttctagcatacacaactatttcaagctgtattggtgacgatgacttgcactagagcagcttaccttaacttgtctgaaggagtgaattggcgcttaaatgcaaaggatagtgaattggatggtaaagagaggcttggaataaatgataactcttcatcctataaaatacaacaaatatccatcatgagtggcacagtaaaataaatgtcaatggaactgttgtggggcaggaggccaaggcccatgacagaaacgaaggccagctgagagatgcttaccttgtaacgatattttatgttcatctcattgtcactgtacaatgcagtgcaaactccattcagaacatgagacctcactatgccgtttactgacaaaatcctgtcaccttcatccaaatatttctgcttaactgaaacttcaccattgggaaagatgaaggttgtcctcggctacatacaaataagatcaatgaactcatgcatggtgttttctagtttcacattatcaataacagcaagggctacagtgcatttccaataactattttttttcacttcatcttagtgacttggttgcataaatactgaccaatccatcaggtggaaccacagatgataactcaatcttgcatggtgaatcacccaaatttgctctcaccgccacttcccctttttgctcctaattaagagaacaaaaaatgatcacatatactatgcggtatcttacatgtatcatgaagacatatttctatagcacaacaaaagctatgctatataatagcaaatagatacaaattaccaacttattgttccatgttaaataattttggcacatacaaaggccttttatagactcatgcctttcgaaaacaagtataacgtatatgccacagatgtgtgacttccaagaactcatttcattcactaatttacaataaagaatagatagatgttcatattaaatgaccatcaccgcatttcatagggtcttccagaaaaaagaatgaaggcgtttctcgatggattcattttgactgaatgagtgactgactattgcaagtataaaactaaaaaaaatgtccatcaaattcaacaagaatcattgaagttcataattaagcaaattgatatcatttgatcaaattgctgctgagtaacaaccaaagagatccccacagaaaaaaaaaaggaacatacattgagaattcgttagtcatatggcaatttataaatgtgtttcagactttcagcagatgtttcttcaagttcagtcccaatgctaattaataatttcaagaatggatgggaaaatgcaagctgataaggaaactgc

SEQ ID NO: 33411 - DNA, 1501 bp, Oryza sativa
atggtaaacatgatgcatgaattcatatggtaattttcgttactgcatctcaggattggagctttatctaggatagacataattgtgaagatagtgaaacaatatacttaaggagtactgtactgtagagacgtatcgtacgagtatttctgaattcttgttaactttgtaccagttacatgttatatttgtctcatgttcaactctgtaccaaatatatttgttgcgttggtgaattgaaataggaacaggaattggactaatagaaatttaaataggaatataaataaataggtagtacatgaacttggtattttgatttcccttgtgatttggtctgtatgtcaggtggggttgggagggaataggacagaagttagattagatttctcgttagactaagttagattagatttttgtcaggtgggacggcagaaacaatacgaatcttttaagtatgtaaataaaaaggtaaagaagtagagaaataggtagttttatggtactgtgtcttataaatatagttaaaaaaaagggtctacttcactccctcaaactattttgtctgagcactcaacccctaataatttatttctttctatatataagttatataatgtacattggtatatgctttacaacttacatctcaaacattacttaaattttttttatcactgtttacaaaaaacaagattgatttaagcatcaaaacttagttataagcaaacaatcatgatgaaatctgcaaatattttgaacctttgataatggtattccctccgtcccactcgccaagacgcgatcaaatttggcacagtccgtaaaactaatcttttctttaaattttttctatattataatgttggcaacaaaatagtaatgacataaaaataattttaaatgacaatccaataaaaattttttcatcaaataaaatttaatttataataaaaatatttatcggtaaaatgtgtgcgcattaagtgtgacgaaggggtatcatctatgggtcgaaaaaaggttcagcttaaaatgatacttgtgtaaagagaaaatgaaaaggagaattgctattaagcataaattatttttaaaagtttagagagtaaaatgagaaaaaataataatttatgggttaagtgatccaattaaattaaacagtttgagagagtaaccgatttttttttatttatcgtaattattatatattattgtaattaagtaagtagtaaatgctgagaaattcaggaaaataggatggacgctatttgtgatgacgtccagatattcaggaaattcaggaaaatattcatcacaacagcaacgaggtgatacaaatatacacccatgaacatgtgtgtttttacatcctagtagtgcaacggccggatatttttcattactgaatggaacatccattatatttaaaataatatgtaattatcgttctctcacaccaaacaaagtaacgagaatgggagtaggcaagcagcaggtg

SEQ ID NO: 33412 - DNA, 205 bp, Oryza sativa
tattaacaataacgctgtaaaattacatgtgtctcttttttttttcaagactggtagcatgtccctgtttaaaggtgttagtttcataaccggaatgtctctttgttaatttaattcattagtactctccacaaactaaaattacaaattcttttttgcgagacaattttcaaaccctaatgctactgccaatggtggtgacaga

SEQ ID NO: 33413 - DNA, 1501 bp, Oryza sativa
ggactaacaaaaataagccttttgtttgttctaatttaatgccgactcctcgtaaagatcggcaaagtgagattaaatatagctttgatgtggccaaatgcgataagatttttgattatcttttgcaagaaaaacaaattagattacctaaagaccatgtcataccatctcaagaagaattgaagcgtcgagcttattgtaaatggcatgattctcattctcaatctactaatgattgcaatgtgtttcgacgataggttcaatcggccatagatgacagacgattgaaattcactgatggtttcaagatgaagcttgatcatgattctttcccggtgaacacaattaatttcaatgataagaaggtgttgattctgccagagcaagccgaatctactaagggaaaaggagtggtcattggagagcctaggccaaagatgatggtgccaaagaatccgaaggttggtgtttggaaggagaataggagtgaagctttaagttctaaagctcctaagaaaactaaggtgacattcgatatgcttttggacaagtatgagaggcaagctggtgagaaagctcgcaataaaggaaaaagaccaagatcacctcctagggagcgatttggttattcaccaagacggtcggaatcacctacatatcatcgttctcaagacatgtcatgggggccttatccaatgccgccaccgggttattcttttccttgctacatgccatgggggcaacgccaccaatgttcaatcatatgcctccaatgcaatacaaccaaggatggggaagaccaaggagaccagctcgtgagcgtttgttttcaccaaacaatagccggttttatgctaaaaatcggatcaatgaaggaaagagggaaggaaagcgtgctaaggtggagacgaggacttcggaggtgattactatcaaagtggggtctcatgatgtgctaataccttttggagatgaagttggagagtcttcaagcaacaaatccaaagctgggaccagttcatcgcagtcggccggtctgaccatgccctctggctgaccgggccaacaagccggtctgaccgccagccacaggccggtctgacaggtgtttctggccggtctgaccaaaagtctgcgcccggtttgactgcactccagcgccggtttgataggagatttgcaaagggtagctcgagggcttcgtcgtcttcaaataaaatcaacagagggcattatttacctcctggaacagagccgaaaccaaggtggatgcctaaggatttgacggctacccaaaagaggaggttgcaacgtcttcgggcccaagaattaaaagagagggaggctgaagagcaaagaaatagaaggttcaatgagttgcgaccaccgcgtacaaaggtgtggaggcgtaaatccatagaagctgaagaatcggttgttgtgcaaaaggagaagggagaacaatcgattgctaagtataattcatctccaaaggaagata

SEQ ID NO: 33414 - DNA, 752 bp, Oryza sativa
gttagagggggttatgcatagggtcctgtcacggcctcttttcgatgtcatggtggcatgtcagcgcacggaaacgtggcatggggttgtgtcttgtgggtacagttgtacacctctgatcagactaaaactatccgaatagccgtgcccgcggttatgggcggtcaacctgatttaccgtgattagtatcattactagtttagcttaatggaactggttagttcaggtggtagattgggtctgtctcaacgtggtgtagcgttgagcagtgattggataatattgattaattactacaactgttttactgctttcaactactgcttttaaatgctagctttatgcaaatgaacccctctagctctctcatggatggatgtgtgtgtgtttgtttgtttgtttgtttgttttttacaatcctgcctataagctgtatgtctgccctatgatttactcaatttgtttgcatattggttcttgcgtgatgaattttgagagtaatttgccacctaaccctattctagggctacccaactcattcactttgggttgagcttggtactaaagtgctttggatctttgagctctttctccctgttttaaatccctcctcgttctttgtgtggtggatcttggtggttgtggatttggtgtgtgggggcttagtgtgtatttcactcgatcttgagcactagggtttgtccaagagttgtgtcgtgtttgttactcttggaggttgatgactcctaga

SEQ ID NO: 33415 - DNA, 1501 bp, Oryza sativa; identical to SEQ ID NO: 21316

SEQ ID NO: 33416 - DNA, 439 bp, Oryza sativa
agtctacgtttaatatttataattagtgtccaaacattcgatgtgatagggacttaaaagttttagtcccatctaaacagggtcttattcttttaacggtagacgacacatccatcatcagcgaaacacccatgataactccgtcaatcataatatatgctggatcagtttttcataagtattcataggtgtagagtgtgcgtgtgtatgtttacatgggtaagtgtgcgtgtgttgtgaacctctgtttataccgtgtttttttttaaaaaaaatgaaaattcgaatgtggcttgttggtattacaaccgcaggtgagtgagaccacccaccggttcgtgtctccgcaccgcccatccctaaaacatcgccacgtccccgccaccccccttcaatgtccgtcgccaccggcggcggcgtcgtcctctcgcgtgcccaa

SEQ ID NO: 33417 - DNA, 1501 bp, Oryza sativa
acacatatataaaacttttttctcaaattatttctcatttgtaaatatgttatttggtttattcctccatttgtaaatattgcttggtttattcctccaacaagtgaaacgatgggatatctaatagagaaaattgatatttagccattctcgggttggggtttcgccagaatgccatcgccgaatgtggcttcgttataatgccatcttcaaatgaccccatcttgccacactgccattttaaccaattttgattatttgcaaatgttttccaccattttgcttatttggtttgacccaaatgcccttgcctcagccgtggggcctgcttggcaggagcgtcttccaccttcgtccaccaccatccttctctcttcgatgaactcatgccccaaattgatctccctccttggttgctcttgcccaaatttgaatgcaaaaatcagttcctctcgtcctcctcatcaattcccccgacaaatcccactcaaatcggcttaactccgtggtggattttaaagtccctcttcaatggcgagctccaccatggccggcgtcgatctctctccccgatgaggttgaagggcccgctcaagcgactggacgttgcgggtggagctggctgcggctgcgcgcgcgagcaggtcccctcgacaaggagctccgccgtgagcaggtcgctgcccacatcgaggagctcatcggagaaggggatgacaccgtggcgcgcggtcaggtcgagtgcttggtgcgccgcgccgccgagccgaactgtcgtccccgtccacgccggcgccttcctcgtcccaaggcgcgctgccttccccgttcccggtcgccgtcgccaccgccggcaacttgtgcgtgaacccggtgagcttcgccgtcaagctggtgagggcggtgaagggcggcgtcggcaccatccccgacgtggccagctttctcatctcgtagcggtacggcgatggtctcgagctgcgccagcgccacccaccatctgcaacgaagagaggatgaggtaagagaagagagatgagataggatccaagggtatttttatcatctcagcaagaaaaaatcattaaattgagaagaaatggatgaaatggcattgcaacatgttgcccctgtttgagagtgatattttaacgaaatcatttttaaaagtgttattctagcaaaacatgttttgacaatggcaaaatgtcaattttctcgaccgatttatcgagggcccgacacggtcgtagtaataagatggcacggtcccgttcgtcgatcagcgtcacgagccattaattcctttctcgcgacaggaacagtagaatggatcccccaggtacgatctggaccgtcggtcacgcatcggacggaccacgcgcgctcgaggccccccgaccccgtcgctgtacatccaagctgtctaaacgcccctcgcctgggctctcgtcaccagtgtgaacgcggcaaggaggaagagaggacgagatgggcggcg

SEQ ID NO: 33418 - DNA, 1501 bp, Oryza sativa
cctacgccgccgggccgccgttccgccttcgtcccgaggagcgccgacgccgagctcccccgcctttccccgcccctcgtcgtcgcgtccttggtgagctcctcctctccctccttgcctccctcctctatctcccgtgcgtgctgccgcgccggtggccgccgccgttaggtcggccggccggcttgtcgctgccccgctcgcctaggccgcccggatccccttgccgcgccgcgccaccgctttcccgcgtgcgtcggccgtcgccgcaggaggctgcgccgccgtgagccgtcgttcggccgggccggcctgagctgtgcccgtgctcagccgcgccaccccgtggccgcccgatcatgtcacaccctaaaaatccaaaatatataaattgttgtttaaatggaattattagattttattttaaaagcctagaagagaagatttaattttaattaataaattccaacataaaatggggccagataaaatttcattaaatactttgcttaattctataattcctagatttttctgggatttatttgagctaaggaagtatttttaataaatggaattgcatttaaggaataatttaaattgaaaaaggtttttaaaagtcttcttttggctttgagccgaaagtcggcccaaaaccctctctctctccccggcccaagtcggcccagtccgccgcagccgtgcgcgcgccctcgctcgctgacaggtggggcccgcctgtcggagtcgtcatctacctccggccgccgccgcccgaaaccctagcgccgcgccgtttatcttttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtcacaagttggtatcagagccccttgaccctaggttatgccaaatggttacccatagaagccctctaaaaatattggaaaagtagaactgttctcctccccttctcttttaattaaaccaaactaatggcacatgcatttcataatctcttttaatggttctcattcaaaatttattccagtgttattagtactgtacatctattactgtactaatggctcaattaccagcaaaagatttacaatattgttttatttaatcttactgcaacgaaataaatttagcatgttgattttataactttcttttatttcttttggaacctgttgttcaaaagtacaaaatttgtgaccttgtttccaactgtttcaacttatcttgcaagattggtttactttatttacttaccttttactttgattttcgaactttattcaaattaatccaaaaccttgtgctattaattggataaatgtcttaactccctccttacacttgtctttaga

SEQ ID NO: 33419 - DNA, 410 bp, Oryza sativa
actcattgctggctcaatctttcccctcttcagtaagaaaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagatggtatcagagccatctcgactgtaggataagccaaatggataaaacctaaggacatattttataaataaaactatttgcgaaagttcctttttctccttcccctaa

SEQ ID NO: 33420 - DNA, 1501 bp, Oryza sativa
tggtcggcggggagagggggaccacctcggcagcgtcggcgttggtgaaccgccgtccgcctcccagcgccgcctcccacttccccgcgccgccttctgccttccacctcccgcgtcgctgcaccaccatgcgccatgcgtcggccgtcgtcggcaacaatgtgatcgacgggaaggaaggaaaggggaaaagaaggaaacataaggaagaatgggagagagaggaagaagagtagaggctgacatgtgggtccgttgttattttggagagcattgatctgttggagtgagtatctagtttgactagctaaatcagatggggagttagctatatgagtgtttggagagtctgatttgaaaatgctattgaagatgttgttatgcgcacgttgggagggaacgaaatttaagaacgacttcgctaccaaactagctactccctctattaaaaaaaaatcaacttctagctatgcaaggaaatgtgtaattgctcattagttgccacgacccaaactcggaaaaaaaaagattgacttgccaaacattttacatgcgtttattgtaccatagcttgaactggccggtatgggtttgagagagaaaaaaagtactaattatgtactcaggtttggaagtagagtctacgtattgatctacgtggtcctgctgatctgtactttgggtctagtggagtcaagacgacatgttcgtcattaagtacgagatggatcggaacgcatcactgatgacgaaacgaatggactagtagtacataattacgcacatgtgacacacaccacacatactgtacatggatatcaccgaggcaagccgagcgaagacgagtagacgacgaggagttttcaactgatgatgatggcagtgacgattgctaacaccctggtgctcggtggcaacagttttgctgaccttgcatatgtagtacaactaggcaattccatttgtttttgaaccaagtagcacctgaccatcgtagtatcgacttgtacaattgaatctcacattcttttttttttaaaaaaaagaaagaaaatgcatacatattcaacccaaatacaaaacctgtgtgataatgtccatcaatctagcaaatcattctcacaacgtgatatctttttctttaatgactttccgtgttttcaacgtttaatggccggatttccagataatagcatatattccaaaaaaaatttccaatgaagcagatcgagcagaaattaaggagtaaacaaatgatttccatgttttatgtgcattggtgcataccaagacaaggaggctgacctaaccaagttaaccatccgtggctccatatctgagcggtcgcttcggtccacgacgcgttcacacctcgacaagtagaccaccgccctgatcactcgccgccccgcgcgcgcgcgatcgatcccctcctcgctcccaaatgcaaggagcaaggtcggcggcggcgatggcggcggcggcggccgacgaggagagg

SEQ ID NO: 33421 - DNA, 1501 bp, Oryza sativa
cgaatataagaactcgttgagatgaaaaccttgtaaactagggtaggaatgcgccgaaaagtgattattgaactgttgttttttacaaagactctgtatgtatatatttataccataagtaaatactagttattatcggatataactcaaattttcctaaggataaagtaaaaaatttacaagcccaatcgaactataaaacaaactttcctaaaacataaaaggaaataactaactcaatctatttaataaataagttaagatgttgtatccttatcgagaactcgacctccccttggtaacgtcaccaaatcttcccataccgagtccgacaaggggtcgattcctggttatcgtccatgtcctatcggcaactttcataactctgccgccgatacgctttagctgatgcaatcttctaactttggatcccaaaatcacgccatcaataccgctctgcgctttctccttactcaatagaatatgccaaattttaccgttagtagtcctctatcctcccttttcaccgcgacctctttctcccttcctccactgcactaccgctgtgtcaatttagcccttgaagccggtggcttccatcctggcaatagcaaccagggcagagaggcgtccgatgacggtgctcccctccctacatgtgccgccgcctttcctcgacctcgctgccatagttcgccgataagacaagcggctgcacccgagatgtttatggtttgttttcattttcagcaaaatttggtcgcaatttgcattaaatacttttagaagttactttatacagatgtttgtgatttgcaatcgttttcagcaaaaacttattctaatttgcattaaataataaaaaaaacttcatacagatgtttatgatttgcatttattttcagcaaaaaaatgcatttaacaatattatgatttgcatttattttcagcaaaaattgcatttaacaatattctttcctcgacctcgctgccatagttcgccgaagaggcaagcagctacacccgagatgtttatggtttgttttcattttcagcaaaatttggtcgcaatttgcattaaatacttttagaagttactttatacagatgtttgtgatttgcaatcgttttcagcaaaaacttattttaatttgcattaaataataaaaaaaacttcatacagatgtttatgatttgcatttattttcagcaaaaaaaatgtatttaacaatattatgatttgcatttattttcagcaaaaattggtcccggcggggctcgaacccgcgaccttcggctcataagaccaacgctctaaccaactgagctacgggaccctggttgaattattttttcttataatttatatgtactgtcctgagaaatttttggagaacccttttctacgttctaacatggcactctgtatagagatactggttttattggaccagcaataacaaaagttgagagaaaaacgatggaggcaaacaagccaaaa

SEQ ID NO: 33422 - DNA, 440 bp, Oryza sativa
tggttaggctggtaatctcacgaacttatttactgtaaaataaaatgtggcacatacagtactagaaacttttctaaaaatgggtatagctaataaagcctgtatatacaacttataaaattcataataaaatcatgctaactctaaaaatgatgacactaattttgttgaactcatgagaacgtaaaattcactgcagtaacctaatacttcacaaaatttgtacctaaaatgtatcaaaagcttaataagacataattaacctagagctagcattaaactttaaaaattaataactcataaatgcaaagtgataaaatagaaaattccttcactaaaaatcatatgcacctatacacagtagtgaactcatgcattttagagcattttaattttttacatgttttggcatttatttgattactgttatttcttttaga

SEQ ID NO: 33423 - DNA, 172 bp, Oryza sativa
gagccaaatcttgctcaaagtaggatgggtccccacccaaaagaagggtaggtagaaatggtatatgtggtatccccttgagatataaaaggaggaccatgcctaccaagaaaaaggggaaaaaaagaaagaaggagaaagggaagctcgtagaaaggacggggaaaaagag

SEQ ID NO: 33424 - DNA, 1501 bp, Oryza sativa
gagccaagagagagagaggaagggagaagccgagggagagagaaagaaaagaaaagagaggaagaaagaaagaagccgggagagagagaaagagaaggaaaaagaaaagaaaagagagaaagagaaggaaaaagaaaagaaaagagagaaagagaaagaaaaagaaaagaaaagagagagagaaagaggggaaaatagaaaagaagaaaaggagaaaatagaagggaagttaggggagagattaggaggatataggaaataaaaatggtcggggttaatcatagattatttttggaaattcctagagtgtaatagtatttcgatcgaaattttgggttaattataggaatatgtttcttgatcggattagattaaaaattggtagtaatttagatgtaattaataactaaacaattagatgaattcttatagattattatagattatttttggtaatctctataagtcatcgattcacggtaggaattcggatttaatttttaggaattttagccgtgtattatatttaatcatttagtcatagactaaattaaatcgtacaatattataagataattttaggattttgtccgatatttagcttgcgatagaaatttctaacctattatatggatataatgcccgggtagattaaattaaaaacttatggtaacaaaatatttatacccgcaaaactagtttaggatgtataaatcgaaattgggtttgccctagttcgcgaatagtaaagttaatataaaagaatcaatttttgcattcgacttccatttggatttacttggatttttatttgaattctaaccgaatttaaatcaattttctcacgtaactataaagcccgagaagcccgagggagttgcggatccaagtgaaggccaagacccgcaagactttgagcaaggcaagtcatcactattccttgaacatgttgatcccatttacaaaattattttgtttacaaataaaattacatgcaatgatagacatcctacttgtgattatgccatgccttgattattgtttacccttaaatccttgtaaccgtgatttatgtataagtccctagtcaactatgacaaatgcttagaaatgctactctagatttatgcatactcatatttatcaaaagctatatgcttgggcaattacctttgggaagggaattgagatgcggcatgtggagacatgagcgccacattgccatgatgttgatgacatgatttgtgaaaggagaaataaaattaaataactgttttcgactggggcggacggaggatttgggtggtatccggaaaaggctagtaccgtccccggtcaattaaggaccgagccatgaagttaagcatgaaacgacgcccgtacaaccgcacttctcgtatgggtatagacctagcggaatatatagctgagcggaggcagtatccatgcatagtggtttcttgatgtgtgaggcaggggctctacggtggggcagccattg

SEQ ID NO: 33425 - DNA, 1501 bp, Oryza sativa
gcgtccgttttagtgcagactagtcctggactccgaattgcactcgacgtcgacttggtttgggcctccaccttgacttagacgtccttgatgatcctccatggctctaagtccttctccaagtgtcttcttgtctcctccattatttctaagcacaatataatcattaggtaacaatctattctcgaattcatacaaagaagaacataggagcgagctcgtctctaaattcaattgtcgcgcacgagctcttgttatcggttcttgaatgaccgttggaggattgttgtgtgtattcgaggtaatgatgtccgcagcagcatgtgacagccaatgcaaaatacagtgctttattctcgattcatctcttcagtcaatctctaattatacgagactgaataaatgtgttggtcgtgcaaaagcggccaagagcagggtggtgtagttcgcctattgcgcgttccgcggggtgtacacgtctcaatagggatggagctatcgtccggctagcccagacaatcgccccggctcaccggtgaaaattccattaaatattactaatacttttgaataaactgatcaggaaatttctatagcaaatgtagctatagtgaaatttgccccgtttcaaaagtttttctaactccgccacaggtctcagtcaatgtgcgcgtctgtggcaaactggcaatgtggcatgcatgcagctggaggacgacgacgatgacgaggaagcgcgcgtgatgcgcggcgcgccgcacgtcgtcagggcccggatgatcgatgcagcgtgatgcagagtgcagggtgcgcgccgacgatggcgagcgctcacctacctagctaccgtgtgtttcgtacgcatatgtggctacctacgtacgtcgtcgtcggtcgctggcgtacggtgtgtgcgtgtgtgcatctcgcatgtggcgcgtaggctggcgtcgggtctttatctgtacacataggcgcggcgctggcgaagaatgaagcggccatcgatggggatcgatcgatcgagctgtaggctggagcctgcaggatgcatacatgcgtgcagtgcacacatggggagcgacttgcggacggtcggcatcgatggttaagaggcagcatgcaagcgaaggaccgaattaaggggccccgtatggaaattttgttgctttggttggatttgatcatctgctctgttttaatttgccggacagaatgtgctgttaattcttggatccccacctggactcctggagaaaaggagtccggtccaacaattcggccctgtcgtcgttgctggcgaattttcagtgaagctcatgagctgatgtacgttggggtgtgggtgatggtgttgtcattcagtatttcagtgtgcccgttggttttgcgtacgcctacatatacattggttttggcttgtttgcctccatcgtttttctctcaacttttgttattgctggtccaataaaaccagtatctctatacagagtgccatgtt

SEQ ID NO: 33426 - DNA, 1501 bp, Oryza sativa
gcattgtgatttacaggatcatcatagcacacattcacagagctaagagagacaggggtgcaagaaatctaacctggttgatcagtgccgcagaacgggagacaagctcgatatcattgccatcaaggaccagctcatccttgaccttctcagaacgcaaaattgtcacaccctcaagcatgtccactttcctcacctattattgaaggaaacgaaggatgtcataacattttttattatctgtggtttccaagctatatactgaatgaatgtgacagcagattgggaaaaaaacaatgttgaaggccagagaatgatttgcttttctagagtctaaaccacatgtctatgttgtgtagaacaaatatgagaaatattgaagcatggcagaaatgatgtatgtgcaagtgatccctaataatgtgtttttaacagaagaatcagcattttgtgttgcaagactaactagagcagaaatccgaagctgaatgtaggctaaacaggcaatctgtgaggcataaattaaatatttgcagctactagttgagatgaatcaatagaggcgtgtaatcgtggagtggagaaaatacattgcgcgtaggatgaaatcatgtacgtgctggtagatggtaatagaaagaaagggaaaggggtaatgggggggaccttcttctcgccgaggaagttcctgatctcgatggcggtgttggagttggtgatggaggcgttgatggggaaatgggcatagacgaagcgcatcttgtagcggtagcccttggtgacgccggtgatgaggttctggacgtgggagatggcggtgcggatggcggccatggtgcggcgggtgccgaaccacgcgtccacctgcagcttcctcaccccctccacctccagcagctggaagtccaggttcaggtgcttgaagttgcgcgtcagcttcccacggggaccctccaccgtcaccaccttcgccgccacgtgcaccgtcacccccgacgggatctccatcgtctccgaagccaagatcgtcttcatctctcgctctctctctctctctctctctctctctctctccctctccggcggcggcggcgatgcggggcgtggaagaagaaggaagaaggagacgagtggcgttttccgctttatataggtgggtgacgcacacggccttagggtttttgccatattgggcctaggctttctggtgggccgttcaatgatgatggatgggcccaatcaacacgctcgcgacttgtagattgtaatgcagcagcccagtcattttaattcacatgcgcatatataataaataaatgggacactaaagttgtcaaaatacagcagaaaatgggaaaccactttatagtcgacgaatcgtcagtataatatctacatgcatctcatcagatgagatcagatcgagtacaacaagatggcgtatgcaggttgcgcatgcatgcatgaaaatcgagataaaaagggattaattaattattaa

SEQ ID NO: 33427 - DNA, 449 bp, Oryza sativa
cctgcagcccccttgaacagcggggcaggccgaaagaagcccagcaataccatgctccttgttcgatgggcccaaactccagcctgcatcaccatgtaacggcccatttatgtaaggcccaaaaactagtagaagtgttcaaaggcccataaagctagcccggaaacagcccatgaacagagcgaattattattactctctctgtcccgtaatataagggattttagatttttacttgcaacgtttgaccactcgtcttatttaaaaaaatttaaaattattatttattttatttgtgacttactttattatctacagtaatttaagcacaacttttcattttttatatttgtaaaaaaaattgaataagacaagtggttaaacgttgcaatcaaaaactcaaaatcccttatattgtgacggagggagtattagttttcaattaaaaa

SEQ ID NO: 33428 - DNA, 183 bp, Oryza sativa
  unsure (1)..(183): unsure at all n locations
acaaccccctctcattttccccctctcctcctgagccaagacaattccctatcccctcatctcactgcagctttccactatactaccaccaccactgagctgccactactcatccagctaatnngagaaggaaaaaagaagaacacagatactttggtaacaagcaagaaattggcacagaaa

SEQ ID NO: 33429 - DNA, 482 bp, Oryza sativa
ggccgtgtaatgcttcagcaatggctacaggttagcatctaatgctcatgctctcaaggaacaattcatcgccctttgttcttaccccaacatcagctgaatgacactagaaccagtcagtattcatgcactttgtaccaatattcctcaggtcacgcaatccgatcatgcatatatagcttgcttgttcggttgttccactgttccgtgaggaggcttctgttgctgcatcaacaaagcggtgctctgcttgccaacctattgcattgctacctcatccatgtacaaatgtttgtatatgaactagttacctaatgacctgagaccgaatcaaaatgttccattcaagatagctacatgtgtggcattgccttgttccacctgcagccaaactgtgtaatataagcaagcttgctatagggggactaggcactctaggcttacctaatccaccccttcaggcttcagctgttcagtgcaga

SEQ ID NO: 33430 - DNA, 189 bp, Oryza sativa
agtgtgccatgtttcacgtttctttttcagtaatactaaacatgagtgctgggaatcttctgtgctgatatttaagtaacacccatttgaattcaggagcattggctgccagtttgaatcgtactcatccgctacagcactatttttgcttgaaatttgaatctatcatattgcatgcaactttgcagg

SEQ ID NO: 33431 - DNA, 679 bp, Oryza sativa
atgtttcgaggatcggataatcaggttgcctatctcggatttgtttgcgttggagcaaggcaagttattattccacccctttgagcattattatcctatattctatatctctattattccatgcattagccattcatgattttaaatgcataacttgaacatatagcaaaccagatatatgctagattttgcttagccatgcctagttagattgcataaaatataatgaacttagattggaacagtacggtagaaatggttgatttccgggtggctagtactgttccaaccgacataagattgccaagtacatgtgaagaacgaacgagtacgaccgcaattctagaatggggacagacttagcaaagtaggttatctaacaaaggtggtacctctgtatagtggttcttctttaagtcctcgcgcaggaggcaaatttacgccgagcagggcgattataatatttaccgaggcgcgggtaaatatattgattattgcgcgctgtgtgtgtattgtgaaaacctggttgggacgacgggggtctctcaaccagttctctctaaagacctcgggaacgccagaactcctctcgctgctgataacgttacgttcagagcgcatgaggatgagagttcatggaacaggtgccactgatgttagtaaccgaaaagctttgcca

SEQ ID NO: 33432 - DNA, 1501 bp, Oryza sativa
agtgctactcggcccgctcggcctaccatgccttcttcctagggcaacttccctttccttgcaccgacttaccgtggcaggccaagggccttgccaagtgcaattagttcctttggtttgcactctagcaatgttgttggactgctgagcttttgcaaaagtacgacattgacaaccactcggtctatcccttttgcgcgcaaggagcttgaaatggtgaaccacatcctactcgactgtgtgttcgctcgctaaatctggcacaacatcctgtcccctcctggttggactgggctcgtcccttctcgtggtgacacttttcaggactggtggccgtttgcggtttgctagggccgcttcccagagcaccttcacaaggccttcgactttctggtcctccttgtatcctggcagctttggaaggagcggagtgttagggttttcgagtctttcctctcgccggtcttggaggtgttagtttccatcctccaagagggtcgcctctggtccttagctagtgccgctttgtttggggatcttttgggaggatagggtttttctttcgcttttctccctctgtttaggagcaacaattttagtttaatctccttctcttttaacccctctcttccccgtatctttgcaagggccagtccattccgttgtgctatgtaactaaaactctatttcttctaatatattgacgtgcaattttttgtgcgttcgcgaaaaaaatacaccttattaatgtattcgttccacatatatccataaatgatttttttcaataacatagtcaaggatgaatttttaaagaccaacccttctttaattaaagaaaggaggaaagtaagaaaggatgagtgtgcatgcctagcttgcgtaattgactaatatgaaggatagttttcattacttaggagatattgttttgtttcttgcatgtctaaatagttaaatgattaacataaaatatattactctacaaattaatatacatgttcaaattcaactgctataaattgtaaataaaaacaataaataaatataattatgcaggtatgttaactagttttagttgtagttttatttgatctttttgttacagcctatacaagtcgaattaattaatatgataagatgatatatcttatagtaattaatttatcttgtcaaaattttaaaatgtttttttgtaagtatttagatgatatatatgcagatgtagatgtcaattgagagatgaaaatccatgtatgagtagtaaatctgtacatatatacgtgacggatgcatattaatggatgaacggcaagcaggcatgcagatagagagttgaagtattcaagtcgataagcaattaatggacgtgaagaaatcgcgcgaattgaacgagcgagcgcccgtcccggactcccgttggtccaccgtctccggcagcccgcactctgcgctagctgccgcatgcatctatccatcgatcgatacatgcatcaatgtg

SEQ ID NO: 33433 - DNA, 999 bp, Oryza sativa
gtaggactgccacgtcagcaagtctatcccaaaaccacctaaaacagtgctagggggggtaatttgcccggtttcaatagttgagggtgtagaatgtctggtttttgagttcgggggtgtaattcggtcgacctcgatagttcaggggtgtagtactttttccatatttatttgagctaaaatattgttcccactagttgatacctcgtgctttgctagagatatgtggatttatgcatgttatacattatagaaatggtataacatgcatttatccacatattttgctgcaaagcgcgggggtatcaactagttactagcttattacttggtactttttactgtaatcttttctgaaattatgaatagatatgcatgattagttgtgaaatgtaaaataaccagggttcggaatttccaaatcatgattaagggttcattcagattataggataggaaaaatataggattgggaaagtatagaaacaggaaaggaatctaagtgtgaaacataagaatgaaaaacaaaggaataaaaaaaaatgaggacattcggataacatgaaattaattgcctgggatttgcatgcaggaataaaaaaaaagagcttaaggtggacggatttttcatatacttttcatgtgaaatcagcatcaaaggaaacttttctttggatttcctacaaccacagttttcatgatctgaatgacaagaaaggaaaaaaaattcctatgcacagtattcctccgaaaatcacgtgaagatcctctaatccgaaaaagccctaatagtgggaactgaacaggccttcatcgacggcgaccagcccgccagcttgccagttgggctagattgctggaaagaatcacttaagtcctttaagttgttgtagagtctaaaattcttccctataccgaaacaaaaggtataactcatcctcaaattcaccatacgtgttaactttggtcctcgacaatatagtagcccgactgacgcga

SEQ ID NO: 33434 - DNA, 823 bp, Oryza sativa
cataaaaatatatttaacaatgaatcaaatgataggaaaataattaataattatttaaattttttgaataagacgaatggtcaaacatgtgataaaaagtcaacggcgtcaaacatttcgaaacggagggagtacacacataggatattctcttggtatctctcgagaatcgtaaaatttctcacagaatattcattaaagaaaggaagctgccagtgctacgtgcgatgattttggccgtttgttcccttacattcgtatatgtaccgtatataatagagtaaattccttgtgtgcccctgaaaagttattcaatcccttacatgcccctgaaacttactcgattccacccttgaatttttgattggatcccctacatacccctaccgttagattgagcagcattccctggttagtttggttgaaaatgtctataatacccttgaggttggaggagctgaaaactaagaacatgtttggcagctgggtttgaaacattcatgactgcacagtatgtattccgtgagactaaaaaattagtgcataaaattaatttcattttcttttgttatagcattcagtattttataaaaaaatataacatgacattggatctttcatgaccactaaccgacacagcctgggggtaaaagacagtacccctagccgtttactcaaacaccattgcaattcatcagcatatcaagaggatcggtagcaccatttaataggaagaaaatgaaaatacatctaaaagcattcatacaccatcagcagtacacaaatatattactttttacatcatgagcataatggcacaagc

SEQ ID NO: 33435 - DNA, 1501 bp, Oryza sativa
gttgtagaattcaaaaagaatgaactagaaatcagaaactgaaaatcttaacttctccaaattctacgagctgacattttaccgtgatcgaccgatcaatagtttacacaacagtgcgtgtttgtctcgttgaaaaggacaaggaaggatggatgttcccttcttctgaaacacaatatatatgaacataaatatgtacactttaccgttacaagcacatttaaagactgtaccgacgtaaatagattaataaaatcatcgtatatgtcgatatgttaacggatatatcgcctacaaagaaaataattaactgtaaatatgaacacatatgtcatacctagaatttgatcttgaataatcagattccaccacaatgaatctaactagttaaattacgctattaggatccccgtacctatattgttttcatctaatttatgtcctctatatgtgtaaccgaactatatttatattttggtatagttgttttattgcatagatatttgttaacatgtgttggacaacataaattaactttaccaactgatattcttacttttatgaaaaaaatatatgtggcgttatttgtaaaaccgatcgaggtactagtactgattaaggtaccccagttcccctccaggcctggaaaaaaagggttgtgctaaaaaaaaactgttgacagttttttgttgggaaaactttcgattttctagccattagatgcgctctaggattcgtgcaacatataaagccagaataaaaaaaaatcgcatgggcaaggcagtcatcgaacatgttaagctaagccatgcaacttcttattagcaataactcttttttattttatatcacttacaccctagttatatatcacttacatcttaattatagagtagttacataacacttataccctaattacagagtaattacatgatagttatagggtagttacattgtataaaattatgatttgcaatttttttaggagcacatattacttttgaatttgaaaattttttcccttctacatgtaagccaatttcttgttgttcaatcagcttggacactaaaatttatggtttgtactagtgtggattgtccccctataaccattgatgacaaatcctgtagtcaaaaaagttttggacctcaaaaattgtcgacaactccctggctagtcccggaaaaaaaaaatccttcagcagttcagttcagctctaaatcatttactattcagaacgaacaacagcagcaaaatttgaacccgtagtcccgtacgtagcataaaaccgtaagtaacgtgcgtatgtttagcgtgcgctaagcgaaagaccaaagtacagtatagccctgtagccgaaactatagtcctgcgcctcggtacacgatacgatgcccacagagaattccgtatcaatctggggctggcacgcaacacgcgtccaattttcacccacgcgaggagtggtggtgtgggcgcgcgcgggcgcgcggtgca

SEQ ID NO: 33436 - DNA, 1501 bp, Oryza sativa
tagctggggctcacctcaccgtcgtcgtcgcacgcgcgcccagctcgatcatggctacgtcgccggcgtaggttctcctagatgattaatcaaattagcacgcacgtacagagtaattaatcaattttactagtttgctatagcaatgaaatttgcattggtagaatatataagaggatttgcattgtaatttgtcccctaatccacggaggtgtctcgttctgcgcgtgggggatgacgatgctggggttgtctctcgtgcgtgcgctagcttagctcccagtgcagtggtagctagacactactgtgtcaccgtcgtctcgtgtgctatgctacattgctactactacatacgtagaatggcatccaaggcgagtagaaaggctagctgcgtatactaatggtttgaccttcggatcatcggatgcatagttagctagcctatgcgtgcgtaatatggagtgaaaatatatattggtaacttttaagggaggaaaaagtatagtttatagctagctgtagcgggctaatggagaaattattaattacctcgttcacactagctacctgttgattcacgatcagaattaagcagagactctctcaaaaaaaaagagaagcagatcgactgtaaaatgtagcaaattctccatatatgggagtactccatcaatttcaaaatagatcaacctagattaaaatagaatagtacaacgaatcttgacggttccttttcaacatagaattattttggaacggatcggaaggagtacacgagtgctatagtgaatctgtggtattgtgtgctagtagttctcgggccaaccgttcttgtattgttttccttcaattctcaaggaagttggcgtgcaagaaaagagaaagaaacatatttcgttgttaatttatgttttgatgcaccattctgtctatttttgattgatctcgccagttcctttaaaatcaaaacggtactaacttttaagcgaagctatgtatattctttccaaattaacaaatctaagatgacaggattcttcacatgaaagcttccgttttgaaaaggcagaacttaatcaaggaaaaaaagcagcacttttgttgtctataactcctttttagacaatgtgtctaccatgaatcgtgttatttgaacatactaaattttgagagaaatggattgatttgctcggccctatgcatttaatactccatctatcttacactattatgtcatttttacactggtgcagataatgaaaaagaaacgccaacgatcgatcagatattttttttttggtattgacgcaagctgagatcactctcctcctatcatagaaattaaattactaatccatcgatctcttccgtctagtcagcaagaacataataattttaaccatagcaattagctagtcaaaacgatcaataagacgataacaaattcgaccacatgatccccactatataacaccctttttatcagcctcaaatccaggtc

SEQ ID NO: 33437 - DNA, 202 bp, Oryza sativa
atccaagcaggaaattcagaacccagaacaacagattagcccattcgaatccaaccggccaatttccgatgtgcgaatcaacaaccatagcatttcacttaaatacatgatgagtcgcacaagctcaggctgctctttctctcacgcatttgcccccaaaatgtgcaacgcaaagcattcctgaccactcagctcacgaaaa

SEQ ID NO: 33438 - DNA, 283 bp, Oryza sativa
ggcggcgatggcgacgacgcggcgcggctcggggcgcaaggcggcgcggcacggggcgcgacgcggggcgacgggtgacgcgatggcgacgcggcgtggcagcggcgtggggcgcaaggcgacgggacggcgcgcggcgcggcagcggcacggctcgaggcgcggggcaacggcgcgcggcgcggcagcggcgatgggatggcgacggcgacagacggcgatggcgacgtcggcgcggcggcaggcgacgatggcgacggcgcgcggcggctcggggcgcgag

SEQ ID NO: 33439 - DNA, 1501 bp, Oryza sativa
tctctgaagcctaaacgcctaaatactgctctccatataacctaaaccaggaaaccaagaaaaaaagaatagactttactagagtcaatcgaacgagacccaaaccaggaacaaataaatcgatcggatcgaacgaacgaacgaaagcagcagaccggagcagcgccgacgaaatccctacccaccggcgataggacgacgacgaatcttgcggacttttagacgaacccgcgacggcggcgaaggaagcgaagaagaaaaaaaaactaaaaaacaaaaaaaaatacggcagagaggaagaggaggaggaggaaagagaattacttgctcgcgaaggagaagacgctggtagcgggtgggtttggttggatcgaatctctcgcgggggaatcgaaacgagagagaggagaggaagacgagaagtcgatgagcctgcgaatacgggggggtttatctctcctcgtctcctattaattgacgcgtgtaccgtataagtaggttcgtatatacggtatacgtgtacgtatcgtgccgtattttttatctggactaggcagcccagggcaagggccgtgtggcacccgcatgcgcgatctccgtcgtcagcttcccgttcagattcgtgctagggtcgcgtttcgtccagcttcccatcccaaaatataatggatttttaggtggatatgactaggattaacaattccaacgaaaatcgatcgaattccgttaaattttaaggtttcgacgagcctcgaaagtagaaaccatctgagattttgattagtttcatctaaattcaaatttaaattgataataaggaagaaaatcaaataaaatcttacaaatagtatgatattcatagtacatattaggatataaattttgaaaaagttgatgtattccgtgtactaactgaactttatagtaggaaagaaaataatagcgaatgaaaaaaaagaaaacactttcaatttacctcttttcctagttaccggttgaaatttcaatgttttcgcttggaatttctccaaagccgactagttttcgcgagcttattggtaaactcagagaatttgtatttaaattttggtttataaaatttgttcgggatctaccggatttcgcgaaaaccgttattctgccagagcccgaaacggaagggcatctcggagttgtaaacgctggatatgacacatcttaatacttatgaatctggacatcttcctgttataattgaagggcatcttcctgttataggatcaaggaggccgactagagggggtgaatacgcggttttaaaacttttggctaaaaccgaaatttgtatgcggaagcataaatcaaaacggttttacacaattcaaaacctaaatcaactagtctcaagtaagtgcataaagaagctagcctatgttaaggtttgcaagcctagggtgataatagacttgctcaaatgttaagtgcacaaataagctagtatgtaaacttgctcaaatgtaaa

SEQ ID NO: 33440 - DNA, 1134 bp, Oryza sativa
attcctgcagcccaagaagtacaacgggcaggttgtgaagcaatcggtcaaggcgggtggcaggagttctagaaagtaaaaaaaataaacctaatgataatcatatttgatttctaaaatctcaataataataaaaatgagaggcaacgggcgggtcgtataggagtacaatggcaaagtcgacgatggttggtgggtcttctagaaagtaaaaaaatgaactccaacgatagttatgttcaacttttacaatcctaatgacaataaagagtatgcggcggatgggtcgtagaggagtacagtggtagcgtttgacgggatttctaaaaattataaaaaaaatgaaacccaacaagacaataaactccaatttttaaaggttcgggcttctaaaaagtaaaaaaataaaccccaatgataatccgtttgattttgaaatcataatgacaataaagaagggcggcagcgggtgagccgtagaggagtacagtgacaaagtcgctgacgttttggcggaacttctagaaagtaaaaaaaataaacctaaataataattatgttcgatttttaaaatagcgatggcaataaaagagaagatgcagtggacggtcatggatgaatataatggcagtgtttgtcaggacttctagaaattataaaaaagatacccaacagaacaataaactctaaaacctataagtttttagatccaatttttaaagattccaagaagaatgaatagaaaacagtggtagatcgagcaagcaaataaagaataatgtgacagaagtaaggggtaggaactgttgtgacttttaaaaactaaaaaaaattaaaaacacgaggataataaggtttagtctttaaaaatcttaagacaacgagataactatttaacaaatttgaagtaaaatcatattaaaaatatataattttatataggtgctagccgtgcaattgcgcgggtcacccagctagttgaacatatgattagcgtgctgttatatattctgtcaggttttgaacaatttcaggtttctagtcagtaaaccaagagaaaattcaaccagttctggtaaagcccggcccatattggcccactagaaccgtggccactttcctcggcccatcgtg

SEQ ID NO: 33441 - DNA, 1501 bp, Oryza sativa
cttatacggtacacgcgtcaattaataggagacgaggagagataaacccccccgtattcgcaggctcatcgacttctcgtcttcctctcctctctctcgtttcgattcccccgcgagagattcgatccaaccaaacccacccgctaccagcgtcttctccttcgcgagcaagtaattctctttcctcctcctcctcttcctctctgccgtatttttttttgttttttagtttttttttcttcttcgcttccttcgccgccgtcgcgggttcgtctaaaagtccgcaagattcgtcgtcgtcctatcgccggtgggtagggatttcgtcggcgctgctccggtctgctgctttcgttcgttcgttcgatccgatcgatttatttgttcctggtttgggtctcgttcgattgactctagtaaagtctattctttttttcttggtttcctggtttaggttatatggagagcagtatttaggcgtttaggcttcagagatttgtttgatattaggctgatgtcgtgattcatgaatcatgagtagtttcctgcgtttaggggtagcatcactatgcggtactgctgattggttttcctgcgtttgtaggatgagattggcccccttgcagtctgtaggataattgcatgctaatgatatttccacccctaaaatcttcacttcattccaattcaactaccaagtttttttaattgttctcatgaattgcatgctcatggcttgaagacgtcgagtctttcctccttgtttttctttaattgcgactccacctaatctaaaagattcaatcttcaatgcttgctttacttgatggtttgaaattttactgtgctttgtggcgcaaagcggttgactttttagaggtttgttttacctattgcctattcaatctactgtgaaaaaaaaatctagctttatatccatgttgtgattttcttggggtttgagttgttcaatatagggagaggtgcttaatttggtttttttaaaaaaaagtttattgtgtttcctagacaatttagtgcaaggttacagactggtagcttgtaccctagccttggtaggagttacggtttaatcctctaaataatttctcatcgatgtacttgtggactgtctatgattggatgtatcaaggttttaccttttgtgtattatgcaatatgctggtctggttttcttgagcttgtgagttgtgattgtggcttacaacgagtcccttcacatatgtaagatctgtgatggaatgttttagccgcactagcggatagaagaacgggaataaaaataacaaacaagttgggacattatgcatcttatattatatgtttgagtcttttgtgtggagcattcactcaccatagtaagtattctaaacaattaaattcaacctatattaaagaaagaaaatattttagtaaattagtaaatatttattatttataaagcttttcacatgtatgcattaatcttctaaacaggttt

SEQ ID NO: 33442 - DNA, 1501 bp, Oryza sativa
ttgtgttgtgcacttgcctggtgtgccggggagattgcgcttcttcttggcgggaggaggaggaggaggagggtgttcttgctgatggttggtgagaggagcgaaagggttggagatggctgcggcttcactagtcgccattgttatcaaattgctaagcttgtcgttggcttgttgctaattaatcgatcgatctctcttgggatcaaactatgctagttgctgatcgatctcctcttctgcttgactagttccctttggagacaaaagggcaacttttgttcttaggtatgggtcattacccccaagcataaataagctttgctagctagtggcaacaacaaaaccatcaaggcaggataaatatagagctttgctagtgagagtgagatcgatggagagagattgtttgtgtgtgtatgtgtgagaataaaatatttgaagtggtaaaaaggtgaaagttgaaaggtgtgtctttaggtgtttgtgcaagcatagcaagggttagctagtgtagctagtgtgtgtgggtgtgcaatgcatcatgacacatatgatgaggagaaagatagggaaagggggaaggagggggtggtaaaaagctgtggcttggtgcctttgcatttggcatgattagcccataatgtgatgcttcctgcatctgcatatccccccttctcatcaaatctcagccttcctccctctcccactgcaaaggtaagctactgcagctgctgcctctggagcctgcactgcaacagtgcaatgcatgggctgctactttctttggcctggacccacatgcaggcacacaccttcttaagtttttgaaaactagcttgttagttgttaaatagtactccctccgtttttaaatatttgacgccgttgacttttttaaatatgtttgaccgttcgtcttattcaaaaaatttaagtaattattaattatttttctatcatttgattcattgttaactatacttatatgtatacatatagttttacatatttcataaaagtttttgaataagacgaacagtcaaacatgtgctaaaaagtcaacggtgtcaaatatttagaaacggagggagtactagattgattggatcaaaatcaagaaaagggatttgctacaattgtcaattgatgttgtttgagccgtcatctcaagcggggtcccttgataggattagaatcacttgatcctgacttgacctggatttgaggctgataaaaagggtgttatatagtggggatcatgtggtcgaatttgttatcgtcttattgatcgttttgactagctaattgctatggttaaaattattatgttcttgctgactagacggaagagatcgatggattagtaatttaatttctatgataggaggagagtgatctcagcttgcgtcaataccaaaaaaaaaatatctgatcgatcgttggcgtttctttttcattatctgcaccagtgtaaaaatgacataatagtgtaagatag

SEQ ID NO: 33443 - DNA, 160 bp, Oryza sativa
agtttatgtgaaatttaccatattacgtaatttacatttgataccatattcactccgcctttcattcctaccttgtctcaatctttaattgtacctatattgacattaaatcttttatactttgccgccttatgtacatgtactgtgcacttgtaacagg

SEQ ID NO: 33444 - DNA, 1501 bp, Oryza sativa
aaagttagctgccggcaaccgcatcatgcgcgtaaccacctctcctccccattcccttgcttccatccttacggagagcaagtttaattgtaaagtcaactgctagctataaacttatattagagctaacatgtgtaatagattagcaataaaattgtttctatttttcttcttacatatttactttagagcatgtgtagagctagctcttacatgagagctagcaatcatcatttttcaatttatctctctttcacataagtttatagttagcttatagctcactattaattaaacctgtgaggaatgaggagcctcgccaacaccccgtggttctcaaatgtacatgcaaaggcagagatatcttatgcctaccttctgcagcccgtcctcctccattagtccatccctttctactaataatcaatatatagtatataatataataagtagagataaatgtaatagtttttttaggaagataaatatattggttcacatgatcgtatgatttggagttttggacacgattgtgtggttccggcttagggtgggtaattcacgagtatgcaagttgtggcgctacaatccagccgtatgtatggtagttgtgtcgtcgtctactcaggggctcagggcccatgggctgcaacccgccgcttctcgcactgtgtggctgttcgcggccaaaaatagcaaggaacatgtgccaaactggcaacaagagtctttttgtcatgtccacatagggcctgtttagatccatttagaatgacaaataacaaataataaaagttttggttagcgttgtaaaagtactagtcggtgtttaaatgcatcttaaagttttaccattttagcactaaagaaagagaaagagagagggtgtggtcccgaagcactttttggcaaaatttgctactatggactaccaaatgccaaatgccaaatgctaaattgccaacttttgctactagtgtttagatctaaaatagcaaaaagtgctttaaaatggcaaaacttttgttattttggagggccctgtgtgtacagtggcgggggcatgggacgaccagtggcctggccccctttaataatttttatacataattatctaattacaatcaattagataatcaacttaagaaatagtgcattagctctcttcaatactgttagccccctcccattttaaatcctggcttcgtcgctactacttgcttgcgtgtgtgccgcccatcggtccatgtactaaagcaacggactcttaaattcaaacatgtacttctacacctcatttcctattatccaaacataccctgagtgacctaagaccctgcataacttgtgccaaatgaaagtaagtcagatgatggctagggatggcaacgggccaggtcaggcacgggtagagcaaaaccatgcctgacctggcaccgacaatgtcacggttacgggttagacataccctttacccttcgatatacgtcacatatcggtt

SEQ ID NO: 33445 - DNA, 1501 bp, Oryza sativa
tctccatccataattgacaaaaagttgcataaccgtcgtcttaagcttacgacatgcagcttttaaaagctcaccgtcttcatcacacctttgtagttatgcctaaaaccggagccaataggttgccctgaaaattatctgcatacatatggtgatttgtcaaaaaaaaccatatcattcctacacaatcacagagcccaacaaattgcaaagctcccaccaatattaatttactcttttttttctccacccccagcagccacccatcgaaaatatgagatatgtctattattactaactataatgttgacgtagatataaaaatcgaggctccttcaaagttcaaaccaaatccactcgtatgatgtaggagtattagtactaccaggttggcgcatacgccagtgttacggcacggtcgtagcctcgtttaacacgtgccagcgccggcggccgtttttttcatgctgccgtagcacgcaggaaggggaaggaaggaagggaggaagggacgacgagagcgctgaccgagctagctttctgctcttcctatttatcttaaaataaatttatatttagcggttattgaatcggagtttataaaagtaaggtaaaaatgtattggggatagataatcagagaaatgattacattgaaatttgataaaataagaatgtttttaatatttttggttttgtatttttatgtgtaagatgggtgaaaaatgaacatattttatgtctgagagagttgtgttacatatcactatcagtgctaagcttgttttatgtctcatgcaaaacatacattggggatagataatcagagaaatgactacattgaaatttgataaaataagaatgtttttaatatttttgttttgtattttatgtgtaagatggtgaaaaatgaacatattttatgactgagagagttgtgttacatatcactatcagtgctagcttgtttcatgtctcatgcaaaacatgtgtggccgcccaccgttgcatggtcatggagtggatgagaactgaatagaaagtgttggcacagcgctattagtctaggaggtttcggggtgtttagtgtttatgctttatactcgtgatctaaccattgtattatttcttcgtttagacattttgtgctagctttgataagaggttttactctaaactagcaaaataattgtgacttgcaatggatttcaaaaaaaaaatcttaagtttcttaacttagaaatgataattgtgtccgaaaaaatatagcaaacaaacataaaaaaaaaaaccaagccacacacacaaagatatatttatctttgaatatggccactctaagtaacggtagattcactatcaccaatgtatgtacttctatatagtacagacattatgtagaccgaccttatatttggaatcagaagatgacgtgcttgaatgcttttaggggttttgtacatattttttccctgagcaatcaaatttatggctattgtgca

SEQ ID NO: 33446 - DNA, 157 bp, Oryza sativa
  unsure (1)..(157): unsure at all n locations
ggaatagcgtcaggtacggtgttggctcccgagccctcccgcgtcggatggctcgccggcggtggctcccgaaccctcccgcgcgnatggtgtcaaggaaggcgncgncggttcccgagccctctctcgcggatggcgtcgaggacgaaggtggcga

SEQ ID NO: 33447 - DNA, 586 bp, Oryza sativa
ttcgcttaaattttcttcacatatacgactgtaaagtttgttgatccacggcattttctatgtttacacattacgccgtgtcctacaccatggtacggaactacggtgtgaactactgttgctttctccggtccgtctctcttgcctgccactggagtctacacaactagccatggagtagcattgatgccatgaaaggctagctgaaagcaacacgatgcacttgctaagatacgtcgtcttcctcacggttcggacgtctgatggtcgatctccgacccgcggacatcatgctcatgctttctgaactgcttgcgcatccgtatcaaacagcttcttttcatcacaacgaagatatgtctcatcatccgggttaagcaaccgatcgatcgccttacaacgtactacgtgcccaaacatgaatgagttagatatattgtttcatctcaattttcgcaagattcggtcaataggaacaccttaattacaccggctatttttacatttcaccactaatcatgcatctctattcagaatttcagagcatggaagtaaaaagtactgaactaagtagagaaactaatta

SEQ ID NO: 33448 - DNA, 539 bp, Oryza sativa
aaccaaccaattggtaatactcagtgtgattgatatattgaatctaactaagacaacaaagcaatctaagaaagaatcgatagatcacataggcaacacaagtaaaagcttaactagtatatcgcacttaaccaagaaagtactaattccgccaatacaagcgaagttgatgatacttactttctcgctagagatcaaaactaatgcagcccaaacttgaaaacaaaaactcatcgaaactagaaagttgtatattgaaccgttgttaaattaaaaggaccttaggtgtacatatttatacccataggttagatcaagtccaattctactacagttagatcagcttaggactctatcccaaataaggaaactacatgatacaattccgactcagacatgactctgatcggcaaactagctaagtccgaatccaacacgagtccatcagctcataactctgtccatagaaaatagaaaccaaaataaacgttccttataacggaacgagataaatttaccaaccaaatctacgaaaatca

SEQ ID NO: 33449 - DNA, 298 bp, Oryza sativa
agaaaaatcaggcttcctgacactccccaacatgcaagattgtatcaagctagtttgtttctcttttatttctcctaactttaaatattttttttccaaactacttatccgatctacgatacggtaccattgtattgattgtaattaaatctttatagcaagatatcacgtgattatattctcatacctgataacgatatgtttcaagatgtgtcttctgtatgtttcacaaaattcacataaactctatctcctctctctccacttcattcatgcatgcatttaactatcttcaaaa

SEQ ID NO: 33450 - DNA, 1328 bp, Oryza sativa
aaccaaccaattggtaatactcagtgtgattgatatattgaatctaactaagacaacaaagcaatctaagaaagaatcgatagatcacataggcaacacaagtaaaagcttaactagtatatcgcacttaaccaagaaagtactaattccgccaatacaagcgaagttgatgatacttactttctcgctagagatcaaaactaatgcagcccaaacttgaaaacaaaaactcatcgaaactagaaagttgtatattgaaccgttgttaaattaaaaggaccttaggtgtacatatttatacccataggttagatcaagtccaattctactacagttagatcagcttaggactctatcccaaataaggaaactacatgatacaattccgactcagacatgactctgatcggcaaactagctaagtccgaatccaacacgagtccatcagctcataactctgtccatagaaaatagaaaccaaaataaacgttccttataacggaacgagataaatttaccaaccaaatctacgaaaatcatggtgttaattctctattttgattcagtattggctaacgaaaatggccaaatttcaccgttaacaccactgttggctggccgcacctacctctggcttcgacaacatcgacgcgttgaaagttactttcctcagcttcaggggcacgtgtgtgtaacccttttgtatcctcggcctttagctgggacgagatcggatctaagcaacacaattaaatatctcgtgtactggtctactaggcatcgggtgctcctgcttgaagatgctacgacattattgtggtgccgcctttggtgccttgtctacatggtaggaatggacaccaacaatgagaaagaactaaggaaggatggcaaggaagcattgatggccactgcgtacaaaggtttgatatggggagtgggtatcaaacgagtaggtcaagaggaagggcagaaggtcgcccaatattcaacataaggtaaaagatcatagtttaaagtgaaaatattatgtatgacttggttcacgataagattttagttatagtccaaagtacaatttactcaaataacattgactggcattcttggtgtttcgtggtcaggagtacgaaacaacgtgataacattggcaatgaggtattggatgtcaatgccaagatctttctgtgttgaggtatatgtccattttgtttttgttagagtttgtttttatcgagatctatttcgaaaacaactttcttaagaaagaaaagagcagtgtcccctagaaatttgagtgatgtggtcaggtcagagcgcgcaaagcc

SEQ ID NO: 33451 - DNA, 812 bp, Oryza sativa
ctctctagtgtcaaaatgcaatagtgtgacatattagatggagaacaatgtacttaagaatcgctactcttcagcaaagctccctcatcatttcccatcatttggcatatttttctcagataatcgtctactgaaaattacaaagcaatatttgactagaaaaccgacagctgttgcctctgatgacaaaaagtaattatatactccctccttcccaaaatgatcatcatactccctccatcccataatataaggtgtgcacgtatttcaagattcaacctttaaaacatttgaccaacatttaatataatatgaaatgaattttatttgttaaaaattatatcattagattgacatttaaatttactttcatatgattataattttgttgctacaaaccttatagcatatgagaaattataagttaaagattagttttggagaccgtgtaacttttaccatgcgttatattatgggatggagggagtatatgtttatgcaccaagaccaaggataatttaaatcacatcaatcaagacaaccatgcacacattctcccacaatgcatgcatcgatcaaaacaccatgccaattacaccttagcatgcacacattctctcatgctgcattaattgtattatgatgaaatccatgtccatgcggttatatgatgatcaatttgagaaattttgaagtccattagatgatgatcaatttgggaaggagggagtaaatgatagtaaaaaaagacaaagcaaagcataagatgatgctaacagaaactgcatgaattgtcactaaatattggcaga

SEQ ID NO: 33452 - DNA, 1501 bp, Oryza sativa
aatagtgtaggatttcaattcctttctttttcctatatttttcctccaattcaaaggaggcctgaacaagacgcatggtacatttatcgtcgatccattgcaattctcgctgcatacaaaatgattaacttaaacatatgccataactacaagattaaatcaaaattaataggtgccaagaatttatcgtcatatcaccaccaccaaataataaattaaattcatatacatatgtcacttactttcaaaagaaccatgtataatctctaattacattactgtttggtgcaggtcatgtcgaaaatttatattactctcatattaataggagacccatatttatcaaagcatattaccttcccaaaattaaaaaaaaccaacaaaaatatatcacatacttataaaacttagtgtataatttctaaattactctaaattaataggtaacctagatttatcaaaaacatatgacagctgcacgtagtgaattggtatcctatagtagtcttggacagaaagaagggcaaaaacacaatcgaagaaaaaaaggggtcatttttttatctcctatcagccattcaaaatgctttcaaagatgcaaaacaaggtgcctattagaaaaatggataatggacgaacaacttatagtatgtgaaaacatgtttagcaactaaaattaaataatggaagaacatattcctgtatggaccagtcattgaaaacttatttgtcaactaggagagtgacaaagggctccgtgaagtgagcgtaacttaattggttaagtttcttatggtgaaaccagtccatctgggtttaaattctaggcttgacacatgtgctcatatttacggctaattgttttttttaatggtacacgacgtatccctcaacaacgaggcacccgtagtgacttcatcgacatcaagatatgacaacctagtcttccagagatgttcataagaataatgtgtgcatgtgtaagacgtatccctcgacaacgagacgcccgcagtggcttcgtcaatattaaaatatgacagcctaatcttctggagatgctgataaggataaggtgtgcgtgtgtacatttataagggtgagtgtgcgtgtgttagaatagtttgtgtatatattgtgtctagttttttttaagaaaaaagctctgtagaaaaccgcagaatctggtgccactgttttctttctgttttgaatggtaaccagcaataatgtaagccgtccttctccgcttaaacggctatcgtcatttctaattaatctcaattgatcggtgaagattcggtgggaatctttatgattacatccaagtatttaggtttcttttctttcttaagaagccaccccacatgtttgaactttggatttaagggcatcaggatcaacttaggcgcacatatttattttcccttttgaggcgaaaaggtgggagctctccctaaagatatatgttagtaagaaggaatgacactttagtttttat

SEQ ID NO: 33453 - DNA, 729 bp, Oryza sativa
aatgttccaccggtccaggcaattgtatcgtctacgtcggcgtcgttcaaggctgcatcatacattcgacctcttggattactctggtttggataatatatttgcctggctatttatcatatgtctatgttaatctagtcttagcatctcaatttagctctatcggctgcttctcgctttagggtttatgccggtatcggctaaatcgtcatgctagattagattaacttatacatctaccaccctgaaaactcagtcaacggcttgattgtctagatattatgtttctttttcatacttagtgctgtatcagttaagtttgatctactaagtcgtgcttagaaccataatctctagcctgcttcttgaatgccaataagggtttcatcggggtttcagccggtgagttatctggacgttgcatcggctcataaggattgcatatatatatatatatatatatatatatatatatataagttggatttagcagatgacaacaaaggtttcactgtttaatctaatctttgtggatttcatgacatcgtacctccagccgatgtgtgctttaactttcggatcgatgcttatttatcatatcattatttaccgattaatttatactggattatattgttattttattacaccatcatcagccgattgcctttatatcatcatctacattggacatatagccgattgcttaaaccctatcgctatcggctg

SEQ ID NO: 33454 - DNA, 1501 bp, Oryza sativa
agttatgttaattatttagtacacttaaaaaggctaggatttttgcggcgcgtaaacgaaacaagctattgttatagttaattaagtattaattactgtaaacataaaaataaacttatttgatttttcttaaaaaagaaacgtatgtataaaagacttttacataaatacattgctgggtagtttgagaatgtgttcgcatgatatagcgaagcactggctcggtcgaaccgccaaagacagggcattaattaggtggtcaatacaagtactccttccataaaaaaaaaacctaacctcattctaaaatgtgcagcgaattaaacatactctatgtccagatttattatactataattgtcacatcttagtattaggttgtcttttttttaaggatggatggagtagagcaatagcaatagtcccagtacactaagtacactcatcgatcaaagctcttattttcctcattttttttcttaattatagtcggtgcattgcataagcataataacgctcaacagtatctgccgcctaaccgcgtgcgttaatcatacgtacacagacccagtttggtttgatcctctatcaaaatttccgtagtgtcaattattgggtaagtttgacgcaatcaaataaaaattagttggtggagttgataagatgtgtcgaaaatatttcgagaggatagaacttaggctagctaaaaattatcaaatataaatgcatgacaattacattgtactctttcagttttaggttataaaatattttgactttagtagtcaaaattaaactgattcaagtttgacaaagtttataaacaaaattagtaatatttttaacccaagataaatttattataaaaataaaattaattattaatttaataaaactaatttgttaatgtaaatattactgcatttgtctataaaattagttaaatttaaagtagtttgactttgaccaaaatcaaagcatcttataacctgaaacggagagagtaatttgcactacaatgcaatttgtatgtagttttcaaaactcctatgataacacgctattttcgtgaagcgaaggctgtgagatagaatctcctcacctgtacgcgcactatgattgttttcttctcccaacatgcacaaatcttgaagtaaatgtaatgatttgaaattatgcagaagttacgtccaagttacaatataattatattgcaattgtactatatttgtatttaatacttttaaataaatttatcgataaatatatagagaggaaatagcaaaactatattttgatactgtagaaaaataaactgaccagtggcagtagtgacaagaaaaaaaccgtggcccattttctaaaccaatttctggccgaagatgccggcccactgtctcaatcgggcccttctcatgtaggccttctcctccgccatgaacagggccccgtcaaggcccatgtggccacagacgaaatagcaaaagtctcctcgcaaaga

SEQ ID NO: 33455 - DNA, 257 bp, Oryza sativa
agacacgatataatgctactgcaacatagtgtgcgctataccacaacacgagtccatcaaatccacaagccattaataagtatcgaagagttgcagctggtcacatacaaaatgaccagaaaagcacacttgcagcacatataatccgatcttgttacagcacaggatgaacactaactctcggacaagtctgaacattgtcgatcccataaccagcacagatgactcaagaaaaatggctcaaatcgcttaccagc

SEQ ID NO: 33456 - DNA, 357 bp, Oryza sativa
  unsure (1)..(357): unsure at all n locations
cttgaattgcaaaacctatnnnnnnnnnnnnnnnnnnnnnnnnnnnnnnnnnnnnnnnnnnnnnnnnnnnnnnnnnctaatgtgcattgccctcaagcacattatgaagcacattatgaagggctgtaacagcgcctactaatgtgcttgagggcaatgcatcaactacctgagtgggtaaagcctatttattgcgacaatcattgctcattcacctaccgttgctactaaataccacttttaacgctgtacattaaagaatcttgcgctagatcaagatccatgaatactggcaaacacttgcactgatgggcaatactatctgctgctgatatggtgtattaccggctccatcaa

SEQ ID NO: 33457 - DNA, 1003 bp, Oryza sativa
taagtagttaggcggcagatactgttgaatattattacgcttatgcaatgcaccgactatatataatccagaaatttctactatatagtcggtgggtgtctgaccataaaaaggtctataattctcctatgtgctactgtgtactagttctagtactactatactatacttgtataattgtattggcatgcaattaagatatctaagtacttgtatagttgtagtagtaacagtagagtgcactctgaatgtacaccacctttattccaagcagatgattacactggcaatatatagtaccggccttttttcgaaattcaatctccacgcagttaattttattttaaaagaatatcgccctgatattagtatgcattttatccgttgaaggctcaaatctaagtggaaactgacattgggttttaaatattgtcttttataagaaattatatatgaggtagtgttttccttatgacatgagagatgtacccacatagatacacaccagacccaccagtagtgcaccgaacacatacctagagagatgaaggccgacaacaaatctctcttacctaaatttttgattgaaaacgaaggcgtgttcatatgtgcataatatttttaggtatcagaagtttaataataaaagcaaacaggggtaagtattgttaagtacacggggtcgaaattcacggagctgtcaccggctggagaatcgcgcatggggattagccggctgtcgtccaggcgaggcggaaaaccgatgtgatgagtacaccagcatgcagcaaatggctaatggacagcaagtaaaaactacagcccaagttaatgaatgaatgaaacatctcgagaattctcgatatgtatggccgtgtctagtttccccctattcctaactttccatcacatcatatcacatcaaaaacttttttacacacataaacttttaactttttttttcaaactcctaactttcttcaaacttctaacgtttttcagg

SEQ ID NO: 33458 - DNA, 422 bp, Oryza sativa
tttgtgcttcaagccgatagactagcaaaaaaggaggacaatgcttcatcatgttactgtcacaaaacctatcacgattctctacgtgaaaattgcatacaatgtcaaacaaaggtagaaatgcattagacactacaactgagataaatagcctacattccacacattttacttgtctgtagtcacttcattcttcttaatttatagttcatttgactcaaaagtgtgtgctgtactgtccatagtcatgacaatggcaaaaaaacaatacactataagtaaagctagtgaacaaactttactatttctccactcaaaacaagtttttaatcattgatttggtctctttcaatcaactaatgcaacaccatataaaaattaatattatttttaagacctacttgcatctgatcaagccacaa

SEQ ID NO: 33459 - DNA, 1501 bp, Oryza sativa
cggctctctctctcctcccctcccgcgtgccttgggccgccttgggccgccttgggccggccggcccatttagctcggccgagccgccccatttctctcgggccgcgccctagccgcccgaggaaagtctaatttccctccctcttttcttttcttttcttttctttttcaaaaaggatttaattaaatccttttcctttagaccaaaaatccaataatcttagaaattcaatatcttcccaaccgtaaatccgattgactccgttcaacttccaaaattcctcaaatctcgagatctatctaatggcacgcttagaggttattaatagggctttattttcgccgtttgttgagttgtcccatttcgcgtgtagtttcggagcccgaagacccgcagtgcgaggatttcgaggatcaagctccagatctcgagcaaggcaagccacctttgaacatcttgagcctatatttgaatttaattatgttgcttgaaaaatattatgcattgataggatcgcacttaatctgttgtcccgtctgcaaggcagattggcagacctacctaattcgttgcatttgacccttcctttgttaattgttatatcatgtccccttgtaaccatctagttgcgcctcgatattcgtgcaccctgtgcgagtatcgacggtcgccttcaaacttaaaatctgagtaatttcttgggtaaaacttgggttttacaaaagacttggaaaacccgacactgggtcggtgcttgcgaactaaatgaatttccaaaaccgcggaccggggaacgtaccgggtgtacggtttcccgctcttgcacctaaggaccgtttccttggaatttcatccaaacataagacaagtacgaccacatgggtggaatgggacacccctggctgagtaactagcttatcagggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatcccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggttcgatgtttgaaaaatctgcagctgatgggatcagctaggcccgggtggccgtttgaaagttgttggcccgggtggccgtttgaaaagctatcggccgggtgccaaccttgtttcaattctaaagactgatacattgcacatactccgaccggacgagacgcactgtctcatccgtgtcgtttgagaagcactcacttagttgttttt

SEQ ID NO: 33460 - DNA, 1501 bp, Oryza sativa
aaagaaagagctaattgcacatctaaccgtgtgatgtgtggtcttcatttgtttggatgttggtttctctacactttgccctgcaaccggcagtctgagatgtgagactgtaatttttgaggtgatcgatcaatcaatgctttagtgccaacggcgcagcacatagcagatggcaagagaagcaaacgtttgattgatgattcttgcataaggtggcctgcccctttggtatgagtcgttcgtttggatttgtaaccagaggctctgcctcacgcctactgttatggtggattggcaaaccggccacaatatgctgatttagagataataaagtccttgaacatgtgtagctacttggttgattgatgtcatcccggagatttgcagacgcatcgtgcattgcatgcatgatgatcaattttattcaattggctgcctccataataccagtagtaacaaacaggaaaacaggacgcacatacatatacatggcagggcacacgaagcagcggctagcaggcagatgagaagaggggttggaatgagatacagtagatacagtagagtccgtgtttatcactcgctcatctcatcggtgctgcaaagcgttaatacattgtatgaggaggagtgtttatggggaatccattgtcgagccacgctgcgtagcctcctcccatgttcttcacgttcttgaacccctgttgcagatacatatatactgtatgtcagtcatgttacaactcactcgtactctccctccgttccataaaaaaccaatctattctataaaaaatcaatctaaaactggatgtgaaacattttaatattatgaatctgaatatatcgttgttcagattcgttatactacaatatgttacatccagttatatattcatttttttagacgaggagtatgaatcatgacctgtcccgtcttcctttactttatttgtttcactgtatgtatattaagggagtgtttagattcaaatgtgtaaagttttggcgtgtcacatcgggtattataaaaggtatcgcatgggtgtttgggcactaataaaaaaactaattatagaatacgtcagtaaaccgtgagacgaatttagcctatttaacccatcattagcaaatgtttattgtagcccacattgtgaaatcatggagaaattaagtttaaaagatttgtctcgcaaattagtcacaatctgcgtaattagttgtttttttagcctatatttaatcatgtatgtatgtgttcaaatgttctatgtgatatggtgtaattttttttttgtgtgtgggaagtaaacagggaacaagagacagagccatcaacaaggcaatgagaaacgtagagagagatgatggtcgatcaagtacaagtgcaactagtacgtgtttgattaaaaacatcaaacttactgcttcaaggagatcaacgcatgctagctccgacctcttcccgctttggcacccctaatagttggattgtttattt

SEQ ID NO: 33461 - DNA, 1501 bp, Oryza sativa
gtgaagataaattacatagaccccgggtgtacatatttatacccatggattgatacaaatccttgtcggacaagaaagaaactttcctaaagataaaaggaaaagataaagtccttatagaacactaaacacactttcctaaagataaaaggaaactaataaactattcctaattaatagataacttgtcgtgccgtattctctttgaactcggtctcttctggataagcttcctttagtagatcaatttccttaactgaatatagcaagaattcgacaactgacgacttggcaactctcatcggctaatctcaggacttcgaagacgatgctgactctaagccgatgattactccgggcttaccaaatttcactgttaacaaatatacatcccacgacagtataattgatggttttgtccgacgtgacaatttaacctgagtcaacagcgtgtgagttagtgtgggacccgtattcagggctctcttcacctctctctctctcttcctccccttgttcacatctcattggccagcacggtccagttgttggggggacttggagctggaggaggccgactatgacgtcaagggtggtggtggtaggctcacatgtgatgggcagagggggtggcatgttcatcggtagaggtggggatggcagcaccagcgttagggttagcatcggtggaggtggtgaaagcgtcactagagaagaccaatggtgaggaggacgacaattgacatccatggaccgttgcgccctgtcccgacgcccgctgccaccactgcttgcctactaggtcacctcgctccaggcctccagcagctcctccttcgcccgtcctcattctcgctgctcctcatcgctggtgagctcccttcatcctcctccttcgtgtggctgatgtaacggcgatgcgaatatggggttgcaccattgcgtcggagggagatggtgacaagacgagccaacgacgacaatgtcagttgcaaggaagatgtcgacaccactgtcgcgggccttggtctccctttgctcctcatcggctatcactactaccacctcgtcgtgtcccgcctctaccaccgctagctacctctatcctacagccgttggaaacgaaagatagggaagaggggctgtgccaatgccgatgttcatcccccaccctcccaacaggtatccttaaccctgcttcatcattgatggtattggagtattagactaggaaaaggaagggggaaagggtagagagaaagagagaataacgggtgaggggagccctgacatgttgggcgcacgctgacttagattgcaacggcggacaaaaccacccgatatactgtcgtgggacctatattgtaccgattttgataattgagggacccgttgtatctgattttttttttgttcaaggataaaatcgaacgcgctgtcaagttaaaggaccttaaatgaacttattcgtagatagatagatagatagatagatgggcca

SEQ ID NO: 33462 - DNA, 1501 bp, Oryza sativa
aatccaggaaacaagtttgattaaattgtctaacattatacataatattttcgagcattgctccggtccagcatattgtacctcgaggtaccaatttaaatctggccgttcattcacggagggtaagatagaaaatatcacacgctaagcagctcgtgatgctccttctctctgactgagtgactgtgtcaacgaagactccaagagcaactgagcaagtccaaaccaagagcaagggcgtggtgggagcgggacgaggggtggtcggcgccggtggtgccggaggcgttggcggcggggtgttggacggcggcgcgttgggcgccggcggtgtctgcacggcggcgaggtaacgaggagcaggaggggtggtcggcgccggtggtgttggacagcggcgcctgcgtcggaggctgctacgcggcggcggaggcgacgaggacctgcgtcagttgtcgatgtgctcgaatccggtagcgataggggaagggccgcggtaggcgtatgtcaccggcgagcttgggggaagtgatgcacggaggctcgtcggccccctccacctccactccggttagcctgtccatccctggtgagagccatcgatcaatgcaggcatgcagcatcttttggagagagaaaagacaggaggaagatgaagaagatacatgcgaaattacttaactacccttgcttctttagtacctctctatgctctgtaaaatcacgtggacaatactactaggtacaactctttctcacccgttggatcaaacgaaatcgatggctcaaattgcatgtaccggtaggtaccaaggtacctgctggacagtaaaaattatcaatattttcatgtgttccaactcttaatgtatgatgctatcacataaacaacatgtcttttataccggtttgggtggcgtagtacctacgtaatttatgctaaaatctatgtgattttagaaatgacatttcaattcatctatttattagcgggagttggggatatgcccccatcaccttttttttatgtctttcttcttactttaagatttttttttactatgtacccattggtagaactagagatgtaatccatttctattaaactttaattaaattagagtgacttcttcaataaaggatctttatcaggaggggacgatctcaagtagctgccttttttttttctttttaagagaacgctataaaattgatcatatattgaaggacgaaacaaataatccacgataatataatcagataattaaaaggatcagatggacagagggagagagccaaacatagaggggcgggttaatcaggaggtaagaacaagtggagaagacaaggataagagatgagaagagcaatgagctatgtatcaataaaataattgatgacctggcagcttagcttaattagtgcagctggaactgataggcgcgcgattgatagcttataaatcgaaggagggggaaggcctcatctccgtgcatctcgc

SEQ ID NO: 33463 - DNA, 1501 bp, Oryza sativa
tagtaggcgtgatcatttgaattcgaactaagagaattcacctttgtgactttacacgtccgattaacatcaatgaccttgacgtcaaaaccctgtaaagtgcacaagatttgtaactaggtaataccaataacaacaagtgaaagcaatgtaaccacaggatagggtgctggccaatccaatgaaagctcggagatgaacatcacttactttcctgtacataggtctcctcttatgctccgtgagggagttgcgctcttcaacaagatccttaatttcctcctctagaactctgcccttcttaccaaacgtatgatctaactcagctaatttctcctcgatcttcttttcgatagaattcaacttctctatgagcagatcatccttctccttgtcttcattgaattcctcgtcgtcgtcgtcgtcaccagccccttggatcatctgcttctccctgtcaaagccagcattgagcacaagatcctccggagagccgacctgctggtgttggatgaccccgaaattggaggggttgctgggatcgtatgcttccctgcattccatgattctaacagctcggttaagcttctggaggagaagaaagcggtccttgccggtggcatctttgaggcggttcatcatgtcgccgatgactctgtactccagtggaagcttcaaatggcgctcctcgaatctgtcgatcttggtcatccatttgtgggcatcgtcaagggtttctggcaacagcgggaggtgtttgaagtgggcattggcgaaggaaggaaggaaggaaggaagaggggaatgggctttaccggcttcggcgaaggagcgtaggagttcggagtggcggttgcacttgcgctcgaactcgtcgacgcggcgcttgatggcgtcaggggtgtagcgctcgtcctcctcgtcactgtcggagtcggtgggctcccagaaggaatcgtccggcgcggcctcctccttggccctgcggcgctcgagcttctcgatgagcggcttgacgcccaggtagtcctcatcctcaccctcatcctcatcctcctcctggcggtcccgctggcgctctcgctggagctcggcgaagaggtcgtggatgacccgctcgctctggatctgcttgagcctagagctgccggaggaggcgttggcggagaaggcgaagtggcggcgaggggaggcgatccgcagggttagatggtgggtggaggatacgggagggctggggcgcagggagaggaggcgcgcccacgcggcggaggcggcggcgcgggaccgggcggcggcggaggaggccatgaacctcccggcggcggaggaggagaagggttttggtagccaagtgactactggaccttccggactatactgacttgtgtgtcggcctgcccccatctacatttcttagtggcccatctatctatctatctatctatctacgaataagttcatttaaggtcctttaacttgacagcgcgttcgattttat

SEQ ID NO: 33464 - DNA, 1501 bp, Oryza sativa
atatatcgccgctcgattgattcatttcatcgttggtatacattatatatttatatggttgtgtgttactaccacgctaatgaaaacggaccatatatatgttcttgagtgttcttcaactttcacggggttaattattaatcaatttattaccacggtcagatcataacctcatcgctgcctgctagtcttgtgcgtactagcagcacaaatccagtactggtttgacaaaaaatggtaggatcaaatatgtcagacattacagcttgcgtgcatgtggtgtagtagctcttctgttctttactccagttcagagagaatcaaattcgctagctggagtactatttccgtaacttggatggagcttcaacttcgctagatagtaacaatgggaggttaaatttctacttgactaatttaatttagtgactatagcaaatgataactattactgttgttttgtttgttataatttgcctttagcggctgaggaataaacacaacttggaactaccagtttatactttgcatacatctgctgttaattgcatgcacctgcagatcgatctactcccataagcagatttatagctcttggaactttggaagaatggtagttgggtgacataatgctactagatgcatgggcacggccaacatgccctgatcagggatatggccggggtcttttggctcatagcatcatactattacacctagctagagattcctagttagctagaaaatgacaagttgattattcgtgtggtccttttatatatctctgctacttaaaaatatggttgttctcttttcaaaccatcgcgtgtaatgtcagaaaaccccgtagaaaaaactgaatcggcccacctcccatcatacacaatttttccccagctaaaaattaactagctagaaaaactcgatagaaaaaataaaccctatataaaactattattccttgaaatcccattgcaacgcatgggcatagcgctagtgagtttggaaaattggtgagattttcctattgccatcatatcttgaaacgactcttcaaattaataaaataataaaatggcgtcactgttaatgttatatgtgcataaattccttttgctcttaatttgattttaattgtggcatttctctaatgtcctagttaaaccattttttccaaaaaagaaaaaaaaacctaagccctcatttcttccgtgcgatctaaatagttataagagatccttcaaaaaattagaaaaataaatattgtattgggtgtcttagcctataaaaacatgcataatcaaactcgtctatatgtacggacgaactaaaacaacaatccaactactttggtgccattggaattgttattttgtttctgcgtgtgtggattaaatttgaatttacatgttagtacatggatgtatatgacatgattatgtatttcaattcatttttaaatttatttggaccatgtatatgtgaaagcgtaagattagga

SEQ ID NO: 33465 - DNA, 1501 bp, Oryza sativa
ctgtaggctgcagcacaaccaaaaaaggactgctaaagacctgagacaagctcaagcagtcaagctgattataaaattcgtcccatttgcgtatggatatcgcataggcctccattcatgaagacaacttcaaactactaacttctaaagtcagaagatgaaccagtgttagcctcttagagcatctccaacaggtacccaaaccaaattccctatagtcaattttttgggaattcatttagattggcaagtgatcaattctttcagattgctatatatttgttctcatacgtcgtgaaaaagaaatatatgcatgtgatctttgtggaaaaacattggcagcaatggttaatctttgtagaaaaacacatgaagcacagaaggaaaatgtgatttttgccgttagctgataggtgtgaaaaagaatatgcctgcaatctgttagctctgggatacagtcatacgtaatttgattttcgcacgagctgttagcttttgtttagagaatgtaatttttccttttaaaaaggggataagtttaagaacctgcaattttctgtgaaatgtgttcaagaggagtgattggaagttgctatgttgtgtgccattgtgaaggcttgtggaaccagtgatttttggtactatgttataaggtatctatatacatgtatgcagagaacaagtcattttaaacttgccaatagaagaagaatgaaccaatggaaacgagcaacaacaaatgcgaataaaacaaatgtcctgaacacaaacctgcgtacagaaccaccacggcgccgtggtgcattgtcaatgtcatattgatgttgtgctatgagtgctgctgccagaatgagttcatcatcatcatctgatgatgacgaatccaagagttgatgcataagaaagcctctcattgtgatgtgctagaggaagaaaaccatcatgaagagcaaatatgtagagataagaaaaatagccactcggaataaataatttgaagagtagattgcagagaaccccattttttgtggttaaagttccggaaaaccgcacatacttgcacacaaccacggatttttttaatggtacaaaggtttcatgaaaaacccaaatttattcaaatcacaattactactccattagcatatctgaaacaattatattgaaaggagtgaagaattaaaccaaacacacataggccccgttcgaaccaagatgaacttaagggcacacaaaacaagaaaaccattagtgtataattaattaagttttaattattacaaacttgagaaatatatatatttaatattttagagcaacttgaaactgcatcttaattagaaaaagaacgggttatagaggcaagcacgaccaatgaggacatagggaatggttctctttttgggaatctgttgattggagatgctcttgtgcatgcaagcatatcatcaaacaagttgtgcgcggtgcggccaccgactcactcaagcctacagaggcg

SEQ ID NO: 33466 - DNA, 397 bp, Oryza sativa
attcctgcagcccattgatcttgcgtgtcacattgaatatacgaacacatgtttaaaatattaaacgtagtctaataacaaaataaattacatattccgtctgtaaactgtgagacgaatttatcaagtctaattaatctattagcaaatgtttactgtagcactgtattgttaaatcgtggcgtaattaggcttaaaagatttgtcttgtaatttacacaaaatctatgtaattgctttttttctatatttaatattacatatttaatatttaatatgatagcgtgaaaagtttttacgtgggaactgtcttattttcgcgttttcggcgttgcgctggcgggggaggtttgaaatggtttcgaattctcgtggggtttcgcttctactgcagaca

SEQ ID NO: 33467 - DNA, 1501 bp, Oryza sativa
gtcatacagacattggcttgaaaagatgcattccaaacatttggagcaattgtagacaaaatgtgttccagtaaattattcatgggggacataaaggcttaaaatgaaggttccccagcccattctcactagtccatgactgcactgccaacattcgattttccccatatctttgtttctctgacagcaagatgccaatggtatagaaatcatattaagagcatctcgtaacaccacagttaaaatgttggcaccccataaccacagtttcctcatttgtaaactgcgccaggagacccaaacaggacttaaagcaagaactgaactctggaagatactgttgccatcaatatcgtgacacgtgcataatttccctgcaccctaaaggtatcataacacatactagtggcgccagtagttaatcatacttgactttaagaatcaatttgcacagatctcagtgccaaaagagtccatgaagtgttcgtcacgtatataccttgataattatacactataaattgtgatcatacaacacatcaagttcatgattgatatgacaatgttacatatagatatggtttctcaaacttgttaaacatgcttgcaatacatgataatagctaagctggaaaaattcccagcagggaataaaaaaaaaaggcaaattgcccatgtaaaaccagaatgtgaattagtccagttttaagaaagatgagtttgcatgtaaagaaaatcagcatgtgaattagaagttttaagaaagggtgagtttgcatgtaaagaaaatcggcatgtgaattagaagtttcaagcaaggacagtacaaaggacaaaatcatatattagatcaagccttctacattttcagctggcaagccagaattgcctacagcccagtacatctggacaaccttgcagatataccattcagacttcctacattgccaacataccacagaaaattacaaccttagcctgtttaccaatatattgatgttcaccaggaaaacaaaagagaggagggggagtgtcttgattaatagtggtaaacagggcaacatgcgaacatcataatattttggtggtatgttggtcaacatggaagcatgagtcatacatttgggaagttctccaaacatagtggtacatggacaattccaaattttcattgtgaatacttccttttggagaagaacgctaacatagtcaaagactgatcactgatgctaacaatccatagccggtgcaaatttgtactgttgttgaaacttatgttcttttctttaagccagtccacccttaggcttcatctggccaggctcctacatttctacatttttagcggaaattgcaagagaccagcatgtctggacaaccttgcagatataccactcagacttcctaaatttccaacataccactgaaactatagccaaagcctgtttgcccgagattcatgtagaataaggcactcatcgatgtcctgattcttgccaga

SEQ ID NO: 33468 - DNA, 230 bp, Oryza sativa
tactcctcctctctcaatcccctcggtcgcatgcaatacggagcagatgggggttaaaaaacgccattggcccaagtggtttcgctgcaacggttttgacttttatatgacagcggcggcgaaaacacgcgatggatggatgcgaccgagcccaaatgtgggagtggtagtcgtgaactacaagtggtgggcactagcttttattgacgagcaataatactttccatagg

SEQ ID NO: 33469 - DNA, 1501 bp, Oryza sativa
cgagagtggcccgatccgtgcggaggtcgtcagatccagtcggccgtccacgccgtccatcgcggtctgcccgtcaggcctcgccgcggctcgtcgtcatcgctctacccgccgccggcgcggcaattccatccaactcacgccacctgttagcagcagcaagccctccttgtcgtttggttcgtcctcaagcagcagaattttggtttctcatcttcaagcaagaagcaagcagcccgtgatccagcccgtcgctgccctctccgctgcccatcgtggtgcctggattcagcggctgttcgctccgcccgacgcatgcatgtcgctcgccgccggggctggggagctgagggtccaacgacacacagaaagagaggaagaagaagaatagagaaagagagattgaccataggcaaacttgtctttaaccaaagtttctctctccgtttccaccgaaaataataaaataatgcggccaatgtccgccagctaattaccacattttttaagtgaccacgagcaaatacacgatcttcgggtatctcacaataaagggtccaatctttcggtgtcctgtagcaaattttgccttagaacatacaagaaatacagaaaggcgtattatcatatgagaatgagcacaagtgtcatattctgaagggttttatttagtttgtcagactaactggtattgacacgactgataatatatcttgctaattgttatatgtatcaacgagatgcagagagagcaaacattgcagtcatttttgtgccatttgtagaagaaaacgagctgtactgggcctggatcagcagttggtatgaccaacaaagagcttggtcatggcgtatacttcacctgctaatgcagtgcacgaattgaacgaattgagaatagaattcagttattcagttaggtaacactgtaccaaatcatgcagtgcaaaactatgtgctaaaccgagagaaaaattcagacagagaaggacagaacattgtgcatgcataaagggctatccttttcacctaaaagcacaactagaatgttggatgaacaaactgaagaactagcagatatttcgatttacagcattcgcctaatgattctgttcacctagagtccacactagcagagccccagaacaaccaaacccttgtcacaacctttctgtgacccaccagcaaaaatatccttgcaagaacagtgcaaattccttgcaagaaatccagatttacctgaaacctctaaacaaacaacttaaaagctcactataagtagctcctccttgagcatcattccaaaccgccattgggagctgacgagccagtagtagccaatggcttccctcctgctgctgctgcgagcaatcgtcatcggcgtcgacgtcgaggagaggcagctcgtcagcggcgcgagggaggcggcggaggaggcggagaggtcttgttcgaagcatccggcgatgccccggcgatgcggcttcttctccgacaacga

SEQ ID NO: 33470 - DNA, 305 bp, Oryza sativa
tgaaaatggattttcattgaaatttgagaattatccagtactccaaaattacttgttgtgtttacatatgcaaagtcaaaactgtaagatgaagaaaaattactgcacctgatcgataatgagttctatattctttttccaggccagagcatcctcaatatcatacgcgcccatctgcgaattaaatctagtcatatatatactgatataacgctgaatgaaagagatcgagaacatgcagtcaggtttagttagaacaaaccgtgatctgatgctccttttctttcttattataaacgcacagg

SEQ ID NO: 33471 - DNA, 1501 bp, Oryza sativa
aatccttcatctatttctcaatcccaatcccacccccattttccattatccaaacacacactctggagatgatgcataattttttttcttataatttaacatataaaatggactatgctcatttctttctaatatcaaatccaaataaaaaaaaatgtcttggttcatagttcatataagctgagcagcaaatatctatactttgggaatgttttctctaaagtttgacttttgtcatgtccagaagataaaactacaaagtcgaaatttccttaaaaaaatgccttctttctaatctccactccagataaaaaatatatattggtttgtagttcacatatgtaaaaacaatggagtattgtttatttggacaaataagttttgtacaatttgagaatttcacaaatgttgaaaataaggcgagatgaaaaatacaacctcaaaataaaaaaaaagacacaacaactagagaatagtactgtgttaacttttctgaaaaggctacgagtaaaaaaaatacttcttccatccacaaaagttagacatatttcacatttgagtttttccaaataagttgtttctatttgtagtctttatgcatttaagacttaaataaatagataaattaaatatttgattagaacccaaagagtcatctaataaatactcattggttgcatgcttatattcactccttaattttgtagcatctaagataatttaatttctccttagtcttggtgacaaaagtaatattggtaacttttatgtatagagtgagtgtttgcaaaactagatttataacttccatatagttagactgaatgaattagtgtcgtttctgtctttcatgtaagtataataataaaaaaggaatgtttttcctttcataattaattgcgtgggaaattatttatttagcaaatagagcaaaaggaacaatataatgaaggaaattaagaagagaaggggaaaaagaaattaagagttaaatatataatgaatagtttgtaggtgtggcaattaagcgtgagtttcggtccgccaaccgcgcgctcttggtcgaccacaacgcatgctactctcagcctcagccaaccaattctgcaaaatgcattgatcgatcgatgttctctcctccctagctgcggacggacttggatccatccatctcccattcattcattcattcattcatgtggccatccatccaccatcttgcatgctagctagctaccctgcaggcccataacgacattattcaattcgaattaattccatcatcatataataatatatatgatgctgagctcgtcggcgtcgaggcgggaggtcggcggcggcggcgccgcctccagcaccaagagcggcgagctgtccctgtccaaggtggccagcgtggccatacgggagtcgtcgggctcgggctcgggcgggatttccaagagcagcgaattgctgtcgagggcaggaaccatggcggcggcgagggaggcggcgg

SEQ ID NO: 33472 - DNA, 483 bp, Oryza sativa
ctagctgatgttttattatcttcaatcttatattgtcacagttgggtacgatctatctagattttggttaataaccctaaattgttggtgattatattttaagttgtcatatccgatgttagtttattttcttcagatagagcaatgataagtcttaattgattattggcacatcggcatgcatctcgaagatatatatattttttagattcaattttgttactttcaatcttatattgtgtcggtttggtccggtctattaagattggctataataaagttagatgatttacaaatatattatatctaagtttcggtcaatgttgttatagcgatcgatccgaaattccatcggcatcggttgggcttacgataatatattggccctatggtcaattggccccacgatctaatcttttttttttctatcttattagttataggatcaaattaactagcatgtcctaaacccgatttgatagg

SEQ ID NO: 33473 - DNA, 1501 bp, Oryza sativa
acggtcaggcagcagaaggcgagatgcgcgaccgcgacgccggcgctgctacacgagtccgactgctgctgctggctcgccgtgaacgcaaagcagaagccgaggaggcggcagagcaagaacagatgctgcatcgaagaagaagctgcccccattggcttgccactgatccccgtgccctgactgctcttctccttcctcttcttcttcttcttcctcttcctctcgtgcctttcttgccatggcttagctcagagaaagcaccggccgtcgagctcctcgcgcgcggcagcggcggcggcggcggcggcggcggcgcggagtcctcctcctccaccggggtcgccgtgcagctcgccatggtgcttctcgatgaggagctgcgctacatcatggtccaccaaaccgtgcagctcgaccccacgggcatcttctccctgcgccgcctctcactcggctccatggacgacggcagcgccggaggatgacggcggcggcgccgggaggacgacgactgcggcgccgggtggacggcgacggcggcaccgggcggatggcgccgcgagcagggagggagcagcagacgggatggggaaagagggagagagaaaggagagagggtgtgggacccacaccgatggcaagccctctggctggccaactttggcaagtgtggtgaggaatttagccagccaaataacttagccatccaattagtaagtctgttggagcattttttttttctaagttagctaaattttgacttgaatagctatttggccatccagttggagatgcccttacggagggagtatagctcagtagtcatatcatacagaagcttggtgagggtgaaagcaattaaggtccatagatggaatttatgatcaatttatgtgatgcgtgcagatgtagatagatgcaacacatgcacgcagatgctgcagcctgcaggtcaggtccatcgatatcgtccaatggctctgctctggagtcgatctgactgatcgctggctggctagctagctggaacgaccttttatattgttattatggtcggaagattaacaacaatgaccagtatattataggcttaattagatctcctccctccatccaaaaactttaacttctagagtttaaattttatcacttcaataccatttacctgacattttagtcattcttcatctccattatttttgtcttgggatgttaggattggctttttttttacggagggagtatgtcagtgtaacttttacggttttaaaatatatcattactattcatttatctgaagtaataccattacaattttactgttatttgaaatatgccactacttacctcttcaatataatttctagaatttttacaccaaattatccttcttcctttttttctgtctctcctgttcatcttctctaccaactagatccctcggccactaagctgaatatcacagcagcaggccctactactccctccgtcctatgat

SEQ ID NO: 33474 - DNA, 1501 bp, Oryza sativa
gacgggggctgcaccgcgacgcagtccccggtccgggcgatttgaccggtcaaaaggcgtggccacgaaccaaaccccaaggcggcagcaggtgggccccacctgtctgtgggcgtgggccccgcgtcctgtggtggtggtgggtgctttgactgcacccctcccctccctcaggcggaaatcatttcggtttcggagagagagagagaggatttttttttccttcggcttatgtagtattgcgctgcgtcccgacaagcaaaagcaagaggaggaggccgcggctagcgagcgagcgagagagaggggagaagaagaggtgggacagccgggagatccatccctgtggagaggagggagggaggaaggaggcgttggaggaggagaggtgcgttgcggtttgttcgttcttgctgcttcgatttggtttgcttcttcttcttcttcttcttcttcttcttcttcttcttcttcttcttcttcttcttcttgtttgtggtttgaggcgattacaacgcgagttcgccgttctgcgagggcggtggctgatccgtctgctgggatctacgttttcttcgcggtttcggtggattttgcgggggtttcggggattcttgagacgtcggtgtgttgcggttgtgttcaaacctcccaagcgcgtggattctttttggggggtctctaatttgtgtcggcgattagtcaacgtggagcaattatacggatttccgagggattttctggtatttattgctgcaaatcgggcaagttcttggcttcggatggggcttggagtaaagatagatcatttacgccatagattcgtacccaaatgctcagttttttttattggtttgcactttccccttcgttagaggctcgtatgctcgcgcctgcctcatagcagatgcggatgagttcaaactcaagaatagatgcagaagagagcctgaatcaggaggagttcgtcaagaaacgtgaacagggtgcagggatccctattttggcttgattgaaggcggttttggagggggaaagttgcttagctgaacaacatttttgcgcatagcagcaaactgttgcttgtgttggagccgacggcaatgaaagaatgccttttttgtagctggttttggacataaagagtattttttatggttgctttcttgctaaaaatatggtgttttagtgcaagtcattcagtgtaaatctccaagcattcttatatacttgttccttttcctcctcctggatgagtcttggatgagtgcatttctctctgttcatctctttgctcttcacctgatgattgtttcatggtggatgcgtgttagatgcactgagttgcttagcatggtgaatcagtgctttgtgaactgcgtggttccactttttaactgatgtttgttattgacgatctcgcaggttgaccgatagatccattgcggagttgagtgttgatgcaaagctgattcgccatcgtttagctttttataagaga

SEQ ID NO: 33475 - DNA, 157 bp, Oryza sativa
ccgcctctggatcagcgcggggggtggccgcgcgccgcgcgccgcggatccgccgtggggtggccgccgctggatctgccgcagccatcacgcgccacctcgtcgtcgacgccgctgtcgtgccccaccacattttcgtcgccactgtcgccgtaga

SEQ ID NO: 33476 - DNA, 1501 bp, Oryza sativa
atttaactaagtttatagacaaatatagtaatatttacattaccaaattaattttattaaattaataattaaatataattttataataaatttatcttggataaaaaatattactattttttctataattttgatcaaacttgaagcggtttgacttcaaagggagggagtagcagtcatcgtccttgcaactgtattaggacacctggcccaagatcctacggacgaaagagtgaaagatcagagcccaaaaatagagaaaatctatcctacagtattccgtctcttcccttctttctgtgtctcttcccctccactcactctctctctctatcttcccctccactcgatccctctctctgtgactaccacccatgagcacggaggcggcgacgacggcggcggcaacgacggcaacggtgacgacggcggcggtgacgacggcggcggtgacgacagcggcgaagacggcggcggcggcaacgacggcgatgacaacgacgacggtgcaatcaccatcggcccccgcggacgacctggacgacagccggcggagctcctgaccatcacgggcgacgaccgccgttgagaagcctccccatcaagctcctcaaggcgctcctcctcttcgtcgttcttgtcggtagcttcctggccgatgccgccctcctcctcctcggcggcgctggcgcctcctacggtcggggagcggtggacgcggtcaccgggggcgagcgcttggcacaacatgagcgatgaggagctgctctaggcggcgtcgatggagccacgggttcggcggtttggagcgaggcacaacgacgagcgacggaatggcacaaggtaggcaccagatctatcgccttctcttcctcttcctccgccgccgccccgctgctcgacttccctgacccacgactcctcctcctcctcctcctctctcttgggatatcacgctgatacccaagtaccaaggcctgatacctagttatcagtcgatactcaggtaccaaggcctgatacctaggtatcagcttgacacccagggtaccaggtatcagtcgatacccaggtaccaaggcctgatacttagtattagctcgatacccagggtaccaggtatcagtcgatagtcgataccagggtaccagttgataccaatgtaccaggtaccacctcggtaccttacccaagatacgaggattggatatggtggaatcgcaggatagcgtgggcctccacacgaaattgatgaagcttattaaatctctcgggattttagttatcccgtgactgctaggagcaacggaataccgtggggtagcagccctccaaaaatatgcgcatgtgaagtagcaaaaccgaaaaaaaaaattggcaccatatttttttagcaaaactgtaccggagctgagcaccgttggatccaaatcaaccgtgggcagatgtactgctttacaacgggtggcactggtaaagccccacaggataacacacccga

SEQ ID NO: 33477 - DNA, 1501 bp, Oryza sativa
attagatcaatatgattttttaagtaactttcgtatataaatattttgtaaaaaacacaccgtttagtagtttgaaaagcgtgcgcatggaatacgaaggagaggagttgggaacacagagcaaataacacctaatttatcacacaattctccccgcaaaaaaattatcacgtaattctcacgcaccaatgcgcagggtacccatctagttaatattgaatccataacgtttccacgtctattttattttggtttgcaataacaagttctgtagatgaggcacacaaaggtatgcacatttccattatctgtttatggtcttcaggccacagatgaatgaagatttgctttgttcggcaattggtagaggcaaggcaacggatgaactgagcgttgttctctggccacaagagtcgctctctgtttggagtgtcgacagcccagagatgcggataggaactccagatcaaatcttggtcgccaaataacaagatcattgcttgttatccgtttttgtgcctttccttttctccgcatgcaaagtgcatgtcttttttttttctatcctacttttttttttaaaacacgtacaaacataagcactcataatacttacactcacccttataaattacgtatactaccctaacacttctaaaaaattaggtaaacacagttatcacccctaaatacacatgcacacctaccctcacctaccctagcatcttcaagaaattgagttagtataacttaagattgagaaaatcatcgtgaacgtctcactatctacgagtataacagctaccactaacaaaataattaattagtaatatttgggagcatccatgccaagtttccatcataagaaatcaaaaggaattcaatcagctaagtttccattgtaagaaatccaaatgaattcaatcaattaaactatgttcatttcatagtgctatattcatttcatagttttctattagttgtaattcagtataacaccaacgtctacaataggtagaagaacttggtatatgatagaattagcgaatcgaaattcttctcttttgttgatggttagtatcaagaatttgaatatagaggtcgtgttttaatccattatcttaaaaaaaaaaagagttttgatcaagtatcacaggggagacgttagcagccaagagaccgaagttgctcatacacatatcactggctagatagatagcgtgaatacattggctgaaacatttcctgttgtcaagaaacgattccagcaacccacattttctagctaataaggtcacaccacccataaacaatcaaacaaataaaccccgtcatatttctagtattaacaccaacttacaggcattcactatccaccactacgacaaacttttttccttacaggtgcagtaggtttctccaaagcatcaggagagttgataaacagaaccagaggcctgaattacccactcccactgtggacagcaggagcagcagctgc

SEQ ID NO: 33478 - DNA, 276 bp, Oryza sativa
gcctgacggtaagagcctactgtccattttagacgcatatgaaaaaatgggtaagcatgaaaaaggtctctctttgcttgaatggatccggcagcatgttcccaactcccacaacttaatatctgaatgctcgatcatgcttttgtgcaaaaatgggaagattgttgatgccattcaggagtacagtagaaaacaaatgttaaaacgtgatcctttggtcaagactgcgacttgtatgagtacttgattacttaccttgaggaggctgagttattt

SEQ ID NO: 33479 - DNA, 1501 bp, Oryza sativa
taatatttttttagaaaactatttattacgaatttcttagaaaaatatcttaatgtatttttaactttgtaataattaattcgtttgtttgtactctcgaatagcttagaatggttaattctttcgtttgtagcctcgaatagttatcacaaaattagttattcaaccatgtatcgaaaagttcaatccaaaaacctaaattgatgggaaaagatgagcaattcattttatattccaacactccccttacacgaggctcgccaggcagcatacgaactcaaggcctatagctttgataccatgttaagttacatgtatcgatcagcttaatctaaaaatttaagctgatggtgggagatgggctattcaaggtcctcaaatgtgtgtgtccgaccatccaacggtagatggatctcaagcccattcgcacttgcacatggtacgcagcagcaaaagttaactcggcccatactccagtgatgggccggatctcgcaatgtggatttgtggtggctgtgggtggataaaaccgaggcccacgcctgcatggggcacgcaaggcctccacgtatacctcggagaagttctcatccgctgacgtgtcccggggcatgtgtcgctggacgacgcgtccacggaagtgactcctcctcctgatcttctgcggctcggcctaggtggcaaaaaacggatggagcctccgccgtgtcgctcgtatccgatacgctcgtacgcatacaacgttgtcctggcacgtggtaaacgtactaacatggcataccttcctctgaccaaaatgttcgttctacactccacatagtttttcttaaaaaataaaatactaattataacacggcaagaaaaacatataaaagtatgaaagtatttgtttaaaaatagtacagtatcaccacaccttatgcttacgtgtagtgttaataatgattgttatacgtaataaaatttcactcaccttaacatagtatatatattgacttttgaaataggcgtgagaatacagagtactcctaaaattacaataattccaaattcagacagtaaaactactgtgaatgcgtcaaatcagagggtgaaaggaacccaacaagatgccaaaacgagcctaccaaagatattagagcggagcaagcaacccggggacggacggatttttcttcacggtttctctctcctcccccacaaacaatcccacccctctctttcctctctcctacctccctcccatggcgttgccgtctccgcatatataggaggcctcctcctccctcccatcctctttctctcctccattgctgctcctctcctcgcaccaccacccgccgccgtcgatcgccggagtcgagagtgaacttggttggttggttggttgatctcgagtggtggagcacacggggatcatcgccgatttggctaaacttaaccccgctattgttaacggcaacctcgcggtcgcgagaggaggaggaggaggaggcggcca

SEQ ID NO: 33480 - DNA, 384 bp, Oryza sativa
ggccgtttttgaaatgaatccactagtaatatccagtatactcatcaaggctgaatgcatttctcagggtgctagtctgttaaagagggcatgcctccaaggatatgagcctgacggtaagagcctactgtccattttagacgcatatgaaaaaatgggtaagcatgaaaaaggtctctctttgcttgaatggatccggcagcatgttcccaactcccacaacttaatatctgaatgctcgatcatgcttttgtgcaaaaatgggaagattgttgatgccattcaggagtacagtagaaaacaaatgttaaaacgtgatcctttggtcaagactgcgacttgtatgagtacttgattacttaccttgaggaggctgagttattt

SEQ ID NO: 33481 - DNA, 1501 bp, Oryza sativa
actatttactggaggaaaagaatgcgaggcgcaacaattctcaccgaagttttcaccaaaatctgtgcaaacttcagcccggatggcctgattgggttcagcgatcccaataatctccacatagtgcgacataggggcaccggaggcccctttgatggttagctgatgaccatcggtggactgcccgataagcaacccgccttcctcgcgctgggcttggaccaccgtgcgcactcttcggccgacgaacatcttcagaatctctccattgacgaatgctgcaggtcctgatgtatccatctctgcaaaacgcatggcttttcatattcatcaacacaattcagaattaccaatctgatgacacaggcaagcaatcaaattgggatcccacaaatctcctactcctggtagttctatcacgggatcatgcctagcaagcacatggtaaatccagcccacaagttcatttaactccttgattcatttaatccaagaagggcacaaccactcggactcgggttttcagtttgcgacaggaaaatcgatgtggttccctccttgatcaccactagttcccctcctaagaaaatccagccaaggaaatttgccgttctctccagccatacctgatactgataccctagtcctaaacaggaggacctagcgatcagatctactgcagagatggacctaagcgtgaggccatcgaataaacaggaggaagagggaagagttggaggtggcgtgtacctgcttcgcttcggggggaggcggcgtcggagatggggcggacggcgccggtggcgagggttgggaggactcctgatttggggacgcacgcagcaggagagggtctacggaattctgggagctcgcggaaaataaacaagttttattacgaaactgccacccactccctgaattagtggcgccaaggctccgcgccctctcgactcttttcgcgccaaaacaccaatactctttcctgccactaaccaacctcctgcgtttgagagcagcggactctcgttttgaattaaatttgaaaatataccgttcatatatttttttcctcagtaatattattgatgtattttttttttggcaaactgatgtgggagcggtctcgcatcgtgagggtgcgacagcgttttggaaatagactgatcagcgattaattaataataattagtgattaattatccaattaataattaattaattgctaatcaagataattaatcactaattaatcagtgattaacggcgaggctgtcggtctcgctaattaggtcccgctctcaccgtgcgagacgacagtatcaacggtatgtttgtgcgactaaaattacatccgaatattttgagagaaaaaaaataaacggtatattttcaatttgtttcccttttttccgaatgcacgcgttttttcaaaaaaaaattatatttaaatgttacctagacgaggcggcggcgccgtcaccggcgcaggggagaacga

SEQ ID NO: 33482 - DNA, 381 bp, Oryza sativa
cgtttttgaaatgaatccactagtaatatccagtatactcatcaaggctgaatgcatttctcagggtgctagtctgttaaagagggcatgcctccaaggatatgagcctgacggtaagagcctactgtccattttagacgcatatgaaaaaatgggtaagcatgaaaaaggtctctctttgcttgaatggatccggcagcatgttcccaactcccacaacttaatatctgaatgctcgatcatgcttttgtgcaaaaatgggaagattgttgatgccattcaggagtacagtagaaaacaaatgttaaaacgtgatcctttggtcaagactgcgacttgtatgagtacttgattacttaccttgaggaggctgagttattt

SEQ ID NO: 33483 - DNA, 1501 bp, Oryza sativa
taaaccgtgatagttgaagtcatgaatctacgattttaccatcatatcactggtgtattttgtgctttttattttaataactaacatgtagcttttgcgaaggagcggtttgccaaaactttggcacccacgtacgttccaccactacaaattaatctacgattcactcctatatagtactgatatacactcgatctagatatattatagccgcttctcccataaaattaaatgtgcccgtagattactcgcaaatacacttctccttttctttttttctctgtgagagagctagatatactccgtattatattgctcgtcaccacctgtactatacatctatacatgggcgctacgtgttgttgctgttgacgttggttgtttaattcctctcacttttctccactgtctcgaccgtgttcgtgtttgtatttttcgcactaattaagtaaataattattctcgtttgtgtttccctcaaaaaaaaaaaattctcgtttgtgcgtgccagcctgcatatgtgcatgcaggtgctcgccacgttcatcgaagcctgcatataaagaattgttgaccccgccgaatttaaggtagtatataaagattgattagtagtaattaattagttataaactacacgcgcaattaagccgttgagaaaggctcagcactaagctcttatgtgtgtgtcacactgtcactacacagctcgaatgctagattgcactcgttttgaaatattggaactgatcaaacattagtttgttgcttaacattttggaatagatcaagtatgatgcatggcgacgtgtgctttagtattagctcatttagtgtacaaaaggcatacgaaggtttcgatgatacaacctaaatttaccaattaatccaaatataactattcacactcgatctcatcatttctcgcaactcctctcacaacaattcaagaacaatcttgatactaaggaatacactttgccataccacagttttagctaccacagtttgttagccagccatttgattgtgacttgccatattttttcaatagcatatcccacatgtcgtaaactagattttcttgtcaactttgctacactttgtggttagcaatttattcaccacacttttgtgactgtcacaatttatctaatgttagttatagtaaattgtggccagtaaccaatcacaccctatatcttcacctttctttcgttcggcctaaattatgatttgttttttctttcggtctaaactttagaaatttctttcggtctatactttagaaatttcgaaataaatacgaaatagaaatgatcatttatttacctaaatgccacgggccccacgtagtagcgcgagtctgggcccacgatcgagactcgcgcgcgcacagttacaaatacctcccccccggccgctaaccactccgcttacccacgtctccttcaaaatctcgcctcgccttcccttcccttcactccgccgccgccgccga

SEQ ID NO: 33484 - DNA, 1501 bp, Oryza sativa
ttggtcctctggtgaatctgctccaaacggcagagttcgatatcaagaaggaagctgcatgggccatctcaaatgctacttcaggcggtagccatgatcaaatcaagtatgtttactcaccttgcaccagttctattcagctttatgaaatgcaaatataaccgctttcatagtttcatgttaagcttcatttggatttgatattgtatggtttgttaaaataggtatctggtgagcgagggctgcatcaagccattgtgtgatcttcttatttgcccagatataagaatcgttacagtttgtttggagggtctcgagaacattcttaaagtaggagaaaccgacaagaccttggctgcaggtgatgtgaatgtcttttcccagatgattgatgaagcggaaggtttggaaaagattgagaacttgcagagccatgataacaatgagatctatgaaaaagctgtgaagattcttgaggcctactggatggatgaggaggatgatacaatgggagctaccacggtagctgctccccaaggtgctacttttgactttggccaaggcggtggtgctgctcaattcaaataaatacaggtactctcaatcctcaacatggtttgtgtttattgtgggttgtttccactcttaccataaatcctttctgttctggtatcattcacttgaggcaacaagtaatgatttcaaatttcctcgacagatttgaccagaggtggtaaattgtggccactgtgcggggtactgaattgttctggtggttcaataagctaaaggtttcaagggggccagtgttacattatttccctactggtcacggatatcatatcactacgtctgtaacagggattaaagctttgaagtctgcgtttttcatcaggctactactatgtagtgtttgcatcttttagtatggtgtgcaacattttgctacttgtatagcctgagtcgaagcttctgcaaagccgtcacaacacattcctgaacccgtctggttttgagtttcgtcaggagtgtgctgagttgcagtttgtccggacatgtaaaccattatgccttttaaattatatattgctagggtttgttcggttctactattctagtgatctctttgcatctgcgtttttagttaataccactgagtagggtttgcaaaaccgaaccactcttactgcaggggtacggtgaaaggaaaaccatggtaatctccttaaattcaaataaattttaaaaataatttgaaattttgataaatttcacggtaacctccttaaattcaaataaaatttaaaaataatttgaaattttgataaattttacatggtcgtacggtttactgcggttactgcgtgataaccgtgcttaccaccaaggagctgtaactccggtctacctgtttgtgatggatgctgcacgtatttccgaatagatgatacagcggaggctaatagaccaagtaaattaaattgaaacttgttgagatgta

SEQ ID NO: 33485 - DNA, 152 bp, Oryza sativa
tgtgcctattatcatgtccaccacatcactgacgttcatttagctgacctcatttgctgtatcttttgcttatgagtgaattgaaattataatacaatatgtaacttgtttacatcttttagctgaagtatttacataaagatctacttgac

SEQ ID NO: 33486 - DNA, 1501 bp, Oryza sativa
gataaatgttactattgtttatgatatcggctacgtgccactaaaatttggggaaattggaaccgtgccccactccatcacgttttctattaaaaatctctattagaatcaactatacgtgaggaagaaagaagagggaggatggatgaagatggaaccgacatgtgggtttcacgtctagggatatgacgggaaacttgacagagtgacacgatttcaattttcccaaattccagtggcatgtagctgatatgtgaataatagtgtcatttatctaaaaggtatatttgtaatagcatggatccaattaacccatcattatatgatgttttttattgaattttgcgtacaatactttcttattggttttatctaaaaaggaaatatttatgtacttccatgtgcatactacaatcatttaaaactcaaccctcgtgtgcacgtgctaaaacaataggaagtacgtgtacaactctattttttttctcttatttagtgtatgcagattaagggcaaaaacgttttctaacagaaatattgattaggattaaccatgtgacacatccagtgagtcccacgatgtttttaagccaacactatacctactagaagactgatgtgaataaacggaaacctcaaataccaaactgaccctttgatggctagattggcaataaatatttggcatttagaataatacgtcatacgttggttaagcttttgaaattccaaccattaatttcttaagtccttcaattgatttgccttaaaaacttgtaggattttacatattcatcttgatacaaaattaattatcaaaattttaaaaagtttgtctaaatttgattgtaaacatcaaatatttatgacctgatcgagtataaaaaaacatgtatactatagcttgattaattagacaacaatttttgtggcgcggtaggaattcagacttttcggttaggtctgtttgaccacagcaaaggaccgtgatccccatcatccatggacagctggcgtgatcacaaatgtacactttaatcccttggcttgcagatgcatggtgcaatctaggcattgttgtacttgtatgtacagattttctgcaaaattgcagataaaatatattcccagtatttagttatttacttttgctaccaagttaaaaccatgcatgtgttaatttggcaagaaatgcaaaatgtttccaaaaaagaagttttactgcaatctttgtgttccaacggctccgcgggttccatgcaaaaatagaaagcttggcattttagcaaacaccaaacgagcggctcgaagcagctggccagccggaggccacccgccatttttgccgcttccctcaccacaccgccccacggcggatcagcctcgcgagtatttatctccctctcgcccctgtctccggccaacctcaatcgatcccgcaacgacaacgttggcgttgggaaccgagtggagactagctagtgaagaccagaggcagaca

SEQ ID NO: 33487 - DNA, 339 bp, Oryza sativa
gtaaaacctcatggaaactttcctttaaatctttctctcttctgtaattcttgtatttttttatacggtcgaaacaaacggtcgttcctatgtttcgtaatcctacgatttaaagaggtcctaaaaagaaagttatctaaaaaaaaggttaaaaagcaagtcatgttggtgtgtgtgagagagagagagaagccaaccaaatgtaagcccaccatccagatagagggaagaccaaccaaagagaataataataaataaataaatagtctcggtccaccgtcgtcgtcgtctagggtttcctcctccttcccagcggagatcaagaatcagaagcaacag

SEQ ID NO: 33488 - DNA, 1501 bp, Oryza sativa
tgaataatagaaatatgatatatgaccgctgactgatcatcatcatcatatacagttctgactcaggaattccgatatacggaattgctatctgtttggtgacagatttttgagtcacatatcttgcagatttatgtgcgttggatggtgtcaagattcgtggtgcatttttgccgactccatcattatcgatttgagctatgttttctaatgctaatttgtttatgatcccacacgtactaattacaccgtacttacactgtaattatatattaattacatatgtaattttagtgtatttacgatgtaagtctgaaaattacatatgtaattttagtgtatttatgatgtaagtctgaaatcaacttgagcccatttgagtccacgtgagcttcagattgtccatgtggcctgtttgtttgttgttttatattttgtttgtgtatattaatgtcatctgttagatgttcatccaaagagtaagaaatctgtatgataagaggctaaaaaatctgtcatcatctgttagatgttcatccaaagagtaagaaatctgtatgataagatgctaaaaaatctgtcagatgatatataggcagtcccatatacataactttctatccatcttaaaataagggtagttttgcattgattgtatccaacgtttaaccgttcgtattatttaaatatttttgtaattagtatttttattgttattagatgataaaatatgaatagtactttatgtgtgataaaatatgatagtgatatatatcttgtaggtgtataccctacgcctacggcacgagctcgagacgccatctgtgccatttcattccatggccatgattgatcgccaacgccacgtaagacaacagaccagcccgatggatcttactccctccgtccaactttaagtaaggatgatattaaggttggacatcacctagtacaacgaatctggacagagaactatcaagatttgttgtcttaggttatctcatcctcaccaaggttgagctttttttttcacggagggagtacacacactcgcacacaaaatattatcgctgtgctgtgataccaaatcgctcgttctggaaatacaagtggtgtgatggtgaagttgtgggtgcatgactttactgggttcaaatcctggtgcctataaatattatgcacaagcaaatgaaatttcaacatgactttagtgagatcaggaatatgcaattggtgttaggggcgcattcgcgggggtgtaagtgtgtgttaacgccaaaatttggtaagattttttaatggattcggttaaggaaagagcacaatgagcctatggaaagcttatctaaaagagttcgagtttaagaaggaaccatggaaaccacgtcatagcagtttagtttatctattagttaagcaagttttgtatttaggaaagtatgattcatgtccgatgaggattttatgttttttcttttatctttagaaaagtttgtttagt

SEQ ID NO: 33489 - DNA, 1018 bp, Oryza sativa
aattcctgcagccctactcctatttgttaagtagcttttgggtccacttgtattgttatcatttgattggaagaatcacacctgtttagactagaatagcccttttacttgtcaggttgatcgaatagtgaaaaataatgtcatgagtggtcggatccatttgattgtgatagcattttttactacatccatcccaaaataagtgcagccgtggatatccgtgcctaacgtttgaccgtccgtcttaccgccataccgcaatagtgttgaggcgggtgtgcagcgccttagctcgccataccgcctaataaacttgatcttaatagatcaattgttgatcaaaaccttattccaatataacaaaatacactttatattttaaaacggggaagtactccattttaaacaaactcatgaggtaatatagatttgctcctatattttacagttccaaaataaacaatgataagaagaagaatagagtaatatagttgttagatgattgttttggtttgtaatttaggagaaatatatgtgatggtgtcatgctaaaatggccaaaatgtgattccgtaaatggggttggctcatcatcaaatggtgcctaaatggcacttggtcagtttctaattgacttgcttaattttgttcttttctcaatgtgaacggatgaaattgaccttttgggctgtgaatagaaacggtgagcagctccactccagcacaggtgccgagcatgagcagccgtgtttagttacaaaatatttcttcaaacttttaactttttcatcacatcaaaacttttctacatacgtaaacttttaacttttccgtcacatcgttttaattttaaccaaacttttaatgttagtatgaactaaacacagctagctagagcgaggcggccttgcattgttctcagtcacggtcggtcggtagcagcgacagcgagcttaattaattggtggtgatctcgatcggcatcggcggtgacactttgactccccgcaccgctagc

SEQ ID NO: 33490 - DNA, 514 bp, Oryza sativa
tacactgaaaggaggaataatgccagatgcaatacacaaattgcaggccatccaagtcagatgtctggaaaacctttcgatatggaacttgttgtattcaagtaaatttgtctgatcataaccagacatacattgagtcatttgagcacataaatcttgaacttacctctagctgcaaaaggaaccaaacaaattaccatagatggtggtaaccaacaaaaagggatcagaggcattttctttatctcaaatcgtctaaaatgcctggctcctaatatttgccgatacaacaatgataagacgagtgtgcttgagcgccctaccttgtggagattctttcgaaaacttaggcatatcatcatgtgaacggccatctagaggcctttcgttataatatcctttactttgagagcgcggagcacttcttggactatgtgaccatctagaatcagtgtgccttgggcgaatatcactggtagttcgcacaggggatctcaaacgatcccgttttgga

SEQ ID NO: 33491 - DNA, 1501 bp, Oryza sativa
atccgcatctctgggctgtcgacactccaaacagagagcgactcttgtggccagagaacaacgctcagttcatccgttgccttgcctctaccaattgccgaacaaagcaaatcttcattcatctgtggcctgaagaccataaacagataatggaaatgtgcatacctttgtgtgcctcatctacagaacttgttattgcaaaccaaaataaaatagacgtggaaacgttatggattcaatattaactagatgggtaccctgcgcattggtgcgtgagaattacgtgataatttttttgcggggagaattgtgtgataaattaggtgttatttgctctgtgttcccaactcctctccttcgtattccatgcgcacgcttttcaaactactaaacggtgtgttttttacaaaatatttatatacgaaagttacttaaaaaatcatattgatctaattttgaaaaaaaataaccaatacttaatcacgtgctaatggaccactccgttttccgtgcggaggagatgggttcctaacccgaacgaacgcatccttagtatatattagttgtaattttttcttactatatgattttctttcatgtgcttatactttgataaattattcaaacgttataaatacttaagttgtatggtgtgtctttcagggagaagagatacaatttgcactcttgatgaatcatctaaagactagaaataattgagacgatgtgacttaagggagaattagtattaactacaattagtggtaatgacgtttttctttaaaatgtggacttttttcatatggacttgggtgggtatgctagctgtgatgtccattatgaaattgtgttgaacagtagaattttatgatattatgggagtacgactttgaaagagcgtagaagcattactaagggcctgtttagttcgagaaaagaaaaatttagagtgtcacattggatgtttgaccggatgtcggaagggcttttcggacacgaatgaaaaaaaaatattttcataactcgtctggaaaccgcgagacggatcttttgagcctaattaatccgtcattagcacatgtgggttactatagcactttatggctaatcatggactaattatgctcaaaagatttgtctcgcgatttcatccctaactgtgcaattagttttttcatttatctatatttaatgttttgtgcatgtgtccaaagattcgatgtgatgtttttgagaaaaaattttggggaactaaacggggcctaacaaacatcgacgtaactttctggtggaacacagtgctttagtacatatatattgtactttcttacccaacaacactattacctattgtcattttctttttcttgacttttacaaaacatttgattgcacatgttacaacacgtttgattgcacatgggaagaactgttctatcatgctggttggaagattgttctatcatgctagtataaaccgtgctacagtttaaacttaaga

SEQ ID NO: 33492 - DNA, 1501 bp, Oryza sativa
cttgaacgcatctttgtcgttctcccccacggtggtgacagcggccgccgctgtcggtggcggcgaagctgcggttcgtagttggtcgacttctgattgatgtcaggagtggcgtgcgtaccagtgctgttcgtcgtcgtcatcgctcgaacgcatcttcgtcgttctcccccacggtggtgacggcggccgccgctgtcggtggcggcgaagctgcggttcgtagttggtcgacttctgattgatgtcagtaatggtgtaccagtgctgcacattgtcgtcgctcgaacacatctccatcgttctcccctgcgccggtgacggcgccgccgcctcgtctaggtaacatttaaatataatttttttttgaaaaaacgcgtgcattcggaaaaaagggaaacaaattgaaaatataccgtttattttttttctctcaaaatattcggatgtaattttagtcgcacaaacataccgttgatactgtcgtctcgcacggtgagagcgggacctaattagcgagaccgacagcctcgccgttaatcactgattaattagtgattaattatcttgattagcaattaattaattattaattggataattaatcactaattattattaattaatcgctgatcagtctatttccaaaacgctgtcgcaccctcacgatgcgagaccgctcccacatcagtttgccaaaaaaaaaatacatcaataatattactgaggaaaaaaatatatgaacggtatattttcaaatttaattcaaaacgagagtccgctgctctcaaacgcaggaggttggttagtggcaggaaagagtattggtgttttggcgcgaaaagagtcgagagggcgcggagccttggcgccactaattcagggagtgggtggcagtttcgtaataaaacttgtttattttccgcgagctcccagaattccgtagaccctctcctgctgcgtgcgtccccaaatcaggagtcctcccaaccctcgccaccggcgccgtccgccccatctccgacgccgcctccccccgaagcgaagcaggtacacgccacctccaactcttccctcttcctcctgtttattcgatggcctcacgcttaggtccatctctgcagtagatctgatcgctaggtcctcctgtttaggactagggtatcagtatcaggtatggctggagagaacggcaaatttccttggctggattttcttaggaggggaactagtggtgatcaaggagggaaccacatcgattttcctgtcgcaaactgaaaacccgagtccgagtggttgtgcccttcttggattaaatgaatcaaggagttaaatgaacttgtgggctggatttaccatgtgcttgctaggcatgatcccgtgatagaactaccaggagtaggagatttgtgggatcccaatttgattgcttgcctgtgtcatcagattggtaattctgaattgtgttgatgaatatgaaaagccatgcgttttgcagaga

SEQ ID NO: 33493 - DNA, 1501 bp, Oryza sativa
aagcgcttgctcacatatattctccttaatggatataaatcctcttcgaagacagatctaaaccctcgtatcctctctccgttgccttgccgccgcccgagtaggtcactggccagtcgagcggctgctaggaaggcggtggcggggttgttactcggcaaggaccttgcatcctatgttgcgacgaagtggggctgtcgagtctggggttcccgtccacagatttggcagtagcacaggagacggcagggaggtgggcagcggaggcatagcgacgatgggcgggcccacgcctagccacgtgggttggtgtcgggaacggaagtggtcaggagggcggcgggtagcggtgaggctacagtagcggcgtccctttgggcaacggcgggtgtggcgaaggatggtggcagcctaagcgttgatggtcagtcctcggcagggaaaaggtggatccggtggacgtggtccctaggcagtggtggcgggctgggagtccaggaggcggaggaggattccgtcaacggttacggccctatggatgacagaggcataggaatccagcaaagtggaagcgaatcctatcaacttgcgtttggtcggctaattctaactagatgatgatgaatgaaggtgggctaagcggtggtgtatggcgtcagctcacttcaagcggatgaagatggcatcagcgaaggttcgcaactatggcacaattgggcagcggcgactagtcgactaccacttgccaaatctagccgtttcaagagaggatgtcgagaggcagggttgtaccgaggtcgtaggtttttcttgcttcttcttcttcttctttttcttcttctttgttgttgttgttgttgtgtgttcttctctttgttgaggtgtgagctatacttttggttatatatatccttcgtggatgtaaagattggattaatgaaaatccattaacttaaaaaaaatctgcaaatgactactggggaaaagtaattcagcattatcaaagcaagataaaagaaaaaagaacaactttgtataacatggctacatcacatgtccacactcttctgttgaagaattgaggtgcaggatcagttgggagtgtgagctgattcatcagcaactcgtagccaaacccaacctttacaagccctctcgattcgctgcctcgttggcaccggaaggcgctctcgcctctccaaagcgaatcaaatcgatcgatcgctttccccgccaaaaagcaaggcatgcacagcctcgctgaaagcaaaccgaatccgaatgtcgccctccacctccaccgcacggaaaccctcgcccggcgtggattccttcccttcccaccgctgcaacccaccattattctcctccgggcaccacgtcgaacaccttatatacgccggcaaaagcgaagcgatccgcaggcgaaatccttttgattatattcgttggtgtggttgagctcgtcggggtgagtaactagcatcgatgcaggcggcga

SEQ ID NO: 33494 - DNA, 1501 bp, Oryza sativa
  unsure (1)..(1501): unsure at all n locations
tttttctacaaacttgttcaaacttaaagcagtttgactttgacaaaatttaaaacgttttgtaacctgaaacaaagggagtaattaattagccaaggaattaaactgatgtgttaggctcttgatgatgattcgtttgctgtcgtcgattgattatggaagaggtaaagtgtcattatcagtttggtaggggggagggggggggggggggagggtncattgggcacagggcaggcaaagaatacgcatgatggcacacacatgtggtctacgtctaccgggatatgatacgcatctatggctctcactactgtaccaccctacatggcatcgtcctttgagtgattaaaataattagtagtactattagaaatttgattagtttacgctaacctagtagtagattagtttagtgtgagctatcactgtttttttcttcttccatttcagtaggaagcctaaccggagtagaatatcctttgattacaagcacgactgattcaaagtttgaaattcaagatagaaataatttcaacattaggctacgatcagttgagccactgttggcaacatgtagaaaaaccaacaaaatattaaaaaaatatttatggctaaaatttttacatatctaatatgagtagtttaaatgccaaggttgtgctcgggaggagaggttagcaacctctccccatacacggaaaacgtggttacttattaacatatggttaattaagtattatattaaaaacttaaaaatatattaatatgattttgtacaacaactttcccatatatcttttttattaaaaaacaatgtttaacacttcaggaagcatgcacgtagaaaacaaaagaatagaagttggtactccctcgatcttaaaatataagcaatatggattgattaggacacaccttattactacgaatctggatgtaggaagtaacttatagacattagtaactgaagaatagattatgagaacaaatataaaaaaactcataagttctctttttatttaaattttaaagttttttttagttcatacttgtaccatgtgtctgctcgtggtgaatttcgtggtgttttttttttactggttggtttcacctgtcagtggcagtgccagcttcgagcagtgcaacggaaaagggcaaaaaagtcagcaggcggaaaaaagcagcagcgagaggagagaggagaggggggcgcaggcgcaaaaagcaagctaccaccgcagcccagctcgaggccaccaccaccaccaccaccacggcacggcgaaaggggaagaagaagaggaaaggaaaaaaaaaaaattccgcagctgctacctctcgccgccttcgccgccgccgccgcgagaaacccagcggcgtcccgggaaaccctagccccatcccccaccccgccgcgcgccctcatggggcgtccgcgtcggcgccagtagtagacaggagcggggggcccgccccgtcgccgacgaggggcatccaacga

SEQ ID NO: 33495 - DNA, 610 bp, Oryza sativa
gagatcgaggaggaggagggacgagagattctattcgtttcttttttcgcctccactctccagtctccaccaccaccaccaagggaaggaaggaaggaagtctcgagagagagaaagctaagagagggggagattggggatatctatggtatggtacggggggttgggtttggatggggacgcgcaacggtcaccttgctgccaccagcctaaactaaggttgcgaaatatttagatatataaagcattaaatgtagataaaaataaatcaattgcacagtttatatgtaaattatgagacaaatcttttaaacttaattgcgtcatgatttgccaatatggtgctacagtaaacatttgctaataacgaattaattatgtttaatagattcgtctcgcagtttatggacggaatctataatttattttgttattaatctacgtttaatattttaaatgtatgttcgtatatgttaaaaaaaattaaaaaaagaactaaacacagcctaaaccgccttttcttctagcagtagtagtaccaatcaatcaatgaataaataaaaagcagatgaaaatagtcccgtaatatgtggtggacactagtatcatg

SEQ ID NO: 33496 - DNA, 1501 bp, Oryza sativa
tagggcttggccaacaattggagtttttttgtgtttagccccgtagtttttttaagctttagctttttattttgttttttctctcttactctagtataagccggtctggctgattgtgttgtgtaattatacttttttcttctaatatattgacgtgtaattcttttgcgcatccgtaaaaaaaaaaaagggctgggattatcgaccacagttccttgcctagtactagtattgatatgagcatgcttgtggcttgtcataagaatggacgagcaacgtaaattggagagagatggatgaggagggtacctgtccgaagtggaggtaagtggcggcgatggcgaggaggacggcggggaagaggaggaagagcctggtggtgaggaggacgtcgttgagattggcgaggagggagcggagggcggcgcagggaaccttgtggaggagggaggcgtcggagcttttgcggagggaggaagatgagaggttgtgtgcggtgcggcggcgaggagaccccggaaggaggtggtgccgcacggccatctccttggccatcgtattcgactccatcatcatccgcgacactggcatcaagctctagttgttcctcgctcgctgagtcgctgtgcgtggttggttggatgagagagagagagagacgatctatcgatttcatacaaatgcggccgccgtcgtggtgctaggattttgctgtatgtatgtagtgaatgactaattgaggaggaatagtatattaatggagcagctcagctcatcggggtggatgcaaatgtcaaatgctccatgaccagagtactccagcatgcagtagtagaatatggagtacagatattaataatgaggaggcacaagcacaacacaagaagaagcagagagagagagagagtggactgatggtctggtcgaatcccgggttctctaaacttaaacgtacaaaatatcacgcgaataattagtatgcattcttggtagtactcctcctgttaattatgcagttactagtaactaggcaaatgcaaaacctccgtccaaaaggtacctaccatagacaacggagctgcaacagagcagaaagaaaccaatccaatccaaatccagtgaggactgaagaggaggtgagagactgacaaaaatggaggaagctccggtggtctattccgctccttccaggggcgtcgccgtcgatcgctgcttctcttgtcttctattgtgctcccctccctaatccaatccgtacccacccaagggatgacaatcccaatcatattaaacccttttcttcttttggattttttgtctccggtgcaacgcagccaaggcccacacgcttacaaataaagtccatacaaatcacggcccaacccaccacaccaacctatccttttaggcccatttgatggataatagtttggaggaaaacgttcacattatgtcctccaatttatgggttgagtttcatttgcatccctcaaccgtaaaa

SEQ ID NO: 33497 - DNA, 359 bp, Oryza sativa
ggttggtttgttcatttgcgtcgcaggtgacgccgtcgcgcagcggcaccgttggtgtcgctgtcaccgcacagtgcaggtgcgagtgcacacaggctcgctcggcgcggcggggtggtgcggccgcatccgtccgtttcgcgtgggtgtcccatgtacagcagctgttcgcgcgcactgggccccgtccccgtcacgatgtggagtggagatgtgatcgtggcgtcgtcctgctgtccggtggcgtagaccgctgcaagtagcacatgtactcgctacgtgatcacgtggtgtggtgtatggtggtttccaaaagtgacaagatccaagaaacgggtggagatttatcgtccgcccaa

SEQ ID NO: 33498 - DNA, 553 bp, Oryza sativa
ccacaggaggcccgaagtcacccgcgtctcggccctctccgtcctcgttgctttcgacgccggaggccgagagacaggcgacgcgcacgtctgtttgcgccgttgccgcagatcagcctgacgaggtaatcgtgcgcgtgcgcctgcgcctcgatcgatcgaccattcctgccctactcctcgatttgttcgcagtcgaattggattgcgatgtgctctcttcctcctcggttttcatcgatcgcttccttctttttgggcgcgttacttcttgaataaatccttttcattttctcaaactgtcaaacaccttgaacaatatttgccgttatctcgattcaccattcatacccttcttactttgtgatgatcatcacctaggtttattcgacttcaccaatagtctgtcacgtttattgtgttacaactgagaattaacaaattctttctgaccatttttccaattcattgcagataccagctctaccaacaactcccgttacttctctgtatgatgcctgttctgaactgagtcttcatagatagagagaaa

SEQ ID NO: 33499 - DNA, 1501 bp, Oryza sativa
tacaggagtactcagcaagccatgggaaataagtgtttaatgcaggcttcaaagaaaggccgttgtttttgcgattgattttatttaaactcttttttgaaacaactaagggagtgcttctcaaacgacacggatgagacagtgcgtctcgtccggtcggagtatgtgcaatgtttcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactatgctaggaatcacctcacatccgcccatgaccgtgggcacggctgctcgaacagttttaataacctctgcagagggggcacactttacccacacgacattactaacccggatcatccagcccgtgcagaacggccacgactagagaccttaaggctttcatgacaaagaatttcaaaagccgacacaggttcaccatatgccaacgagaggggtcccagaccaacaccagattaggtcccagaccatactgtgccaggaagccaaggggtcctccccgacaccaccccggcgaatccacatgtctcttagcatcatggctcccccgataagctagttactcagccagaggtgtcccattccacccatgtggtcgtacttgtcttatattcggatgaaattccaaggaaacggtccttaagtgcaagagcgggaaaccgtacacccggtacgttcctcggtccgcggttttggaaattcatttagttcgcaagcaccgacccaggtgtcgggttttccaagtcttttgtaaaacccaagttttacccaagatgtttctcagattttaagtttgaaggcgaccgtcgatacccgtgcagagtgcacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgttcaaatgtggcttgccttgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaattttggaagttgaacggagtcaatcggacttacggttgggaagatattgaatttctaagattattggatttttggtctaaaggaaaaggatttatttaaatcctttttgaaaaagaaaagaaaagaaaagaaggaggcagggaaattagactttcctcgggcggctagggcgcggcccgagagaatggggcggctcggccgagcttaa

SEQ ID NO: 33500 - DNA, 1273 bp, Oryza sativa
atagtatcctttgaatttgtctcgcgtggtactttcagtatttttcttccctatgacgacttgactgttcacatgcccaactttctttcagttcaggtatgcagtgacgtactctaattgacgaattgaacgattgttcacgatgggattagccgcgaaattgacatgccatgggaccaattagcggtgataattatttaatgaactgaccgtttcttgctccaatctcaagctgtagacttgcctaagctgcaggggttcaaaaccaatcaagtgaagtcgacgcgcgtaataacacacattttcctgcagacttgtctaaacgcggtaaaatttattaaagatcacccaatagattctcaagaaattaatacaaataagcgtcgatgtcaattagtttagtgtatttttcacatggcttgttaataattagtacatacaacaaccgtcgtagcaatgtgacagtattatatactcctatgcacatgctgctacattccataacattagggtatcaactaaaactatcaaatgtttccagctagctctacaagtcgtacatacgtttgacgactaattaaccctatctccaagtggttttctttgtttgtaagaaaagaaaaaaaaatatggctcgttcatgactgaaggctcccaatcccgcttacaccggctcgtggcatatggttaggttgtgagctgtgttgcccccaattaatggtgcaaactttaatggtttggcactttgccggtacacaacctgctgcctgcatgcatgcattccccatatccccaactcaagtattttcaacattttccgtgtcgctaaagctaatgaacataagaacaatctatatgagaaagcatcattgatgtattggtgaagttgtaggagtactgttcatttttattgatgaagagcatagaagtttccattcaatttttttatgatttacaaatagaataaatacctgttgatcagattcaaaattgtaaatatgacgatgatcttgatgatctactctctccggcctaaaatataatcatttctagcttatgaatctgaacaggtattatagccagaaattatcaagattcataaaaaaatccttatatatattttgagacgtagagattatgttatactctttgatcatagaattttcaaagttagtacatgaaaaacgattttgaccactaagttatactccccgtccaaaaaaatcttttttttttacggagggagtatatcttcagtttaaaattgtaaata

SEQ ID NO: 33501 - DNA, 238 bp, Oryza sativa
agagagagagagagccggggagggagggggagatgggccgagagggattcggcccatcgaacccgagggaggcaaaatagacttttgcggagggatttgatttgggaaggatttggattcgggattgaactcgacgatagatcggggatttgagatctgagatggcacggacactagacaataagcaaagaaacggatttcgcaaatagggtttttaagagatagtttttccgctagg

SEQ ID NO: 33502 - DNA, 460 bp, Oryza sativa
acacatgtatcagctagggatatgtctcctcgagagtctagggcctatttagagaagcttaagattttgagaaacagctggttaattggtagccagcttctgagaatatggaaaagctgggtttcctagcttctggtttctagttcatttcctggattctacgtacaactacagtttcttagaatctggaccaaaagctggactgtttgggagagcttctgattattagagaagttgtagcagctaaaagctcttctaaacatacccttataatcgtttctacgccatagctactatacgtaggttgcatgcatgtaattgtattcgtgcgcgtatgtgcgtttgatgtgccgtaggcatcgtacgttgcatgtattgttttgtatgtttgctcgtcacatggtgaattgagcacacacgacacatctcatcatcagctgctgcccctgggatttgtagc

SEQ ID NO: 33503 - DNA, 1501 bp, Oryza sativa
caatgctcctgtttacaacataataagagcgtatatcgatggctgagtttccccatttttttgggatctgaaatatttcccgtgaaattgtgaaatttgcagtactatatatactgtagatcaacgacttgttcttcttttaaatcttgtgggaatcaagatgcgtagatcagtgacttttcttttctatcaatcttgtgggaatcaagatgtttcccgtttggaaatctcgcattcgtggcaccttaacacaaaaatagggcaaaatacttcttggaaaatccaactgaagcgaacgttagatttgcctccctgccaaggcgacagacgcgcaactggaatacaaggcttttagaacctttttaggagagcttaaaattcttaaaattctgaaaaatgactggttagaccttgtttagttagaaaaaatttttaggtttagttgacacatcggatatatggacatatatttgaagtattaaacgtagtaatattacaaaataaattacagattccgctaggaaactacgagacgaatttattaaacctaattaatccatcattagcaaatgtttactatagcaccacattatcaaatcatgacacaattaggcttaaaagattcgtctcgcaatttacacgcaaactgtgtaattggtttttttttccacatttaatactccatacatgtgtccaaacattcgatgtgatggatgaaaagtttttgttttgggaactaaacagcccattaatagataaattatagaacgcagctgataagtaccccctctataaaatagataatgttgttgacttttgaacacatgtttgattattcgccttattcaaaatttttaggaaattatataatatataaatcatgcttaaaatattttaagtgataaaacaactcacaaaaaaataaattataattccataattttttaaataaaatgaatggtcaaacgtttaataaaaagtcaattgcatcatctagtaggcagcttctgaaaatgtaaagaagctaaaataactagcttgcttgtagtagcttataagttcattttaactattaacttctcatatcttctcataagactgtgtttaattcacaccaaaattgaaagtgtttaattcacaccaaaattgaaagtttggttgaaattagaatgatgtgacggaaaagtttgaagtttgtgtgtgtaggaaagttttgatgtgatggaaaagtttaaagtttgaagataaaatttgcaactaaacacgaccttatctagatgagaaggccttatctatatgagaagctagactgtttggtttgtgagaacttatatttctggaaaaagcttcagctgacataaactcctcaaacaggccctaacccaaaaaatgtcatgctctgctctagggagtgctggggtgcagatgggtttctcacttcttgacgatttaatattctcaatttatagcatttcaaaataaagctatataccacatgtta

SEQ ID NO: 33504 - DNA, 1501 bp, Oryza sativa
agtattcttctattgtgttgtgtcaccttttctacactggtctccaagattcatatcgtacttcgtacataccacagtgatttagtaaagaaattcttaccacaacttgtgttttttccaaaaaaaaaatgcaagtcggaagaacaagaacatgtccattctatttcgtggtgagcgttagtagtagtagacgacaaacaagctaggtgtggtaaggcctgattcatagtgcgcagcggttataaaagaaattgtcatgcatccatgggcagctctgaattaacgtcgtgtcgccagggagaagggggcactatttcagagggtcggtctgtaacatgtagtattgccaatataattcatctgagcatttacacatgtgtacaactgtattgactgcagatcgacgacgagggaatccagtcagagacgtcgttggacggatcaaaccttttctccattgtaaatcaggcagatcactgcagctgtagtactactagtgctggagtcatgtgattatcactgaagattactgcagtccatccggttgcctccgactgatgaatgaagaatcaatcagtagcaagagcatcccaggttagttgatttttcaaattatttatattttaaaagatttaaaaaataaacattccaaagttcttaaaaaaacatactccttctgcccaactgtagggcgaggcatataaatcccctacagtacggcaatctatataacgtggcacctggcgagagaggcgtgccatggcaatttttgcaagcagccccttctcagcaataaatcgcattcccctatagcgatttatcgccaggagggaatggtatggaaaattatcacagcgcaaagttgggtgatggatggagtgtgccatgtcaattttgcaggcggcctcctcctggcgataaatcgcccttccctaaagcggtttatgaccgggagggggtcgtctgtaaaatttggcaggcattgaggaatatatttatgtaaaactttaaaattgtaatttatttttttaatattttaaaaaataaataaaaaatcaggttagttcccggctaatatatgatgaagtcaaattggaccttttccacttgtatcatcattgttgggttctcgaagccaacccatcctgctctaaatagtactccgtagggctgggcctgtttagttcgtgaaaagaaaaattttgggtgtcacattggacgtttgaccggatgttggaaggggttttttggtatgaatgaaaaaactaatttcataactcgcctggaaaccgcgagacgaatcttttgagcctaattaagccgttactagcacatatgggttagtgtagcacttatggctaatcattggactaattaggctaaaagatccgtttcgcgatttacatgtaaattgtgcaattagttttttatctatatttaatgctccatacatatgtcaaaaattagatgtgatgtttttttaactaaacaaccccgtagt

SEQ ID NO: 33505 - DNA, 240 bp, Oryza sativa
caagcacaaggaataaaatgcaagcaatgggggaaaaactacaacaatggcttgagtggcttttttccccttgaacagtgaacagctaaataacctaatgattttgtaataattattcgagagtgtaaacgaattaagtagtaactattatgaatgaagttaaagagtatcatactttgatttttttctttattgttgagaaatcctactaatttgacttctttcctttgggtggttagg

SEQ ID NO: 33506 - DNA, 1501 bp, Oryza sativa
taccccctcatcaccaaacatattttactgtacactgcactcccatcccatctcatctcatctcatctcatctcatgtgtaagtacaactactcggttctctcggtttcacctctaccgaatttattctaaattttttctttaaaattctaacttttttatcacatcaaaacttctctacacacaatcttccaatttttccgtcacatcgtttcaatttcaaccaaactttcaattttagcgtgaactaaacacaccagctcggttaatttctagctcggtttgagaagtcaattcatattattcctttttatttggggtgtgtttagaaactgcatttttaccttttttccccctcctatttggtagtatatgcttttggggatgaggtgaggaccaaataccatttcattcaccaaagccaatccaaacacacgtttacaatggataaatttttaaataaaatactatcacaagcatatttttttttgtgtgagaatgacaatgtgggggtctggaccaacatatgaggccttggccctttaagtgccagtgaaccatcatgtttcttaaataaaactgattgaaacaggttaaatgtgggctaaggttttgtgtgtgcgacagtgtgaggcagaggtagtttcacgttgacggttaggatggctcactcagataacaatatacggattgtatcattgcggtttcagccattaaaattttcaacttgattatgggattttttttcatagaagtttatttttcagcatttacttttggatcgctaagaacatgtgtatagaagttttattcacaaattaatgtttatttataaatagagataattcaaaaaatgctattgacaagcatccaaatcccagaaataccatcgacaagtataagttccaagaaatgccatcttacaaatgactttgtcccaaaaatgccatcgccgttagggttccattcattccacgatattaaaattctataggatgaacagtgtatttaacggcgcaaaatggatagaaccctaatgacgatggtatttttaggacaaaatcgtttgtatgatgatatttcttagaatttacacttgtcgatgatatttcttagaactcacatttcttggattatctcttataaatatgctatttgaaatatgccaaccgatgaggctgcagaattctcggatggagcaaccactcatttgatgaccctgacggagctagagctagaattggtcagcgtaacaataatcagtccgtccgcgtcatgcttccaagttacagcacggtgtgaaaaatgaaaaacatctgacaagccgctctttacaacaagtcaacaacggcattttgcgctaacagtaaagtccctgcaaacctgtaatggccattttgttggtgcttcatgctgaagtaaaaccgggaaaaaaaacgtatttaacatcagcacatagatggaaggaaggcaaaaaaagagagagagagagagagagagag

SEQ ID NO: 33507 - DNA, 1501 bp, Oryza sativa
ctcttaacatcttcattttgctgcctcaaagccttcccaataggggcatttgtacactttttccagccataaagacgatcaaccttcatagagattaagccaaaaaacaattgagacattaatagactgtaagaaaagatgaggtcaaagggcaaaaaaaaactccaaagcaatataccttatttaaggcaacgataaaaactgcatcacggctcttcaagagattcagggattcaattgtttgaggttcaagaccgtgcataatgtcaacaaccaaaatagcaatgtcacacaaacttgaacctctagaacgcagattactgaacgactcgtgaccaggagtgtcaataacaagcaatcctggaaccttaagtgtggcatcagctttaagctcttttgttctctctctaatattttcagttgggaagtacgtagccccaatctgttgggtaatacctccagcttctccttcttgtacattggtccgtctaatacagtctagcagttttgtcttaccagtatcgacatgaccaaggatgcaacaaattggtgaacgaaggtcactgccattcttagtctcatcctctttaataggtcctttctttgaagcgcctctattcctcctagcatttgcactactggattcgccatcttccgtttcacctttattggagtttgcaaccttttttacagtagccactgtagattgtgctttagaattttcctgcttctgaacaggttcagcaaccttcttggcgacagggtttgcctcttcctcctcaaaggcacttgtcttaggcaaattgacatctatatcatcccagctctttgcatcccattcatcttcatcttcctcctcttctggtttcaattcttcgacatcctgatcaggttcggttttctcagattcctccacttgcaactgagattcctgatccactaacacatattcttcctcgtcattgatagtttcgttaacttcttgtggttgttcttcaactacctttgcagtctccagagtcttctgttgaccttttttcttcttggaatcatatataggcctcttctttgtctcagggacagcaccatcggctacttgaagttcactctgctcaaggaattgtctcctcattgcttctaacctctttgcttcctccttctgcttcccagtcaagagcttaccctcctgcttcttcttcagcaacttctccttttctctctccttcttcctcctctttgcttcctcagctttcctctcctcctcctctttcttcaatcgctcctcctcctctttcctcaatcgttcttcctcctcacgcttcttccgttcctcagcttcctgcctcctggcaagtgcctcctgcatctcccgcacgtgcttcgggagcttcttcatgtcaaccttccctttaggagcttctacagccttttcctcttctttcttagcatctgcctccttagctgctgccttcttctccttctccttttccttcttcttctt

SEQ ID NO: 33508 - DNA, 1247 bp, Oryza sativa
atcatttggttatttagctgttcactgttcaaggggaaaaaagccactcaagccattgttgttgtttttcccccattgcttgcattttattccttgtgcttgggttgggtggcagccattgttgtgttgtgttggcttccctttcccctccctcccactcccagtctgtctctctgtctggctgtgctgtgtactcctactatagcgagacagagagagaatctaaatccaatctcaaggacatggccaagcccaagcagccgcctcctcatgctcctcctccgccgccgcccccgcctccggtggagggcaagcccaagcctcctcctcatgcgccgccgccgccgcctccggaggccaagaagagcttcatgcgccgcatgttccccttcctcctcgccgccaacgtcttcgtcggaggtcagctcacccctttccttctctacttagcttacccgatgccgcgtccttgtcatctaccttacctctaccgctgcgctgctactcctccttgcgggatcacctccgtacccagggctgactactgttggtcgcaccagcagttggggctatatcagtattcatctcttaggcgggttggttgttgcattcactctcggctttactcacatgtctcatcactgaaagatccatccgcttcagtaaacttatattaatataagctcatcaactacacataatcttttactcacattgggggcaacttctgtctctgccttgtttgggctagactagtgcattgttgtcttagcatctgcagtgccatttactactactgtatttacgtttattctagttgttcttgtttcttctcaagtgttatgcatgtaatggtaaaccagagctgccaatcatatttgtgcattttttgtctcctcagtatatttgagcatatctattaacaggatattaatgtagtactgaagaaatatagtacatgcataaattgagcgcatatatgtatatatattctttaagttctgaaagagatccacttctgtagctcttatgtgctgttattctgcacttctgcttttcttactcaaatgctattatagttcagttattaacatccttataacaatatgcagcttatatgcttatgaggacctaccaaaaggactcgggaaagaaagataccgagaatgatcctacttcttctacgccgacctcatctcccgcggctgctgagaagcctgcagaaccaattgttgcacccataaagg

SEQ ID NO: 33509 - DNA, 1501 bp, Oryza sativa
tgtttttcttgggtccttaccagcaaaatcttatagatcacccacctattttgctctccttgcttacatctacatgtaagaaaaaaaaataaacaaacataaaacactgcaccatcctgtaaggaactagcccctgcaaacaagctaatcattgacgagttttatgttaatgcgacttgctagctgctagggtttttggctagtcttcgccgttttttgggtcacgttggttctccactatgaaataacactacagcagcacaaaagtaatgcagtaataatatcttataaagcccaaagaaaccaccttacaaattacaaatctacaagcacgcagacgcaggaatttctttatgtaaatactaatttgtcagttgcctacgtgctacttgaagatgcaaatactgcacaacaaagactctagtgtacataaatttatagatctagtcttctttaatccttcacaagtgcatttttctgtattttaccaacacatgcgcataatgttttcattctcatatgcacaaagttctaaaggcagctactactttcagactacagtaccttttgttcatctcaattggcatgcagtacacttctgacaactagttactgataacctattatacttcacacttgcttgattttgttctatgtccaatactttactgtcctttttactgcctgttttagggcctgcaccttgtggtagccactctttaatcaatggagagcacagagcccctacaggtaaactcctcactttgccttctagtgtttctgcaagtattggttttttcaaataccgaatttcctgttagtgtttaactgcgatgatcggttgctgttgatttgagatcatgatttagctgctgcaagttccatctaaaatgacattatgggctgtttggttggtatcaacactttgccaaaaggataattgaggttgtcttttgtggtggacaaattctcaactattcgcaaatcttgccaagtaattgagtgtatgacaagtgagccagctggttaaagaaagcctgacagaaaatggcattggtagtaccatgttaatgggctgttttgtgtgtaatatgtacaaaggcctgaaccatgtttggaccagtttttcatcgtacatgatacaaaaaaagaaaaaaaaacatagatgtctcttttgtatactaggcagtttgtttctttatgttttagttcttttcagaaaactgggatagaacttctgttaatctttgcctgcactctaaaaggccaaaatatttagctagcaatttgtagcaagaaaatcttctgataagaaatgtaggttgtgtatagtgagctttcagtagttcagtgaactgagttaattttctgttgcagtgcatggtgcttattgatctatctcaaattaagatcttgtgcttattcagaatcttaatgacctatatatttatttttgccatctcatttatctctgctatgatataacaaggtgttgagcttc

SEQ ID NO: 33510 - DNA, 1501 bp, Oryza sativa
ggcccacgaaggagctccagcatggcggcctactccggcgggcaagcgtctgctcgtcttcctcggcgacagggtaaagaaacgcctagaggaagtgtttgaggccggtggaggtccgaggttcactggacattaggactagaggtgggcattcagtctaactgaaaatttcggtctcggtcttcggtctttcggtatttgaaaagtgaagaccgaattttagcgaaaaatgttaggaccgataaattcggtctcggtcattactgaaattcaacaacgttttcatatatgcaaacaaactatggaaattttcaacacaaaaatcacaaaaaaaattcgtaagcacttatgagtaaagactcttattaggttgtatgcctataagaagtagggatgtgaaaattagagtttaattctattaaacatagtggattgtaggttgcatttagacatttttttgataattcggttttttcggtctattcggttaaccgaggagactaaccgaattgaccgaacaaaattcggtctttcactgcctatgaccgaatttattagtctcggtcttttcaatctcggtctcagtcttttcggtttggtctttttctgcccacccctgattaggacatgagagaggggaaagaagacagggagatgaaaaaggagggcaaaatggtctaaatatgtttatgaatgcaatgaagaggtaagtagtggcatataccaatttgctataaaattgtaatggtatcgctacaaataaataaattttagtggcatatttctaagctgaagaatttataatggcgtggaactaattaaccctatatataaacccaaagtaggtcaagcagggccataatagtgcagatctagggcagacttgcacatgtacatgcagtcgtcgtgtcgttttgatcgatgagatacatatactacatgcactcagagcgagtataccagtccactactgaaagatgagacaatgaagatgaggacgaatagtactatcgatcatgtgcgtgatgcaactatcgtctatggctagatgatggacggacccatcgttggctgtgtagtgcaacagaaagcatgcaaagctgaccacttggccagtaaaatgtggacagataatggtgatgcaacccaacaaccagggagtacattataaacggatttttgtccttaggcctaaggtatttctagtctagctgctccttccatctcagaataattttttttggctcttccagtttttcctaaaataattttttttgaaaattttcctaaaataaattcatttctaagtaatcatcgtgtcgaagtttgtgaaagtaaaggataaatacactgggagtggataaagtagacaatagttgtattggaatttgataaagcagaagtactctagtctttggattttatattggtatacgtgggataggtgaaaaataagtttactttaggatggagagaataactgataggttggatttgagac

SEQ ID NO: 33511 - DNA, 1112 bp, Oryza sativa
gccgccgctgcccaccgtcgccttagtttccgccgcccggtactgtctctgcttgtaactaaccatatactccactcgatcagatgcttcaatctccataattcctcctcttttcgcctttacatcataatatatgtgtttgttgcattccattagattggattggaaaaccattccattcgacttgtatttcttttgctgcttcattacatcaatcgatcgatcgatcgtcggttgggaattaggccatccactccatatatctatcaccatctcttctccacttgttcatccatttatgctgtctccacttcccttctcttgtacccatgcaattcaaatcatacttcattttcaagcacttctctctctctctccctctctctcttttccaaattattattattattattattattattattattattattattattattattattattttcattcattcttacctgttaagcacgcctccttaataattaaaagaggtcttgaggtacccatgtaaacttttccctttttttttaaaaaaaaaggatccttgctagcttgttatgtcggcaacgcaaagctatttcgtgtcacctcagctgcttcaaacttcaatttgcattcataccctccagtccgaccggaatatatgcaaaagcaagctgcttttcattatactgcagctgcagcattgcctttcacataatcacattgcttgcttcattgattgtattcatgcgtccaatacgcgtctaataatccaatgcggtcactacctttctcgctacagctagctagctgtcacaccaccaccaaagtctctttccgtgcgctctggcttcataccattggagtccacgtttcctgctcgcacttgataatgtgtcactgtcagatttactagtataatactggtctacatttggggtgctggcactgccaactcccattttttaaagctcaaaaaatccattcttttttctgaaataagattttcttttttttcttggtttgcattagcagtatatatgcacacacactcattcctacactaacaatcttactacatcatatcattaacacttgcaggcctgtctagagggcagcca

SEQ ID NO: 33512 - DNA, 1501 bp, Oryza sativa
ctttgaagtagttgcaggtgatgaagacgccgccgttgaagcactcggcgcgggcgcagccgatcctggtgaagttgggcctgaccatgaaggcgaagtggccgcactcgtggaagtcgacgccggcggtgcatttgccggtgtccctgtcgtagaggtgctcctcgtcgccccagcatcggacggcgtcggaagccctggcgttccagccgttcctcccgatgtagaggctctcggcgaagctgttgccggtggagtggcggatctggcagtcgccgcgcatggcgtcggaccaccgccgcgcctgcctcgccagcttgttatcccacctcatcggctgcagcccgtagcgcgcgcgcagctggttgtggccgtccacgaactcccgcggcatccccttgtaccaacccatcccattggtccacgacaccaaccaccccgctggtgccgatgctgatgcgtcgtcgttgaaccaacacatcgcgtcgcccacagacagcagcagaaaccaacacaatagcaatagtaatgggaggatcatcgcggcggcggccattgtctgccgtcgtcccgacgaggacgaggccgcccgccgatccgatccaatccaatagtgctaatgggcttcttatatcctagctcatcttttgccatttgcttttcttggatttgcctctcgctcttccaaccataaacaacgaactaataatgccaatgccaagtttaggcagtttttcttttcttctctgcatcgatcatatcatcatatcgcacggccactctgtccaaacaacaaagcctaacctccccgggcactggcagggcagctggctgggctctggctctaccagcttgctgcctgcctgccgtgtctcgtctgcttctacaactacggagcacctgtttgcaacggccaacggacggaaggaatgttttttttttttgtttggcttggattccatccatcctctccggcctgttcgtgtgtacgccttgtgctaggctaggctccacacacctggacattctactctcgatcgttcgcggtcgcggggccctcttctgttctgttgcgttaattgcggccgctttgctttcaattacttaatatctgttttaatttcttcgccacttgacatggttatgagtatgacagattaatatatgctatcttttttgtaagaaaaaccgttaatatatgctagctacgactgcatatatatgacagattatatacgtagtatatacttgtggttcgcaataacgaccagctagcttagctagcggatcaatcatacgacgttacgttacattatactagtacgtgatgatcaaagaatcatgcatgtcaagctcatatgtgctttgtatctactaccttacacttgctctgcttctttaaccggaaaagctgtatggctgctgaatgatttttgctcggaaaactaactatgccttacgctttcccttgctctgcttctttaattgggtcggagtgtgt

SEQ ID NO: 33513 - DNA, 1501 bp, Oryza sativa
aaatttgccacttaagttagcattagagggaatgggaaggagaattaaattcagttagcatccatttgatatgctatggagccttagccaaatgtttcttgtcttttgtttgttgcctcagatgctataatgtttataccttttaacgatgttagctcatgccgtcaatccaatggcaggtaggtagggttcaaatcatttttagtggcaaatttgcaattgcaatttttttaatggcatattcacaataccggttcaatcgagtggcaaatatgcaattggtcctaaagaaaaacataaaaatgaattaatatgatttttttaaaattaattttactatttttttttgcgaaaaaacgtgttgtacatctagccattcgggaagtttactcgcagaaaacaaatgagtagaaggtaggaagaaagagtatcaataaatttgtacttctagaggggttcataatacttgtcatcttgaacaaagactattgtcaaagttttaaagacttggactatgaatatcatgatgtaaagtatgtgttagaaataaggagaactatattagttttagtctaaaaatagcataaataaaattatatatttattaatatttctatatatatgtaataaaaaaatagggatgaatccattttacacccttcaagtcctgtctaggtctaaaattcatagcaaactctaaaaccgggtatccaacactctctaaatatcaaaatagttcaatttacccacctttggcccaaggcacgaggttttgactcgatggcacggaccaggcacggcaaggcccgattgctgtcaggcccgtgccggcacggcccagctgttgggctgtgcctgggcctatgcctcatcatggtgggccggcctagcacgacatgaagttcaaggaggtgaaatagacttactttcgaccatatgtaagacagggcacagagaataggaagacaaatcgacgtattatatggcacgactcaaagagtagggacgtaaaatagacttattttagctatatatatgtcacaacccaaagaggagggagggaaatagacttatttcaaagaaagcacgatgggctgcccgtgccttcgggccggcccagcacggcccgacccttattgggtgcctgggccataggtggagcacgtgggccggcacggtacgacctggtgtgtaggtcgaaccgtgccagcccgacaaatcttggcctaggccatgccgggccgggcgggccatttggccaactataattgtggcgcaacgcagagagaatgatttgagacgatggtgttgtgagcacgaactggcaattacacattctggtacctcctcaaggatggtaactcctctcaaacaaaacaaaactaactttgttgcatattataaattagagatcttttacggtacttggaaggtaccttaggtacctccttaatcaattgatatctaccgttaattcataaagggtaatttaggaaaaaaa

SEQ ID NO: 33514 - DNA, 1501 bp, Oryza sativa
tagagaataggcataggatgcaaataatttatgaattgctcatgtaataaaataaattattttacaaataaaccctcatcctaattaaatattcacatgtcaagattcagctatttaagaacatatacaaatgtgcgttcatacgattaattttgtttctaacaattaattgttaacatatttgaggcaaaaattgctgcaagaacatgcacaatcatatcgcccgaatataggtttaatgtttttcacatgaatataaaatgaaatcaaattcattccttaaaaacctacaaaatatttcagcataggctataaatagtgtgcgcttattcaaaataaggggtcatgcaacgtgaaaacctataaaacaatgactcactcagatacaaaatttgtaataaatattaagctatctattgtatgagcataatattagtcattctgacctatattttttacgagcgatgagaaacccataaaaacatattgccactcctaagtaccatgtaacaggaggcatagagtcacgcgaatgcgcgacatcacaggctagtaaaccatgatggaaggtgccagtattaggccgtgtgtttagtggtaggggctggaagcttctttcccgcgcacgtaaaacaaggtggctcattagcgcatgaataattaagtcttagcttaaagaaaagggagaattgcaaatatatcactactttccaccccctaactcggaatagccattagaaaaacatgaattgcaaatttgccacttaagttagcattagagggaatgggaaggagaattaaattcagttagcatccatttgatatgctatggagccttagccaaatgtttcttgtcttttgtttgttgcctcagatgctataatgtttataccttttaacgatgttagctcatgccgtcaatccaatggcaggtaggtagggttcaaatcatttttagtggcaaatttgcaattgcaatttttttaatggcatattcacaataccggttcaatcgagtggcaaatatgcaattggtcctaaagaaaaacataaaaatgaattaatatgatttttttaaaattaattttactatttttttttgcgaaaaaacgtgttgtacatctagccattcgggaagtttactcgcagaaaacaaatgagtagaaggtaggaagaaagagtatcaataaatttgtacttctagaggggttcataatacttgtcatcttgaacaaagactattgtcaaagttttaaagacttggactatgaatatcatgatgtaaagtatgtgttagaaataaggagaactatattagttttagtctaaaaatagcataaataaaattatatatttattaatatttctatatatatgtaataaaaaaatagggatgaatccattttacacccttcaagtcctgtctaggtctaaaattcatagcaaactctaaaaccgggtatccaacactctctaaatatcaaaatagttcaatttaccc

SEQ ID NO: 33515 - DNA, 1501 bp, Oryza sativa
aattataaaactcaattaccattttaacctttcaccttacatactttgcccactcttttaatacctttcttctagtaacttctctcttggagcgttagatcattagagatcaacgatcctaattaattccaagtatagaagaagatctcaccatttaaatataaccgtctatttaaaaagggtaggattggaatatgtaattgccagctcctgcttgcaacaccatcgtctcaaatcattcgctatatgttgcgccacagttatagatggccaaatgagccacccagcccgacacggcccaataggggtcggggcaccatgctgagccagtccgaaggcacggacagcccatcgtgctttctttaaaataaatctatttcccctccctcttttttgggttgtgacatatatatatatatatatgtatatatatatatataattttctaataatctactcgaacgcccatgtgttctccttgcggatttcctcctcctccggcgtgaagtcgttcttgatcccaaactccttcctgatctgctccggcgacttgcctttgatcaggttcgccgtgtgctggcagcacaaatccagcaagctcttgatgttcaggaaattggacgccaggagcaagccgtacagcatgttcttgtccacgtcgatcatgaactcggcgtcgaagctcttcagctccttctcctcgtcctccgcggcggcggcgtgcttgacgcagtattcgatgaccttggcgaggaccttggaggcgacgttggggagaggcaccccgttcgtcgtgcagtcgttctcgatcatgttggagacgagctgcgacaggctcgccgccgccgacggcacgttaaagtgctcgccgtcggagctgattaagaggatcgtgtcgtcggcaacctccttcttgtctgccgccattgatctcgctactttgaaacacggacggacgaaactcgcggattgcaaagctcaactgtttcttgtctttcttggaacgtaaacgttgggtgtgcttggatcatggcgagagaggaggtggtgtgtttttattgcgtgaaaccgcgcaaaaacaactcggattcggtcatgtggagtcgaaatccaatccgaattcaattgattttcggtgatttccgcgttagtttggtgtacgtacgtcgtcgagactcgagagatttttaactggactgatcttcggaaccttcttccatagtctaattagactccttttggaaacgagtactctaattatttctcgatattaattaatttacaattattacagtagtaaaatgagattaaaatacgactcctactcggagtttaattatctcacgctgctttatgcaataaatacaatcacgccgcgaggttctatctgattaacaccaaactttccaagccatcgaccaaataatactacttcaggattagattatcgtcagaagttcatcaacaatggcggcagcagcagcggaggccacgaccgatg

SEQ ID NO: 33516 - DNA, 1501 bp, Oryza sativa
caaccatggtgagatcgggcttagtatcggggctggagcatttcatcgaacacatggtgggcgtgaccttggatgagtccttggtgacgatgcaggggtcatgaaccttgtcctcgccatccccaaggtctagggcaactgtcggagcagtctccttgtcgatgtggcctgagctcgacgtcgcccaaggacgatcgtcgttggagcacttcatcaaacaggtggtgggcgtcgaagaaggtggtgcctggagtggaggatgtgatgcagccgtgaggacagtagtggtcgccttgatggaggcgctcatctcctcgaagaacttgctcctgttagcttctatctcattcaacttcttcaaaatcagatcgatcttctcctctagcctatgattggcctccaagcactcttggtcactcatggtggaatttggtgggggaatggtggctctgataccagattgttaggatcccagttatctcgcttggaacaatagcaaactcagaagtagcagtgcgaatccaatacaagaagccactgatttctattacaatagtggaaggttttgaggtggaaggtggaaggatacaaggggctaaaagactctagaagctaagcaaaggatttggaggtaggaggagaggtggggaaggagattgccaaggttccaagcccagaaccaggacgccgccgtcgttcgctgtcttgccaactgattgatcgatcctggaagcttgctgctgctgccttttttattaatctcagaggcatgattgctcgttatttgttgttattcaacaaggccgcacgagttgttgaagaagctcactagagcaatcgcgaagcagatttaaaatattagcaatctgtaaaattttactaatatttctctgttgaatatgtgaattatgattcaataaatcttagaatccacgtggctccctcgcggagcacgcttccgctacctcctcgcacggttgcacgcagtctctcctcgttgcaatggtcggtgccgcacgtcacagccgccaaatcatcctcctcctcctcctcatgtggcagtggtcgtgctgccgccgcctcctccctgtcgtgtgcggcatcggagatctgacggccggcaccggagccggccgccggggaggtaggaagagaccacctacagcgtaccttcctaacaagtaccgcttgcgagtggagtacacgtggagaaggacccccaatggcagggggtggtaaatatgcgggggaaagaggggcaaggatgatactctagcctctttccacgccggactgacaccgctccagccgcgcacgggtgggcagctcagctttgtggggggcgaaaaagaggagctttcccttctccttcttctccttctcctccctcggtgatctgcctcgctggggcatctctaaaagcatccgactccgacgccaccaccaccagttcaccaccgctgaaagaatcagcagcagcagcagaggccacacgaggaga

SEQ ID NO: 33517 - DNA, 1501 bp, Oryza sativa
  unsure (1)..(1501): unsure at all n locations
tagtcaagcataatatggaccgtgctactaccaatagaacaagaatcttagccgctctttaattaagtacacgaattaataatactccacccgttttgaaatgtttgacaccgttgactttttagcacattttgcccgttcgtcttattcaaaaacttctgtaatatataaaactataggcctacatgaaaaatatatttaaaaataaatcagataataggaaacgaattaataattacttaaatttattttttaaataaaacgaacggttaaacatgtgntaaaaagtcaacggcgtcaaacatttcgaaacggagggagcaagtagtactccactcttttaatcaagcacaagcatgatcaacaaaataatcactcaccgtcaccgagtccgcgaagccgaagctggagaggtcggcggcggagaacatggcgaacggcggcgggtgcgggccgccgccgggcttctggtcggcggcggcgtcggcgtcgtcctcccccctctcgccgtggaagaacgcctcgaagttcagctccgacgggcacttcttcatctcctcgtgtggcctctgctgctgctgctgattctttcagcggtggtgaactggtggtggtggcgtcggagtcggatgcttttagagatgccccagcgaggcagatcaccgagggaggagaaggagaagaaggagaagggaaagctcctctttttcgccccccacaaagctgagctgcccacccgtgcgcggctggagcggtgtcagtccggcgtggaaagaggctagagtatcatccttgcccctctttcccccgcatatttaccaccccctgccattgggggtccttctccacgtgtactccactcgcaagcggtacttgttaggaaggtacgctgtaggtggtctcttcctacctccccggcggccggctccggtgccggccgtcagatctccgatgccgcacacgacagggaggaggcggcggcagcacgaccactgccacatgaggaggaggaggaggatgatttggcggctgtgacgtgcggcaccgaccattgcaacgaggagagactgcgtgcaaccgtgcgaggaggtagcggaagcgtgctccgcgagggagccacgtggattctaagatttattgaatcataattcacatattcaacagagaaatattagtaaaattttacagattgctaatattttaaatctgcttcgcgattgctctagtgagcttcttcaacaactcgtgcggccttgttgaataacaacaaataacgagcaatcatgcctctgagattaataaaaaaggcagcagcagcaagcttccaggatcgatcaatcagttggcaagacagcgaacgacggcggcgtcctggttctgggcttggaaccttggcaatctccttccccacctctcctcctacctccaaatcctttgcttagcttctagagtcttttagccccttgtatccttccaccttccacctcaaaaccttccacta

SEQ ID NO: 33518 - DNA, 275 bp, Oryza sativa
tgagtatttgtcatggtttgtggatgcatggatggttgccaaacatgcaagtaattttggttggtatcttagttgggcttcccaaattaaaaatatggtgaagaatttgttgcgacaggcaaatagggccagcaattttgacacttctatacttgagatgaacacacatgttcagaaacattcagcttatactcaagtgcatagcagagctgaggtagttactgttaaacctgaaacaaaggagctattgaacgctgaactctagtcctttgcta

SEQ ID NO: 33519 - DNA, 1501 bp, Oryza sativa
  unsure (1)..(1501): unsure at all n locations
taaattgtatttctatatggactctgccttttctttttctccgattaatgtgagaatttctaggccatgagagcgagtgtggaggctcctttttctattcctttaataatataatagatgtcacaattctctcaaacagttcctagtacatcttgggcacagggtttgacctatcggaacactgatttgtatcgggggtcaccgaagttctgaaatttcggaaatattgcggaaattttggacgatttttttttaaaaaaatgaattcaaatttaaaaattgtgggcgaaatttccaaaaaaagaacaaaaacagatagcaacactcgctctgtttggcagccatacaagcagcagcagctgcatcacaaatttgcggcaattcttaactactgcagctgtggcaaccaagctggaaaaataccaagctgaaaatgcacaaggaaatataccaatctcgtcctagaaccaataagcccaaccattcttccatcaacttctagaatatgagatgcacatgaacagaactagctggttgttgaagaatatactgagaacaaacaaatgtgaagaagagggataaccaagctggttgttgagcaccatcaccttcaccggcaggttctcgacgtggatcatggcgagcnnnnnnnnnnnnnnnnnnnnnnnnnnnnnnnnntcgatgtcgaccaccgcggcaccggcggcggccggcaggccgaagcccattgcgcctagcctggcggatgagagccactgcctgggtctcctgtaggtctagtactatgtcgcccacatctggtgctgcccgacgcccggctggagcggctgcaggcgacggctaggggcgccggtggtgggctgcgtcggggcggcgaggcggcgaccggcgtcgaggcggcgcctggcgacttggcgagatggtgatttttttcgatctgggtgtggtgtggcgcaatgaggggaggcggagggggggagagaacggcgatttagggttaggggagaaaatcgcgtcaaattttttttggccgaaatatttgaccagagctcacttacaatcgggacccaccgaaacgcccgaaatttccgaaatttcggttccaaaatttccaacgccgcttcggcataatactgctttgttttatccaactaccttttctagttgtgatgattgattagtccattattaatattttaactacgatgaatcaggataccaaattcattgtggttgttgcttattttcatttgctgaattccaacctttagtgtctttataagttccaaaatttgtttaaatttgcaagatggtatgatggaccactattaaaggtcacctgcatgggtgtataacttcaccctatatattgttattcatgttgagtttgtttatatttctgtcaaaagatgtctttttatatcttactaagcaatgtattcacatcatatcataaatttaccatatgaatgcttttcaggttacatactactttagaaag

SEQ ID NO: 33520 - DNA, 233 bp, Oryza sativa
tgtcgtcgtggtcagtaggcgtttgctgaaagttgtagctcgctagctctgaaattaagctgcagctgcaaagcagagatgctgtagactgtggtgtgcgtgcgatttagctgtgaatttggttctgatgattgtgagatgattcgtgggatgattggtctagatatatatagcctgttcggattaattctacaaggatcgccatgcgtgcatgtgcccgtgcagccgcagca

SEQ ID NO: 33521 - DNA, 398 bp, Oryza sativa
gaattttcctattattaattttaataatacaaagaacattttagtaattatttaaacaattactccttccatctatttttgatagttatatttcatcttggcacaatgatcaaggataagtaattctacttatcatccatttaaacatgccactagttattcctctttttttttcgaacacgcaaaaggattacacgttaatatattagaggaatagagtttttgttacacaacgcaatcggccaaaccggcctatgccagagaaggaagaaaacaaagccaaaaacaaggaagaaaaagaaaaattcgtacgacgggtaacgctactccaaacaacgagagggggcagagccacgctacactcccaacaagtccccaaaggaagcaacgcccgctaa

SEQ ID NO: 33522 - DNA, 724 bp, Oryza sativa
tataataatccgcaaatctccatataacagcattaaacttcggatgatcatatcttggtcatacccgctccgaaccgacccgttcaagtctcttaatgtttgttataacctaaagaaccatgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatccttgaacatattgagtcccagtttataaaattatgttgatttaaattattgcattatcgctttatttaaattcccgcgttatcactgttttatctagccatgcctatttacctttgttatgaccttattattgctattgttattattaccttgttcaccctaggaaaacaaaaccccaactagtgggtactctattcatggttccactagtatgaatttaggtagatgcttcgctgattaataggacaacactaggtggtttttataactttagactttgggaattctcatatcatttgaacactatggaatggttggcttatggtggaattggacatacacctctcttcctctttcaaaacccctaaaacctgttttccggtggggtttgggtgcatgctagttgtgggaagtagcaccccggccactataaggattaa

SEQ ID NO: 33523 - DNA, 1501 bp, Oryza sativa
gtccgccaaactttttcttctttacttctttgtcgccgatgccagcgcaagcaatccaaattggcgcatgattgcgatcgattgttgccgcgcggaaatatacatttccattaatttttatcgtaaaatatattgaaggcgcttctccatctgtctattagccaatcacgggcgttccccggccttttcctaggtttgaagaaagaagaaatgagaaagctcattaccatataattaattaagtattaactattataaaattagaaaatggattttttttaaaaaacaacttttatatataaaaaagcttcgcaaaagacacaccatttaatatttaaaaaaacatgctaacagagaaaagagcatgttaaagaaaataacaggaccacaattatctatcatttaatttatctgcctacttctcatataaatcaataacactaattttatttcagttctttaatttactttatagaaaaactccagaaaatgcttatattttggtttagtactcctatatttttgtttatgttcatgtgcaaccaatttttgtatatcggtaaaattcagacatggaaccaatatttccactcttccttcttcttcatctcctctaacttccatagaggtgaggaagaaattatggaggaaaacaatggcagatgggatccataagttgatttggccagccaatggggtcaaagctgcattaaaagtaagacggaatcgcctcccaaaccactaaaggaggaacaaacgtacaatggtcaaagctgcacttaattagacgtatggctaattaagtacggacaaacgtacaatgctcgctggttgtgtctctgcttacctggatcgaccgatcgagctaacatcgccgatggacactggttaagaatgataccaggtgaaacggtaaatgcgtcaatccgatccagcagacatggtcaacgtcaacccagcacagacagacagacttggtatatatcctcgaccatcttgaaatccctatagagaactcgtcatcgtcctcacataaaccgatctgttggcgagttcgatcatccgagatcttcatctcactttttggaaaagaccgaaatttcatgattcttagagctttcttgcaggaattatttaaacttataactgaatctgaataaataattttgaccaaattcacagaaaattagaaaaattcgagaacttcttttaacacttaacttgagatagtggctagattgcccggggtgggttttgatactgatctcaccttcttttatcacttaacttgtgacaaatttaactatcatatattctatgaaaggtttatcaaattattatcatatatcatctattctgtggaatctattctatggaaggtttactaaattattgtcatatataatctgtagcacggctgcctacctacttttactttttttttccctccaattattctaggacgtcacgactatagttggccataaggcccgaggcccga

SEQ ID NO: 33524 - DNA, 169 bp, Oryza sativa
aaaagtactattgggtaattctgtactttagcaaaataagatccttcatggttcattcagttctgcttgaatctcatgcaggctgccctgagtgtagctggttgttacctttgtgcagttccaaggtccaaaggtacaaaagtacttgtctgttgttctgttgatctga

SEQ ID NO: 33525 - DNA, 184 bp, Oryza sativa
gtttctgtctaggtgtggtctgtacacaaggtctatttatttaatagtaaataaaaagtgtgtcagactatcagtggcccagaattcatgggtatctagctcaagagattgtatttagttaaattcacttgtggaagtaggtcacagaatttgtagcaaatgacaacattttcactgtttcaca

SEQ ID NO: 33526 - DNA, 1501 bp, Oryza sativa
aaatatcctactcttgcgatgatttctacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagcta

SEQ ID NO: 33527 - DNA, 731 bp, Oryza sativa
ttctgttctaagtttatgaagcactaataaaatgctacaactgttttgttcatttgttgtgtcaatataggtgagaccatgttttggtagtttacataaaagatttgcccatagtagatagatctcaaagcagattcggtgccaggtataacttgtcaatgctatattttaatctcagaattattatgaagagataaagaaatgcttattatgtaaaaggaaaatatggcgtgcggcctagttccgtaataacatataaggaccgattccttggagaatcttatccaagcatcttataatgtgaccatatgaatatttgattcccctggctaggttatataacaataattgtgtgtttgtcttgggacacttgtgcaagggaggaagatagcccttgaattcctagaattggttttgggcccccccttgagtaatagcccaaagtcttgtgtatatgttgactagatgtgtatatatattgggtacattgtggatgggaaaaataggtatagacctagccaacaaaattggagaggctttaggatgttgctgggctttaacgggactagtcatagtcatttttgttgatgagcctatgtgtttatacctcctaggttctccatgtttatcttgggcttgtagggacaaagcaaaaaaatgaagatttttttaaaaaaacttttaaaatttttaattttgaaaataagtcctttcaacacataattcctaga

SEQ ID NO: 33528 - DNA, 1501 bp, Oryza sativa
cccgctaggcgccacgacggaacgggcgctacagaccaactcccctaacaagaatctcgaccccgagattcagcacctaagggagcagctccgggaactcggcgcggagaagatcttctcgctcccaggttgcctcatcttcagaatgattgctccattggaccttgtagaacttgatggtcttccttcgagtctgacgttttgcctcttcaagaaccttgatcggtctttccttgtacgtcagattcttttccagctcgatattacccagggggacttgctcttctggaactcgaagacatttctttagctgggatacgtggaacacgttgtgcacatctgcgagaccttcaggtaactcaagctgataagccacttcgccacgtctggcggttatgaggtaggggccgatgtagcggggtgctaacttgccggacatcccaaacctcctcataccacggaggggtgatacccgcaggtatacatgatctcctttttcgaactcaaggtcatgccttcgattgtcagcgtaattcttctgacggttctgtgctgtcttcaaacgttctcgtatcagcttaacttgttcttctgctgacttgagtatgtcaggaccgaatatcagcgcttcgcccacctcattccagcataagggagtgcggcactttcttccgaacattgcctcgttcggcgacatctgaatgctggcctgatagctgttgttgtatgagaactcagcatacggcaaacaacgatcccaagtgccttcgaaatccagggcacacgcacgtagcatgtcttctaggatttggtttaccctttctgtctgaccatcggtctgcggatggtaggccgtactaaaatttcattctattctatttggactttgtgtcaagaaccatataataagaggttgtagctgtgattgaagtaaaggctaggtttaatatatattataaaaaaatactgaggaaaggtggtccaatatgcaatttactcttattatattgatcctagtggttgtttggaataatgaaggcttagcaaacacgcaacgaggatgtgcttaatttgctgacatatctcttccgttcttgaatattgatctttcgtttttctttcctagggtgacccacacccactaggaatcgaaaaactctgcacctgctggtatgcatgaattatttaaagttggctacttggccttatagaattctttcagacagcatggagatggagaaatttcccaccaaatattgacccataccccacatgatttggatggatcccttgatccgatcacgaatgcttaggtggactttgtttctaaatgtagaaatgttattcagtaaccattgtggtttgttccataaactaaattaaggttgggttttctgatggcataaaaatcatcatttacaactgattaaatatttaaaatttagttgttgaaacactgaaattatatatatcttcacaacaagttgcaccaaataatatt

SEQ ID NO: 33529 - DNA, 1002 bp, Oryza sativa
acgtgaacgatacgtggacgacctttgaacgggcgctgaacgaacgtggacgaaacgttaacgaacgcgaacaaacgtaacgaaacgttaacgaacgcgaacgaacgtgaacgaaacgttaacgaacgtgaacgaaacgttaacgaacgcgaacgaacgtgcacgaaacgttaacgaacgcggacgaacgtaacgaaacgttaacgaacgcgaacgaacgtgaacaatacgattacaaaacgcgaacgaacgtgcacgaaacgcttacgaacatgaatgcacttgtactaaatgtgtgagaacgaacgcgtttctactaatacgatttactggtaatgttgcagagaagacgtttagactaatacattttcctggtaatgttgcagagaagacgtcggcgtcgtccctcaagccgaagtggtagctagccatcgaaggaattcgcgcaggcaagtgatgtaattaagtgattgttagatatttaatataagattgttacacttagcatacatgattattacacttttaatataagattgttatcgatttaatataattaagattagtagcgatttaatatgagattgttatacttagcatatatgactattacaattcaaatataagattattagagattaaatataagattgttagagatttaatataagattgttagacttagcatatataaatgattattacaattttaatatgagattagtagcaatttaatataagattattagacttagcatatatatatatatatgacttacaattttaatataagattattagagattaaatataagattgttagagatttaatataagattgttagacttagcatatataaatgattattacaattttaatatgagattagtagccatttaatataagattattagagatttaatataaaattagcagagtttcaatattacggttagcaaatacatcctatatacctaacaaatattttttgtatgcacaga

SEQ ID NO: 33530 - DNA, 1501 bp, Oryza sativa
attgcggagaaatattaataactttgtctcttataggaatatgtccccagcttgttgcttaactaaatgtcaatccaaataataatcatatattttgttgaaaaataattaacaatatagatcaatatctagtatcacttcacaaactttcaaacaaacaaattgaactctaaatagtacgtacgtactagtagttatttttcaaggtatatggtaatgtcaagaagtaaattagtaatgagcactctaatattttacccctcggccatatagctaaagctatttttttcttagctacaaaattaggttttcccttactttgcatacactatgagcttccttgatgcttttattgggatcgatttacatggacaccctatagtttttttttcaccacttttctttttttttcaccatatagtttttttaagtttatatacctaaagtttatacttatagggtttacacatcttttataggtcaaaagtttatataccgattcaaatttgaatttaaatttaaatacatttaaagatgaacttgaatctgatatataaacttttgacttacaaattttaggtcaacaaactttaagtatgtaaactttagatgtgtaaacttaataggtataaacttcgggggtataaacttagtaaaacagaaaagtaaagtggtgccaaaaaaaaaataccgcgtagggcagaggaaccgatcgccccaagcaatcaatcgtgccataggagtttcgcaccctatcctcacgggcttcaagtctagcctgatgaaggcattagatgggcgtcatcgccagcccatctatgtaggcttgaaatattagctcatacatgcatgtttgtgggctgtaattcgttggaccagatgaagcctattcaaacttagccccaattggtagtttcccaccataggtcagcccagatgttcaattctttttggtagagcttaaaattgtgagaattaacagatttgttctcagttcatgagaatatgaaaaagttagttttccaaatttttgttatagttcattttctgaattatatatctactacaaattcttataatgtgaatgacaatctaaattgtttagggagagttaaagattctgagagaagttgcagctgctaaaagcttttcccaaatagacacctagggcctgtttgggggagcttccagctgctgcagcttttcccagaatcagaaactcccccccaaacagtatagcttttggtacagattctgagaagctatagttgcatggtagagctccaacttctaaatttaactccagtagttgggtctgaagtggagttgtggagctgactaaacacagctccacatctctagttcattttatgagagcgctccacccagcttcgctgctattaggtggagctgaaactgtttggctgagctccagttttaggagaggtggagctggtgatggaactatgccaaataggcccagaattcagaaaatgaacaa

SEQ ID NO: 33531 - DNA, 1501 bp, Oryza sativa
cgaaaaacaaagctttgggggaaagacactacataaccatagatatttatcgatgagcaccgtgccgtctaaatgaaacttgccatgctgacgtggcggttcaggagcccttttttaatgtggttggaccgaaatgcccttgcgccttatctcccttgagggagtagccggtcatggtgaagaacccctcggtggcgtagatgatggggcagtccgggcgcgtcgcgtcggagacgacgaacgtctgctgcaggctggacagcgcgtccttgacctccagcgacacccacgcggcagccagtcttacgacgcgcggccgccgccgcgcgccgccgtccactgacgacttgcatgccgctcccgtccccgacgtgccgccgttgtcgcaccacgccgccgccaccggacgccaagcctgctgctgctgggcgctgcttccgctagagccctcctcggcaacgatctccaagccggcggcggtggagatggggaacgccatccacttctccaccgcgtccactatctccttcgagctgctggccgccatggatgccgacgagattgtcctcggctattatcagcaaaggtgtaacaatcttggcagtgcaactgccactggtggagaaaccatctttcgtcggtcgggctaattccacaatagtcccggttgcaacaaaaaccgggactaaagatcatctttagtcccggttaaaaagggtaacgggcatatttgatctacaccaaccgggactaaagatcgtaactttagtcccggttcaaatgctgtaagggcctgtcaggtcccccgggatctttagtcccggttaataacaccaaccgggactaaagatcgtaactaaagatcacagcgatctttagccccggttcataacaccaaccgggactaaagtctcacccctatataaatgtcttcttcctccttcagcccgagcaagcttcaaaatttcttcaaaaaagaggggaggtcatgccaaaatttctagtaaatttattttggtgattatatacaaatcagaggtgcctaaaaggttagcaacttcatcctccaatgttttttttttcatattacatttggagctatgttttgcacacatttttgtgaccaaaattttgttgttatttgatgagagagaaaatttgtgtggagaataaagaatatatagaaatttagtttatttgctaaagaaggttttataaaaaagttgagaaggaaaatatagtgaaagttaatcttgaataatagaaaacaaagtaaaatgacaaattaaaataagtacaacacattaatattagtttaaaactttataaatagtaaatatataattattcggtgtaatatttcataatatttgtaggaataatgatatgtcattattgtgtgactgttgaaagagtttgtaattattttataattattgtatgactgtcattattgtacgaataattatgtgtgtacgattttttttcatgttatgtagat

SEQ ID NO: 33532 - DNA, 937 bp, Oryza sativa
acagatacttgatacagagccagttcttaatttcggggaaatttaacttaactcgtgatcaagagttatataggccatagtgtgtcgctttaccaaaagtgtgaaatatttcccctgtcccttgtggtaaatttgtacgaacaaatattagactggcgaatggagagtaacccgcaaatagttaaatttcctttttacagtactcctgttaccggtgtctcagaaaaagtgacacctacaggcacgcggcacgccatggcaagtgcaatattgtgatgtcaaaatgcgtactacgtactagtatgtgcaaaggtcgtttgattaaccaggaattcctcgtctgccttaatggtgactcaactctaaaagttctataccaacgaatattattaatttattattataccattacacgccgttgggcgcgactgatgctgttggccaggtgcatttcagcagtaagattcaaggaagagacgacatccttacttcgacaagggagtacaccgaacatggaataatctctgcaaataattaagccgtccatttcaccattggaagtaaagcaaatccaagatatatcctctcaaattaaatcaagtttgtgtcaaggaaatcaatagtttggacaatacgtgtctgcgtgttcgtaacttcgtataaaaatctaccgattaattaacccgtaagctatgctgcggctgcacgggcacatggcacgctacacgattcattaacttaaggtgatccttgttgaattaatccaaagaggctgtagcctatatatatttatctagaccaatcatcccatcatcatctcacaatcatcagaaccaaatccacagctgaatcaaacgcacaccacacagtctacagcggatctgcttgcagagctacatctttcagcgcctactgatcacgacgacagacatggctt

SEQ ID NO: 33533 - DNA, 522 bp, Oryza sativa
atgtccactagtttattgcatatcatttaaatagttatgaaaaaaattaaaaaaatatgaataagatagatcaatatgtaatatgtaatatgtaatatgtaatgtatcaatccacaaacatgcaagctaaaattcaacttctacatattgtaacaaaaataacaaacaaaactcaaattaatatatgtatgttgacagttaaatttgttgttttttttacaacttgtagaagttgaatttgaactttgatgtttgtggagtgatatattacatattgatttatcttatcaattgttttaaaaaattttcgtaaccatctagttgatatgcaataaataaacaggtggacgtccaatcaagttattagaatccatcccgtttacgtttagtttcttgtattttggtacgatgagagtatgaccaattacatactaggacgattggtacgtaggcacgcgcgtgtacgtctttgatcgagatcgagttgctgttcccgggagatcgatcgatcgatacacatca

SEQ ID NO: 33534 - DNA, 273 bp, Oryza sativa
agggggtggtaaatatgcgggggaaagaggggcaaggatgatactctagcctctttccacgccggactgacaccgctccagccgcgcacgggtgggcagctcagctttgtggggggcgaaaaagaggagctttcccttctacttcttctctttctcctccctcggtgatctgcctcgctgggcatctctaaaagcatccgactccgacgccaccaccaccagttcaccaccgctgaaagaatcagcagcagcagcagaggccacacgaggaga

SEQ ID NO: 33535 - DNA, 255 bp, Oryza sativa
tacatcttaaaattatatgatgttgttttcccaaaacatcgaaaacttattataaatactccttttattttatattataaattaacagtgtcccatacttttttttacggagggagtaaaaaattttaagagcggtacaataaccggcgataaacgctccagctaggattttgcgatttcatggaagaaagagcggtggagcgcgagcgcgaggctccacgcgcggcccaaggttgtggggcccgcttgtagcga

SEQ ID NO: 33536 - DNA, 1501 bp, Oryza sativa
tcgccaaatgccttgtcactaacaccattttttgccttccattgcaagaactccagagtggtatccaactttttgtgcccctgctcgcaacctgggtacaacgacgttctatggtcctctaacatcttgtccaatttatgggcccccttttcactttcgcaatcctccatggcgtcctgcaacatctgaccaagatcatccgcaatgttgttaccatcagcatccctttcctcctcgcccgtttgatttcattcaaatccagcgtactgagcaaagtccggaatattgtcgtcttccacttcatcttcttccatttcaacaccttgctctccgtgggatgtccaacaattatagcttggcatgaaccccgactcaaacaagtggaaatgaatagtcctgcatgcagaatactccttctgattcttacacttattgcatggacaacaaataaaacccttttgcatgttagcttcggccactctcaaaaaataatgcacgccgtcaataaactctttggaccaccggtcagcgtacatccattgccgatccatctacataacatgaaaaaaaatcgtacacacataattattcgtacaataatgacagtcatacaataattataaaataattacaaactctttcaacagtcacacaataatgacatatcattattcctacaaatattatgaaatattacaccgaataattatatatttactatttataaagttttaaactaatattaatgtgttgtacttattttaatttgtcattttactttgttttctattattcaagattaactttcactatattttccttctcaacttttttataaaaccttctttagcaaataaactaaatttctatatattctttattctccacacaaattttctctctcatcaaataacaacaaaattttggtcacaaaaatgtgtgcaaaacatagctccaaatgtaatatgaaaaaaaaaacattggaggatgaagttgctaaccttttaggcacctctgatttgtatataatcaccaaaataaatttactagaaattttggcatgacctcccctcttttttgaagaaattttgaagcttgctcgggctgaaggaggaagaagacatttatataggggtgagactttagtcccggttggtgttatgaaccggggctaaagatcgctgtgatctttagttacgatctttagtcccggttggtgttattaaccgggactaaagatcccgggggacctgacaggcccttacagcatttgaaccgggactaaagttacgatctttagtcccggttggtgtagatcaaatatgcccgttaccctttttaaccgggactaaagatgatctttagtcccggtttttgttgcaaccgggactattgtggaattagcccgaccgacgaaagatggtttctccaccagtggcagttgcactgccaagattgttacacctttgctgataatagccgaggacaatctcgtcggcat

SEQ ID NO: 33537 - DNA, 1501 bp, Oryza sativa
tcataactaattcattgtaactcagttttatgtggttcaagttgcaaaagttgtataaaataaagatctacatattaaaattatccataaattgaattaaatttatttaatcctttttaaatgggctttaattagatttaatctagtaaaattcttaataaattcatttgaagtcagaatgaggccgttcaagtctcataattcatctaaaattatgatctacatgtttgtttactttttatgtactgtttatttggtttttattagtctttttctttgttttgcgtgttagcttgtcgtttccgtcgttgcgaaggtttacgagtgcgccggaagtatccaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgggctatatatattggttcagctagatattagatatgattgcttagccatgcttagaaacattagcacactattgggataattaatgtttcattattatttaatgatggcttaatgatagctcgcgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtatagcatgattcattgtggagcaccagactgagaagtggcggagataagcccacgggggtcgctggggagtccatgccttgtttataagggggtgattatgatccaggaaaggtgcgctgtggtggattatgttgtgcaaggggtattgtcatagctcctttccgaggtaccgtggtggtattgaggcacatggtgacatgttgtggggctgtgtcttgtgggtacagtggtacacctctggccagagtaaaactatttgaatagccgtgcccgcggttatgggcgggttgagcaatgtttttcgtgattagtctcacacctctcacaataattatggatgttatacctggtaataatttgcttagctcctgatttggagttagatctgtacagccgggtatggttgttcaggatggttgggcctgtgcagcatgggtgtgctgttcagtgttgattaaaatttctgattaattactctactgttttactactcttaactctttgctaaatgctgctttcgcaaatgagactatattatgccatcctttggtatccttgtgcacttgcatatttgctgtgtggcttgttgagtatgtcatatgctcattcttgcaataatcaatcaacctcagt

SEQ ID NO: 33538 - DNA, 1501 bp, Oryza sativa
gcaaacctggctcaaaagaacatattttagatgagtaggaagcttgtgttcttcgatggtctgaaaggttagcggctacaaatggcttgattaagttttttaatcccctcttgcttaattgtattctttacttagaaactttaactcaattgactcaagcaatggatgtacttttcttcagtttacctcaatcaatttatgttagcgtgccttgtacgtgcacgcttttaatcaataaattttcgctgacttgaagaactctgtagagcagcgagcagcagaggtaggatgttttgatagcaggtgctcaactaaaacccgaattgaatccatcttttggctttaaactgatgttcagatctggcattttggtgcacaacatgtagttggggattttttgacatttcttaagtgttttttcattgaacttgatcaaccaaagaaactgtattacatcaatattcatgacctgttagtctgaagctaaagcagaatcagattcagcaaatgcggatgtacaactatccaataagattgatcgagcataatcttgcaagattatgagataatgcatgtacaactaaataaagatacaggcttttctatactgaactggattttatggatcatcacccatggtcctctgtactcaaatcctttttttcttttttttaatggcatacaccccatggtaaatgaaaattgtattttctttctttctttttacctaaattcatacaatctggataatatattttatatgatcccttcttatacctgtggcttagctatttgtatttgtaaaccaacgatatacaatagaaataagccggtgcgatttgatgttaacgtattaattttttttccattttcaacgcacgggcacccaactagtataacgtaaaagttgcagttttgtgataatttttcacgctattgttgcagtaaactaaaacatatcgctaatgttgtagcaaactaatagttttgttactaaagttgcagttttctgaaatttactcttgtttttaagcactcaggcagtacagcataattgttgctatgctgtgcgtgcgccgatctggccacattcatcttgcttgaatcactaatctaatcatcgtagtttgtttttggtgttccagctttccagctttcttttctctctttttttactattaccaagaaagagggaagggctcaaggatgttctgagcgggctgctcagagcaacagcaggtggcaggcaaccagtgcatcgcaggagataggcgcacagtgttagaaagagtttgttacatgtgataatgcgcatgagataataagatagaattagagatagatttctgtttttgagtcttatctcctcctttgtatgcgccactttgggagcttttcccaaacatatattaacacgtacagcgacctctaacgaggtgagaacacttctgccaattcacatatatatggtatcacagccaaacacccacgcataagatca

SEQ ID NO: 33539 - DNA, 282 bp, Oryza sativa
ctcatcttaaatagagagacatttatgactctctattgaccggttaaaaaggtgggcggactaccacgtgcgcgcgcacgcgttggctgggccaagcccgtggcttccgtcgtccctagctttgatctcttacgtgcaaaagagattgggacgagtagagcctccgaaactctgtccgtctgagttcctgcacgggtaggcgggcaataaagtttttgcggagcgttcttccgtctgagttcctgggtctgagttcctggttcctattcatcaacgccaaca

SEQ ID NO: 33540 - DNA, 1501 bp, Oryza sativa
cgagcgtgtcgtagtagtcgtctgtgctccggtacccctccgggctgaacccgccgaacctgaccccgccgccggtgcggccgacgactacgcaggggcccttgaagtcgcaccggcgatggaagtccgtcgcgctgaagccgtccacggtggccttgtagcagcatttcagctcgcgacctgcactgcacacgggaattaattaaccaggaattagttactgatcagtaatcgagcaagaactaaatcatcatcaagaacaagatgatttgggttttgcctctgaggtgggtgttggcgacgagggacatggggaacggcggcgcgacgtcgtggtactggaactccggcggcggcgcgcttctgccgccccagctgaagaggctgcgcggggtgacgaatcccgccgccggccggcagctgcgggtggtcgaaggagccaccgtcgacctgccgctcgccatgaacgccgccatggtgatcgctctctgctcggtgtcatgggctcatggctacgctgtcgcgcgcacgcgaaccttatctgcttcggtggcggctgacatggagggggtttgatgacacgtgtcgcagcttgattcgctctgtttatcgcgggctctgctctctggggcccaattgcccaagagctgcaaaaaatgggtgttcatacgtgtaaatttttatgcatatatgtaatttttgcggtatcggagtgatgaggactggcaacaaaaatatgaattacacagcattttgtacaaggcaaaagtgtgttagccataacaattcttgcaaataatttttttttcggtgtcaactagtatatacatttgggtgattcatctaaaacgagtgtgttagccataacattctagaacgagtgaattcacataattttcccctaaaaaagaattcacattttttttctcaaaaaaatgattcatctaaaattggtacacatgaattatattttttttcaaggaagaccgaagacagagtagattgtacattgttttgctcaccttagtttagtaggagtacatactttcgctttaccccagggtatactataatttccactttgcactaggttgcatcacataattaaaaacaaaactcataaaatatgagcacaacttatgaaaccttttgaatttagatcatgttttacgaggttccattaatttattatgatttttttagagatatgattatataagtcactctttagccagtgtcaggtgcaatttattctctcctgaactttgttcagtgatgaaatactccttcacaggcctattgggccataattccatatcagacgccagcccagaacaccaaatgagcccaatgaacccattttcaggcccattttcatacttggcccaactgcaacatctagaaaaaaacattatttttttttaaaaaaaacttaaaccctaccaaagcaccaaacctcgtgacctcgccggaagccgcgccgccccagccgccgccatgc

SEQ ID NO: 33541 - DNA, 309 bp, Oryza sativa
caggatcgatcaatcaggtggcaagacagcgaacgacggcggcgtcctggttctgggcttggaaccttggcaatctccttccccacctctcctcctacctccaaatcctttgcttagcttctagagtcttttagccccttgtatccttccaccttccacctcaaaaccttccactattgtaatagaaatcagtggcttcttgtattggattcgcactgctacttctgagtttgctattgttccaagcgagataactgggatcctaacaatctggtatcagagccaccattcccccaccaaattccacca

SEQ ID NO: 33542 - DNA, 786 bp, Oryza sativa
atccatgatccacttggtgagagcctggagaattcaggtaagtgaccaaacggtccaaaagttttcatctgataggggatatggtaaatgaattttactctggagtgaatactacgtttctgaacaattaaaggcgataatttagtgtggtttctttgtgcttcaagtaattgtgatttgtgaatggccaagacaccggcctctgcactgcgccgtcgccacagatttgctaaacataggtaaattaatttgctgtaaacaaggggcaacaaagatgaaaaggagtttggtgagaaggtggtggggagtgacatagctagcggacaaggacaaatcatgccaacttggccggagtgcatcacccgacgtggacacctcccctcccttggattctctgcgctacccaccacaccgcgactgaattcgcaaccagccgccggtgatcggatcccgttgtctatgtccgaagagtaatagagtactacctccatcgtaaaattgtccgatttttttttataataaagtattatctacatcttaaaattatatgatgttgtttacccaaaacatcgaaaacttattataaatactccttttattttatattataaattaacagtgtcccatacttttttttacggagggagtaaaaaattttaagagcggtacaataaccggcgataaacgctccagctaggattttgcgatttcatggaggaaagaacggtggagcgcgagcgcgaggctccacgcgcggcccaaggttgtggggcccgcttgtagcga

SEQ ID NO: 33543 - DNA, 1501 bp, Oryza sativa
ctccacccaatccacatccactattgagtatctgaaaagaaatacaattgagctaattcttttctgtaaacaatttatgtatatgccatattattcttccacatagtacaagataacatttgacatttcataaataagatgaatggatagctattacattatcttcaccaattcattctaaagaaaataaaatagaaatgccactataccacatacaattattcgttgcatgcacatcatactcattcatcaatcatgggatcattttttttagggttatgtctcctcctttttgttgccaacatgcatgatctccctaccaaaaaaaaaatgcatgatcttttctttttggttctttcacccaatcaggtcagccaaagagatggtcacaagggagaaagaattaacaagctagagatcaaggaggggggagaataaagatggggtttaattataatcaattaattaaaaacaaaacagcacgacagagccaacaaatggtggtgtggtcgcagctggatgatccatccctgagctgtcctgctgttggcattagttgttttctgctctgctcgctcgctcactcgcccccactacccaatatgggctgcataaagaaaggccattcatatagctggtgttttgccacatgcaccaactgcatttgctatctatgtacctcttggatattttccttctcgccctttatccactccccctgatctagagtttttggtaaagatgaatctttgtgacttttggccccatcgttggctgataagaggaaaatgcgaaacgatatatttgtaaataaaaaataattatatatatagagcaataaggctctaaaaatattgcaggcgtaagtggtaaactaaaataagccaaccatagtctataaaaaatatattttattgtggtcaatattatggttttagcagtagaaatctaagaaacaactaatgttaatagcttaggcactaaggagaacaatttatatgcatgaaagcataaaggtatgaaaaagagaagaaaattggctattgtcaatgtcatggggctttatatgctaggtttcatagcaggcaccatggcaaaaatattacatttgtcaactgcccaaagctcagtgaacaaacggtcgtacctatacctgttacatagacgtaatttaatacatacaagataaccgaaatggatgagacaatattaattataattgtactttctattacttactaaactcacaacacctaaattatagtaatattttaaatattccttacggccgaaaataagaagttatttttttttggcgcgaattgccaacgtaaacatatcaacggataacccgaatttctcctcatgtacactacagtagtacgcttagcatttcacgagtcactagtgtcccagtgttgggctgttggccacccccacccaaatatcatcgcattgaaaaataaaataaaataaaataaatcctcatcaccttcacgtg

SEQ ID NO: 33544 - DNA, 1026 bp, Oryza sativa
cctccacccctctttatatggcacagtgtgacgggggcccaccagccattgggctgggcgcccccgatcagggcgcgggtcaaggcccccttgagccgttgggctcaaggggagggagatccatctaacatcagtgtcaccatgtctatcttgcttttgcagcttgcatctcgtcattttttatgtatttgtatctccattatcatcatatccatgcccttcagattatatgtatggacttaagtaccctgagattagaaaaccagaaatcacaggcacatgtcaagtggaccagagcaaatttatttatttttttacgatactcattcttgtacaactttaaagtgaagttttgagatgtgttttagcaatcaaaaagccatattgtttcacttggaccatttggttgcgttgagttgaaaagattgtggaaggtctctcttgtgcttttgatgtgtacaaaagtattaatgaacatgaagattcttattttttctccttccggttctctttctgccattgcagcccaagggtagcgttttgtggatatggggtgtgtttggttgctcgtatccccctagcctggtccgtctctctcatcctggctgagtttgacctggctaagaggatacatatgcagctgtttagttgtttgcattagtctatctaggttggttgtttgcattagtctatctaggttggtatgagatcttgtttggttactcgtatgagaaatacggtttggaagggatcttttttggttggttgcactgatcgagtgtggttacctctttatttagctgggtaagattacctttacaatatatatataattatattgggtttttagttaacaattaaatattctcttacatatgcaaatgataatattagaagtgcaaaatcattgtcttctctatataaaataaaataagtcatcaactttacgagtttgtgataaaaaaaagaaaaaaaagtagatttttattaaggtagaccgcggtgtactaatctaccattagtaga

SEQ ID NO: 33545 - DNA, 169 bp, Oryza sativa
tgaccacttgctacgcgagagaaagcagacgtcgcggccagaaaccaagtcaaacgaactgaaatttttgaaaatatttggattgttttgaccctgataacacccggctggagctgctcagctcggtctttgcttgctggcggcctaaattccatcaattcgtcccagg

SEQ ID NO: 33546 - DNA, 443 bp, Oryza sativa
atcatagcgtaattacgctcaaaagattcgtctcgcaatttacatgcaacagtgcaattgatttttttttcatccatatttaatgctccatgcatgtgtccaaacatttgatgtgacggaaaagttgaaagtttggagagaactaaacacaaccatagtcattatttcatcaatgcagtccatatgtaatgattatttatatatctgtgtgtgtacatgaaaaactaattatttagtttactactttcctctcagaaaagtaactaaatttactgtttagtatatataactgcaaaaacattgatcgttccaatctaaaacttgtgtaaacaaaccgtaagttgtctgtatgattttgtcttgaaaaatgggaaaatgcatgtagaaattagtgttaaattagtaaatctccttcttagctaatatatgttttattctgaagg

SEQ ID NO: 33547 - DNA, 534 bp, Oryza sativa
tttcacatgatcaaggtgtatgatgcaaccccacagttttaaggtggctccgccactggtcaatacatataacgaattacagtttgcatcagagggagtacttatttcttcgcacggtagtttatacctactttgtaacttaaaaggtgtttgcactttggcatctttcattatcaaagatcctgttacctgtatgcatatttctttggatcatcagttcatgggaatggtgtatagtggttaaatgatctaggtttttctgcaacaacaatttgggctcaccaaattcaatgatatacgcgttgaagtatataaaccattatatatatattttctgttacattatttttaatgacttatttcctcatctgcaaccaatgattttctttattattttgtaccatagaacaatagattcagatgtatgtagttagcaaccatatgtacagacagcattcaatgtatatttatggaatgatttttttctgttatttcaggtgatgatgtttcttgaccgacagaagcagtcaaaga

SEQ ID NO: 33548 - DNA, 270 bp, Oryza sativa
ccccctttctgttcttcacccgatcccgcattttcttctcaaattatcttaagttatcagtgtattctgctgctagtttgtgtgattcgatctctcacgagctcgggtcataacaatttggtatcagagctgttctgatcggttctcttgctgcttgattggtagacccaagggaagggttggtgttttacgcaccgtgattctagcctaaggttcgatctgtagagagacgaggaagatagtggaaaccttacccaatggaagcatcaa

SEQ ID NO: 33549 - DNA, 1501 bp, Oryza sativa
gttttgcaataacgattcaaagcagtggtaaatttgcaattgcccctttaagatacttataaaggtagaatatgtatgcgcgttcatagatataagtgtgcctatattttaagcatttgcgtttgtactatctttcttaatgactcaacaaatatataataaggaagaaaccaaaaggttgaaacagagaaaactggaaatcaactggaaatcagatcagacggcgcaggcggccccctgtcgtccacgcacgggcgaccgggggcgaaacataaccctcggctgctttgttgatggggtgtgatgaagctcggtaacgataacacgttgcagtctctctctaggtgtgttggtgccaacaacaagcaggaagcggtgatacgattgctttggctgatgttcgccatgggaagtcggagctgcttggtcgtttctgtgatgagcttggcaacgacgacacaagtttgccgtgaagtcggagctgctttgctctggcaagcttggcaacgatgactcgtgtttaggctccgtcgatggtctattttgagtgggttgtagcgttgagttgttgtgcgtgctgtgaacttgttcggccgacaacaatagcgtcctttgttttctttttctcgtaacccgtctgggtttttactcctgcttattgaaagtataattggcagcctctacctgccgatttagtttaaaaaaaaaagaaaccaaaaggtttagtatagttttagtatttactaattatcttgtttttggaaaaaagaagttctaaatttccaaaactttcagcgtcagtctactacattccctaatctacccataacttacaaaactaccgtgaaattttaatgttccagccaaaacattttcttaaaaaaatttaaggtctcatacaagtaacaggcacggtgatgacagcgtcggcagcgacgtacagggcctttggtgctattgtgggctgctggaggaagcccacaatagaaaaaccggcccgtgctgctattatgggctgggccatgctggaggagggagagaaaggctttcatcagcccaggcgtcgagtaggaataaaccactctctttaatattggattgatttggaggatgatttggtttcatattcgaattccaatttaaaattttaattcatgggaaatagacaactttaagggagcgttttcggcttttcagatagactttggtactaactctccgataagcccgctaaattcacaagcgttatgtgtaggctgccatcggttggccaattaatcagcgtattagcgataagaaaataatttatagttaaaacttttacctatgtgctctaaatgacttaaaatggtaatgttgaaatagaaaatacgataaaagaaaaccttaaaaccaactccaaaattaatttttttaattttttttttgactttggcatatacgttacactagcgcttactccctccgttttataatataagattttctagcattactcaca

SEQ ID NO: 33550 - DNA, 1501 bp, Oryza sativa
atcgcaaatcgaagttgcattatctgaatctgcgagtattaaacccgtggttgaatctcccttcttgctctgaattttgaataattcgagctcggattgcgctttaaaaagacagtctttcgcattttgaattcgcgtctcctttctcaaattcaaaattacagtagactttgcagcgcgagtacagatatccttaattgcttatctactaggatcctgtgtctctatagaaaaatacactgttgcagctgtgatcttcagtcaacagaagttcatatcaagaatttgattgcattttgttctatactatgaagaattctggatttgcatgcgatttttcttctaatacaccgggtagcatttcccaattcatcctgcatttaattaagatcttgaagctaggcgatctctaaagtgatttagatcgggtttctgagctgttctgtgaaattttacagtaaattcgaatctatacttgattcagaatttttgcagtgcagattgcactggaaaaaaatatatgaaattattttattaaaatcgggcaccagggtattagttgggggaaaatgcatcacgagattgtactgtactgttcattactgtagtctgcaatctccataactccgctttaaatgcgaatttactgaaagcatgaacacaagattgtttacctgccccaactattaaattcttgtggttactccacataattttttagtagatccagttcccataattaatgccaagcacctagctaagcaaattgcttaagccaaaattgattgcttacaccatttcatttctgatttactacctggcaatcccatgcactgcttttgtacatattccttagacacatcactttcacgattgctactccagcaagtaacgagcaattcttgcagctagctagctggtagtgggtcctggtgagtgtctctgccgattcatcaccatcatggttagtggttgggggtcactaatgctctccagtctgtttgtaatttgcaaccgcatcagttctgatccggatcgagttgcatggaggtgtcacatcatgtaaatcgctttcaggcttcactcgtgccccccatggaaattaatgtacgcaaaaaaaatataaatatgaatttcctgtggaacttaggactcaagaatcgattttgaatttcagattccctttatgcagggtcaagctttttttttttatgttgagctagtttctgaaatcctgctatgcctaataatagctggtatactttttttaattttggagcagcactgtttttagcaaagttcaccaatcctgcagatttgagatgcagagttacttggttcttgcaccgtgcaataaatcttgaacattgcgctaatctaggaaaattttctggcactgggttgatagtgctatttattgtttgctgttgatagtcaatcatagaacactccactgtattgagtttgttgtgtactgattgatttgctgccaaaccttgaa

SEQ ID NO: 33551 - DNA, 583 bp, Oryza sativa
cccgtccaaaccgcaataaatgcggttaggtgagccctcgctgctctcacctaacccatacacgcggcgcaaaaaaccttcaaggggtcggggcgcctcagccctcggggccgaaacgggagcggtccgacccctcgggaagacaaagaggggggcggccacatcaccctcgggcccgacccccccgagggggtcaggcctcgtgggtgattgctcctgcccaagcctctagtcatgatactctcggtcctatgtcaccgacaatagtattagaatgtgtcacatctcaataaaatcttcttgtattttgggatggtggagtatagtacaggcgaggaagccactgaatcttgtgaccacaaaaaaaaaattgaaggaaagggacggagaaaacaaggataatttgatcgaggtggtaaatatctgatgtctatgacatttttcttcgacccctaattcatagttctatgctttgataatttcttgttctgttatctacgagacaaattgcacaaaccattaatcacacggacattattgcaaacacagatagcatcaatttctctaattacactggctgaca

SEQ ID NO: 33552 - DNA, 1501 bp, Oryza sativa
tctaacattgcccacattcatttagatgctaatgaatctagacatatgtatgtgtttagattccttaacatttataacatttatatgtatgtgagtaatgctagaaaatcttatattataaaacggagggagtaagcgctagtgtaacgtatatgccaaagtcaaaaaaaaaattaaaaaaattaattttggagttggttttaaggttttcttttatcgtattttctatttcaacattaccattttaagtcatttagagcacataggtaaaagttttaactataaattattttcttatcgctaatacgctgattaattggccaaccgatggcagcctacacataacgcttgtgaatttagcgggcttatcggagagttagtaccaaagtctatctgaaaagccgaaaacgctcccttaaagttgtctatttcccatgaattaaaattttaaattggaattcgaatatgaaaccaaatcatcctccaaatcaatccaatattaaagagagtggtttattcctactcgacgcctgggctgatgaaagcctttctctccctcctccagcatggcccagcccataatagcagcacgggccggtttttctattgtgggcttcctccagcagcccacaatagcaccaaaggccctgtacgtcgctgccgacgctgtcatcaccgtgcctgttacttgtatgagaccttaaatttttttaagaaaatgttttggctggaacattaaaatttcacggtagttttgtaagttatgggtagattagggaatgtagtagactgacgctgaaagttttggaaatttagaacttcttttttccaaaaacaagataattagtaaatactaaaactatactaaaccttttggtttcttttttttttaaactaaatcggcaggtagaggctgccaattatactttcaataagcaggagtaaaaacccagacgggttacgagaaaaagaaaacaaaggacgctattgttgtcggccgaacaagttcacagcacgcacaacaactcaacgctacaacccactcaaaatagaccatcgacggagcctaaacacgagtcatcgttgccaagcttgccagagcaaagcagctccgacttcacggcaaacttgtgtcgtcgttgccaagctcatcacagaaacgaccaagcagctccgacttcccatggcgaacatcagccaaagcaatcgtatcaccgcttcctgcttgttgttggcaccaacacacctagagagagactgcaacgtgttatcgttaccgagcttcatcacaccccatcaacaaagcagccgagggttatgtttcgcccccggtcgcccgtgcgtggacgacagggggccgcctgcgccgtctgatctgatttccagttgatttccagttttctctgtttcaaccttttggtttcttccttattatatatttgttgagtcattaagaaagatagtacaaacgcaaatgcttaaaatataggcacacttatat

SEQ ID NO: 33553 - DNA, 1501 bp, Oryza sativa
tcgtcctctacgtgtacatgtcctccaaagtcgcagccgaccatccaatctccggcgaggtcgccatcttggtccggccattgatgaggtcatcatgatgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcattggtggtgtgaatctattcctttgttatggcctgtttgcattgattactttattccttgataccttgggttattataacttgactagttgagctttatatattggttcagctagatattagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacattaaccgtgccaaccacaagccagcgtgggcaacgactttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgccacagcctctattcgggtactttccagtatcgcgacgcatggtagacataatgttgaggctgtgtcttgtgggtacagtggtacacctctggccagagtaaaactattcgaatagccgtgcccgcggttatgggtgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgttgtgtggcttgttgagtatgtcatatgctcattcttgcaataatcaatcatcctc

SEQ ID NO: 33554 - DNA, 1501 bp, Oryza sativa
tgtgtacgaagaagctacaaagtgcgagctagcccctgatcgttctgggatccgaatccagcctctatcgttcaggatccgtccccccccctctaagtgggcaaggtcctccttttataactcaaggggataccacatgcaccatctctctattttgtgtggggacttctcctctctttccctccaacttcccttctcttcattaatggacggagatttgtatggttgccgtccgaatgaccttctgatgggacggcccatacctacctccacttccgccggaggcaggcgcgacgtgggaacatggctgtctgctggcgacatgaccagtgtcagaccggtcacaaatcggtcattcttgtccaccacgtgtcagtttaacaatctgcatgttcgcccttcttcatacaatatcttgcctgtaatggttaggatgaagcctgacatatatctgaccgggtccaacgtgccacctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagcgcgctgtactgcgttacatgcggcgtgacgcgcccgtccaaaccgtaataaatgcggttaggtgagccccgctgcgctcacctaacccatacacgcggcgcaaaaaaccttcaaggggtcggggcgcctcagccctcggggccgaaacgggagtggtccgacccctcgggaagacaaagaggggggcagccacatcaccctcgggcccgacccccccgagggggtcaggcctcgtgggtgattgctcctgcccaagcctctagtcatgatactcccggtcccatgtcaccgacagtagcccccggcgttatgccagggcgatcgccctcctcgagggaagcggtcgggcgtgacgccacttcctaaggcctggtgacaggtgggaccggtctccacagttgggcagaaacccaacggtcgccaatcacgcacatcggcaatggtaattcgactgtcaataatgagcggcctcttcaaggctgccacattactcgagtagcacgcgaatccggacgagccggttcgttttgcctggagatatggtgatggcgcttcggtcggcgagcgtaattaacgcgcgcacgatatgttccatctcgactgccacttccgcatatccacctcatgcgccgcaagcgggcgaatgggattagtggaagcgtgggcgcgagaaacgagggagcgaaatagtgggcgcgagaagcgaggagccgggcacagcgttgacaagggtataaagacaccgaggaagagatttgcttccttcctctcgccattattccccttgtcttcgccgcttgtgccctaactccgcgtttcctgtgccctaccttcgccacacgcgctcgctctcaaacatctcttcctccggcgtca

SEQ ID NO: 33555 - DNA, 1501 bp, Oryza sativa
ttggagggtcatgagaagtagtaagttttttctcctcttgcagctcgatccactaatccagcacaacctggttgctccagatttaccagggtgatttacacgatctggcaggctttgatccacccatacgtaaacgactgaaataaggtacagttagttatttcatcgaagagaaggaaataaaatatgaatgccttttctgcctaatcttttgtagatataactccatcaaattgactactattttcttataaatcaagcttcaattatagcatccctttcctgtgttgtcctctcatctgatgccagtgattgcattttcggttcgaaatttcggaccccactggcaaatcaatatatcgaccgaatttttcaggttttctcaaatttttgttgaagttagtcaaagtttattcaaaaactgttaaaatctgtcaaaatttcaagaaactttgttccgaaatgtgccgaaaatcacgaaatttcgtaaatttcagtcctaccgaaatcgccgaaatcgaaagtgtaacccctgtctcatgcagagtccgctaaaatttatagatttacagtaaaagatccaagtcaaatatggcactaaaatatttatttgtttaaggatttaggaagagaggatactggcattcctggaataaaaacataatatacaggcataaagctaataatccaatcctacacactttagctttgtgtcatctgccttaaaacccaatggctggaaaagtttccaaataaacttgcagttcacatatggaactggacgaataacaacagaacaagtaagaggaagaaacaccattcaatatactatcaataagcactaatcttatcttgacaagatgtagcccaactgctgacacatgtgtagatgtggttgcttggaagcccattggcatcttaactgcatgtattaatccaagtgagaccagatgtgaatatcacagctcctaatgtggatgacaaattgcttccttgtactctatatttttgctacagtaattgagtgctaaaagtaaaaggcattaacaacctgctcagaattgacatgctgccagtttctgagacattctatggccaaaattcagaaattggtaaaacagaatagaagccttgatgtaaaaaaaatatattagaaccaaataatttctgaatggctttaaagggacttgtacgtagcggaagaaatattggaacgccttatcctgaaactcaaaggcacaatcttgttgagattaaggacataaaaattaatagtgtcgatctatcgttgggctgctaacatatgaatgttagatcctatagtggcaaagagattgttgttcacatgttataaatcccaaaccaaatttcagtacagcaaatgattaaaaaaagagatgataatcatgcccaaaccatgtgcaggaacaattaaaccccattgcagaaggaacagtctcagttctcacaaattttcaagatctagcaggcagaccaggca

SEQ ID NO: 33556 - DNA, 827 bp, Oryza sativa
agcatgtatggatcataagatagacaaaagcaaacattatcaaggatcgtctgctaaatccaaataagccacacgttactcagacaaaagactgcagcggatagacataacaacgataaacataagcaacatcgctatcctttaattcatcacacgatgaaagctcaagactgcaacagatagataccatgacgtcgaaacgaaccccaaaaaaaaaacaccaccaccaaaaagcattagttaaatccaaaaatgatatatcctccagccttcacaagatcgacacgcgcattccctcgtaaaacacaagacagcaacaagaacacagacagatactacaacattgaaacaaacccttctgaaactacccccaccgcttccaacacaaccttaacgcttcatcctccctcatcccgacttactacaggtaaactcacgacgccggcaaccgtcatgcctcctaacctaaggtggactcaccacacatagactcacgatgccagcagccggcatgcttcccaacctaaggtggatggacacaccacatgtagactcacgacgtcggtaatcgacctgccttctaggtatggccgtatggggtggggtggggtgggggtagggtagattagtgggttacttaagcccaccgggtggtctccccaccctctctcaccgccccacagcaaatcccgtttcctgtccaccggaagaagtggactttccccactctcctcctcttcgtcttcctcacgagtcccacacgctttccattcctcgccgcagatcggctcgcacgccaagaacgcgcatggaggtgtcgccggagc

SEQ ID NO: 33557 - DNA, 579 bp, Oryza sativa
ttcagttgtgcattattttcggagttattgcctggatcatgagttgtttttggtggtgccagctgatgcagctacactgttcatgactgcctcttcttcttaccattgctgatttgcccacctgtaacaatggatgcttcccctctttgggcggcgcctcctcacgcgttcccatggccgccgtcgcggcgtcgggcggcgaccgccatcgttaacaccaccgacggcgacgcctcgccattgcgcgctcgtggcagcacaatatctcaccacttgtacacccaagctgagcatctatagttcctgaggcggagctccatctatcgtccttgtcgagattaacctgactacggagatttacgtggaaaatcctcctctataactaatgcgaggatggaggaatcggattttgatcatccacatgatcaggatcgctcgtggcagcataatatctgaccacttgtacaccgaagcatctacagttcctgaggtagagctccatctacagtccttgtcgtcgcgattaacctgaccacgaagatttacgtggaaaaccctcctttgtaacaaatgcgagga

SEQ ID NO: 33558 - DNA, 833 bp, Oryza sativa
ttatatatatatgctttattgagttgttattcctcaaatagctttgtaattgctcattgtgcaaagagaataaaaatatctctgagagaaaaaaatgaataccgaatccttggaaacagtcttgacgacaaagacgtattcgatgtgagcaaaaataatgggtgccgaatccttggaaacagtcttgacgacaaggacgtactcggaataattgagagagaaaatatgagcaaaaagtctcaaggaaaataaaacaaaaaattctcttggttgttttgtgctagagctaatttgagaaagagtgataaatgcaataggtatatatgtttagtgtttgtttttcaacctatgtgcttgttaagatgttgcattataaatcgtatgaaatcatgaattttgattgttgatttgaacttaattgtaaaatctctggttcatgattatactttactgcatgcttgctatattatagatgggttcatattctttttattgcaacacatgacttgatttgctatatgtatgctaaactcttgaacattattgaatataattcctatgattgatgaaatcattgtcaaaagggggagaaacaatgagtttttgagaagagaacatgttttttggttcaagggggaatttctttcttttcaaaaatgagagaagttttcttttggatttttgagcacgatgtgtacatttgtacaaagtgtgctttttaccacttttgtttttatttttctaaacaccaaaacattttttatgggtttgccaatgtgttcatcaaggggaagattgtaaaatcaaaggtgtttttgattattattctgtga

SEQ ID NO: 33559 - DNA, 1501 bp, Oryza sativa
tataccaacgaaattatgggtttttatcttatttcactttccacaagattaaacaaatacatttactctaaaccaagctaagtcataattagttttatatcgcattaggttatgtcgcaggttccctttgtaagacttcttataactttggatcatgttttgcaaaattctatttgaattttcaattaaacatgaaaattgtatagtatgttgatgtatctcgatagaaagtaatatgttcttagtccatccatctcagaatatagcaacctaggatcggattagacgcatcctagtactacgaatctgaacatagggcatgtctagattcgtagtagcaagatacatcccatccgatcctaggttgctatattttggaacggaaggagtactttacacctaatgcacattgaaagtatgctataaattcggctctgttcttaggctgagtttgaggagaagggcattgagaagattaggaagatacgtaaaacggtctgagctattagtgtatgattaattgagtattaattatttaaaattttaaaaatagattaatatgattttttaaaacaacttccctatagaattttttttaaaaaaacacaccgtttagtagttcggaaagcgtgcgcgccgaaaacgagagaaatctttctctctatcacctactgcgaacgctgccttagttctgttctcttttcgtaattgcaagaaaaataagtaaaaatttaccataatttttctttaaaaattggctctaaaattaaaatgaatttgggttataataatttgtaagaaaccattaagtgcttgttggaataatgtaaaatgataactttgaattctattccatttattttttccacctcatttcatccattcactaccttcatatatttccctataccaatctaacatctgatatgatcatatcacatgatccaaacatagttccaacttccaagaccatatagatcacccaattatcaaaagaatcattagattaattagctgccgtccaaagcgatttggcaaagaaacagagagtatacaattttgctatatatttgtcgataaattttctctcaaaaatttaacagatgtaattacagtacaatcgcagtgtaattacactgtaacttgcatgtaattacactgtaactataatgtaacttgtatgtaactttcaaaaatctctccgtaacatgttatttcggtaaaatagagatcgtgggaacaaatcctttcacatatatatgtgctgtgattttttttcttcctcaccagaataaatcttgtaatagatctaacgatttaaaattatgtgaaacttacatacaagttacactatagttacatgtaagttacagtgtaattacatacaagttacaacgtaattacactatgattatactataattacatctgtcaattttttaaaagaaaatttgtcgataaatatataggtggtcccgagagtatatatatcctcgagaca

SEQ ID NO: 33560 - DNA, 1501 bp, Oryza sativa
aacagtcgtcgatgcgttggaacttctccgaagtgacacccacaaggaggacacgaagcgtaacgccgtcaccgctcattcgaaaatcggaacaaggttttcacctggagattttggggggggggggatatgaaagaacgccatgacaacgcctccaagaagggaaacagcgcccgcgggcgccgtcgtcatcgaaccggccaaaggcatggcaaggctttcgccagcatcttcacatcacccacacaagcacccccacattgatggccacgaaatagtccttgacatctcacaagcagtcataacttgaccgtaaccaacggcaaagacaggcccttgtccacccgtgaaacatcatcaatctgccgcaaactcctacagcaagccggagcctccgccctccccttagcgttccccacaactagaacagtgttcgcccaaagaaggggggaaaccgaaaggagggagaacactcggccgagaacgaggaagtcaccgccgcggacgtcaagccccattcttgcttcatgctagcacaagtcgtcgtcctgccaactccacatccgcacatccacgagacctgccaccggcaaaagaagcccccagcacatctgcacattcttgcttcgtatctcacagtaggtttgaggtgtgtgtagaggtggtgacagccctcaaaatactaaagtcctccctgtccgtgtacgttgtagagccatatctgggagcagcaggctggccagcgcccgaagccagctcccgatgtaccttgttaggattaaattgagctttctgtagacactatctctcactagtaaatcatctctacccttagcctatcttagcttcgtatccttggatgaacctggtgaagagtcgacacacatggtccttgtggaaattgataccttggaatactcctgggtgaagtgctacatcggtattttgcgcttgcggattttatctgtgaggttaagaaataccaacaatgttgggctccgaagaggattattcaataaaggaatacgaaggttgtggttggttcaattccttgttgtgtgggtgatcctgttcaagaaaaggagtagagaaagccttgtgaagaagagaatctacaggtttacacacagagaagtagacttccagtaatacaacaagtcgagcggctatgatctcaagatgctgaggttgatgagcaaatgttagatcatataaagcccatacaggtgtatagtgagttagggcaaggagaagaggaatctgaagaagggggaggagaatctgaattacctattgccataagaaaggggacaagaagcgcggcgggaaaaccaccacaaagatatggctttgaaagtgaagatgaaggtggtgataataacaacatagctaactatgtcttgtactctttattgtcacctacttacaaggccttgtggcatcattgaattcagtggcaatcccgaaagattggttagaagccaagatccaagattgtgag

SEQ ID NO: 33561 - DNA, 1501 bp, Oryza sativa
ctataggcatgatttggcatgattgagtgcatattgagtgactctttttgtagcctagctatttggaggcctgcatgacctcatttctgttgtcatttccttcactatgcaatcctgcaacttccagcttaatttactgtttatgtctatgatgtatatggtgagtcaagcagatggagatggaaggaagagttggtgcaccatgtcaaagtccccatacatgcacagccacttgtgttgatgatagctgcaaacctgcaactaaatgcaagaatctcacatacaaaggcaccagaagcctgcatccttggaacagcaaagaaaggaatcagcaatatgttttttcttgtttttcagaatccaataactgaatgtgtttgactggatgcacaggaccaaaagttttcagaatggaatggacctccactcaggatggtaaagctgatggcactagcttattgttaagcatttcttttgaagctgctagtgtcaagtgttcactactgaacgctgtgcactttgatgactatttagatacaaggggatatccgctcgagggatgaatacactttcccttgaacccttaaactttctgcaccgacagagacggcatgtttttttttctttttcctgaaatgaatgtgcattttgttgcatctctgatttgtagtgaatgggtcaaatgcttttgacttctcactgcttgaaagttgaacatcatctctagtgttttctgccattcacttcgggttgctgccctttttttgttcttggtcatcatggtgaatgtgtggttgctcagttgccgacacatttctgcagacccattttgcttttgaaacactgctgattgtttatagagcgcgcacacacacacacaaaaagagatggaattcaacagctacatttctgtaatttatgtttaagttttatatttctgtcacttttgtggcaccagtgatcttataattgtaaattttgatccaagattctaagatgagtatttatcctcctctgacctacatatcagtaatcttgcatgatcaaacatgtcattgctacaggaagctaaatcgccatttaaaagtgccgagaattttttttatgaaagtgtttcatttgcttctcttctaagaaagtttcattttctaataatgtatcctaattcgagaattttttaatgaaagtgtttcatttgcttctcttctaagaagttttatttctcataatgtatcctaatttttagcctaattattcttctggccgctaataaaaacagatagccacctcgcctgaaaaaaaacccgaaaagtgattggttaaccaaaaaaaaaccgattggatctaataatgagggacttattccatcaccgtcacaattgggcctccataagcccatctgagcccacacattacagcccataaatccacgccgaaaatggcccggcccggcccggcccactaaagaggaggctaaaaaccctcacaaaaaaaatatctt

SEQ ID NO: 33562 - DNA, 1357 bp, Oryza sativa
ctatataagtaatcatgtcaaaattttggcaagtatgccacaattttagtatctataccaaaatttgtcaatgccaaaatttggtaaggttttttttggcatcaaggtgaacaggcccttagacatactcagcccaacatcttcaatccaatgcttcatcctaggaaacgtttccagttctcccaatctgtctcatacattaatgttgtactggtggttgttcagtcgaggccctgtttaattctcacgcaaaaacttttcaccctatcacatcgaatatttgacacatgcatagagtattaaatataaaaaaactaattgcatagattgcgtgtaaattatgagacgaatcttttaagcctaattgctccataatttaacaatgtggtgctacagtaaatatttgctaatgacggattaattatacttaataaattcgtctcgcagtttacaggtggaatctgtaatttattttgttattagtatacgtttagtatttcaaatatatatatccgtatatctgatgtgacacccaaaaccttttaccccctaactaaacacagcctaaatacgaagacacaacctaagtatgaagtggtatagtgacaataatccagattcctgtatgagttgacatttattttgtcctacgtacaatttctctaatttgcgagttttcttgctgcactctgcgtatatacaatcccatgtaagggtgtgtttataggcggtaaagttttggcgtgtcatatcggatatacgaacacacgtttaaaatattaaacgtagtctaataataaaataaattacagaatctgcctgtaaactgcaagatgaatttattaaactgcgagacgaatttattagtaaatgtttactgtagcaccatattatgaaatcatggagcaattagtcttaaaagatccgtctcgcaatttacacgcgatctgtgtaattagttttttctatatttaacacttcatgtatgtatccaaatattcgatgtgacaggatgaaaaagcttgctaggagatttaaacaggctcttagggcatttacaatgtgagccactcctagagtgtcctcactaactgagaacactcgtaggggaactcagctcgtaatggaggacacccttggatgggctcctaaaaatctaaagcaacttaataaagacattccaacccaaaatgggtatcccaacccacaaagccccatatttatttttactaccctacccctaatctctctctcccgccccctcttttttttcaccgccgcacgggcctatccctctcgccattgcactcgcctctccctctcgccgccaccgccgctcgcctctcccgtcgtcagc

SEQ ID NO: 33563 - DNA, 722 bp, Oryza sativa
cttcatcctagccattacaggcaagatattgtatgaagaagggcgaacatgcagattgttaaactgacacgtggtggacaagaatgaccgatttgtgaccggtctgacactggtcatgtcgccagcagacagccatgttcccacgtcgcgcctgcctccggcggaagtggaggtaggtatgggccgtcccatcagaaggtcattcggacggcaaccatacaaatctccgtccattaatgaagagaagggaagttggagggaaagagaggagaagtccccacacaaaatagagagatggtgcatgtggtatccccttgagttataaaaggaggaccttgcccacttagagggggggggacggatcctgaacgatagaggctggattcggatcccagaacgatcaggggctagctcgcactttgtagcttcttcgtacacagatccaccaaaacacaggagtagggtattacgcttctcagcggcccgaacctgtatacatcgcccgtgtcttgtgtgtttccattctcgcgaaccttccacagaccgagagcttagaacctcacccagggtccccggccgaatcggcaaagggggacctgcgcggtctcccggtgaggagccccacgctccgtcatctggcgcgccaggtagggggctctgcgtgtgtttttctaagctctcgtattctttcgtgtgcgccaagcttttcctgttcagcccaa

SEQ ID NO: 33564 - DNA, 1501 bp, Oryza sativa
gcgttaattacgctcgccgaccgaagcgccatcaccatatctccaggcaaaacgaaccggctcgtccggattcgcgtgctactcgagtaatgtggcagccttgaagaggccgctcattattgacagtcgaattaccattgccgatgtgcgtgattggcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtatcatgactagaggcttgggcaggagcaatcacccacgaggcctgaccccctcgggggggtcgggcccgagggtgatgtggctgcccccctctttgtcttcccgaggggtcggaccactcccgtttcggccccgagggctgaggcgccccgaccccttgaaggttttttgcgccgcgtgtatgggttaggtgagcgcagcggggctcacctaaccgcatttattacggtttggacgggcgcgtcacgccgcatgtaacgcagtacagcgcgctcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggaggtggcacgttggacccggtcagatatatgtcaggcttcatcctaaccattacaggcaagatattgtatgaagaagggcgaacatgcagattgttaaactgacacgtggtggacaagaatgaccgatttgtgaccggtctgacactggtcatgtcgccagcagacagccatgttcccacgtcgcgcctgcctccggcggaagtggaggtaggtatgggccgtcccatcagaaggtcattcggacggcaaccatacaaatctccgtccattaatgaagagaagggaagttggagggaaagagaggagaagtccccacacaaaatagagagatggtgcatgtggtatccccttgagttataaaaggaggaccttgcccacttagagggggggggacggatcctgaacgatagaggctggattcggatcccagaacgatcaggggctagctcgcactttgtagcttcttcgtacacagatccaccaaaacacaggagtagggtattacgcttctcagcggcccgaacctgtatacatcgcccgtgtcttgtgtgtttccattctcgcgaaccttccacagaccgagagcttagaacctcacccagggtccccggccgaatcggcaaagggggacctgcgcggtctcccggtgaggagccccacgctccgtcaactataaatttggataattagtatatctacattcaaagtattagaatatgtcccatctaatcaaaactatttatctttcaggacggggagtgtggcagttaaga

SEQ ID NO: 33565 - DNA, 263 bp, Oryza sativa
acctccggtaaacggtttaagtgagtttaggggtacacatttctgggtttgtggttaagggacctcaaaaaatatcgctgttaagttgagggacctccggtgaacttattccttatttctggtccatttggaaacccacgaggcagggatttcccggcccaatccgcggggaaaccccagggaaaggaacccgacctctcgaggtcaggaaattttcctctcccgatccgccgctctctcgcgcaaaagcagcgaccaagagc

SEQ ID NO: 33566 - DNA, 1501 bp, Oryza sativa
agctggggtctgttggtatttcttaacgacattactagaaatataattcccagcaatgatgcagaaatacttctggtacattattgttacagagttcatctgcaagcgcacggatataccattgtagcattttacccgagagtattccaagggtatcatatttgtttaatcccgtgagaagattataatagagagaactatagtaataatttatatattacttataataatccaaagtctaagcaggggttaatataattcagagagtagagtgacactaagcagaagcattcatactcttatttataattacctaagctaagtggaaagaatatagaaagatcatattcctatacttctattacgcaaacatattatgcatacatcctagttatatcattacttagctaatgccctctttccgatgtcctcttggtgtttcgagaagccacccctgattgcagagtttcttacgacaatccattatgaccattcaaccagggctaaatacagaggagtaccctccccaggaaattaacttaggactatatacacgcgcggaggaaaaccggtactgagctgtcaccatcagcggcccacctcgcttccacaacatataaccccaaataataatatccagtaatataaacaccacgcttaaattaccaaatactactctaatatcgtcgtcatgacatagagtcatcatatacacgatgattatacgcacaccattgcatctcctagataagctagcatcataacaaatatgacttggatatataataaagttggtattcatatactcggaaagtaatacaataccaaagtggtataaggaagaatattctaaataaagtacaagtcttacaaaagaaggaaaagctattagagccgtactcgaattattccgaagactccgaggactgaagattatattctatttctattccactatactctagagactatactaaacttatactaaacttgagagatgaaatgaacttcttgcttgaggtgtgtcttgaaatggagagactgagggggtttatataggctggtaatgacggttggaaaggtcggtaatatccaccaactgtcattgaagatcaatcccagccgtctagccaaaccctgcaaccatcggcgctgcggctggttcggccgaaccctgggctggcccaaccggcccagttcctagcaggcggcctcctctcctgttgctcacttcggacttgtgaattttggtccaattgatcgtgtcatttctgagttcttggtccatccttccataagtctgattcttgacatcgtccgattgattgaccatctatttttatgtcgattctcctctattttatgtttattctttgcaagagattagtaatcctagtgctagtggaatatatattatttaaatacaaatatgcattgcgagcataactagttcttattttagtaatattgacgggcgaaactgatcgctaacgaccgtcaa

SEQ ID NO: 33567 - DNA, 1501 bp, Oryza sativa
gatgtcttttcaacaactaatgtgcaatcattaacagttggcacacaaatagacacacatgtaagcaaaggttaagtggaaaagatataatccttggaattttcaaataatcatctcggtgcaactggtcttaatctttactcttgtcacttgttgatccccaaaactgcaatttcacaatagataatatgtcaatttttttctcaattaatggttgcaaatcaaaacacaagaaacaacaagggacaaatttcgcgaatcatcgctgaagtgctaatgtattgcatccacaattatgcttctaggattctatacaagaattatgtatccagaattttgagggctattttcatgtactagactaatgtactttctacatgcatactgtattatgttaccagaattctacagtgctactaaggtaagtttttcatgctatgctgcatacaaagtcaaaattcctgaatcatttcccattgcatacaaccagataaataaccaccaaacaattgcaaacggagtttttaatggacacttaacaacattggagataagaagatcattaaaaactgatagtgattcagaattatgtattgcttccagaattctacaccagaattatgcattcataatttagagagctattttgatattttcatgtattccaaaattctatacagtactagtcaagtaagtttttcatgctatgttgcatacaagtaaaacattctgcatcctagggaacttgacatagaaaattctgcatcatagggaacctgacaacaataatatctcaaattctcaatcaaccagaacttaacatgatatttcccattgcaagtatagcagggaccaatacgaaaaatagttcatcatcctctagtaaaaactttctaatttgctcgtttgcagagcccatcacttttctgttagaaaatcagactaaaattacaacaaaaaaataaaacaactgattggtaaaaaaaaagagagcaagattcatcatggcaaacacaaaaggggcaagaaagaattatgcaagacagcataagcaggtctgccactaaaattgacagagcaatactgtacgtaaaaacatctcaatacagccactaattcttcctgcaataagagcaggatgaacaccaaaacaggtttaattgcaacaatttctttgatgtgctatggttcactgtctcatattcagaacacaatttcaattcagccatgttatatactacaattcagtgattgactagcacagacaacagttaaatcagctaaaatacttcaatgaacagcctactaaaaaatcttatctgtacaatgtactttgcaaacaaaaatcatcatgccatatactgtgcaaacaatgaataataacattattagggatacacatgcagatgcagtgcaacacgtacttgtccactactatattagtactcatcatgtctgcatatagctataatagtacccatgagtgctgtgcacaatacac

SEQ ID NO: 33568 - DNA, 255 bp, Oryza sativa
aaattttttgaataagacgagcggtcaaacatatgctaaaaagtcaacggtgtcaaataaaacgaaacggagagagtatatacgtctgcatgttatcgggcggaaaaccaacaagaagctagctaggctatagctggtcgtctccatgcatgcatatatatgctcgtacgaagacgcatgtacatgcggccgtctgtacccggcgtatatgcgtatgagctacgacgtcaagtgctaccgcgacgtcgtcgaaga

SEQ ID NO: 33569 - DNA, 417 bp, Oryza sativa
aaaataatgcacaactgaaaatctcaaatcaaagaaaggaataaaatgtgttcctgaaatgccagattgtgactgtaggtacaccagtgaagacgccggcatcaagaggaaattagtactgcatctagggcacaggtgtaccaatggtgagaaaaaaagacagggagatgcacagttgcaaaaccacatctggcaagaaaaggataattgcaaaatcaaatgaagtacaagaacagagcgcaatatgtaacaagtgcatgcactgttgatcacgaatgaattgcactctgcacagatcagcttcaccgtcgctgtcagcagatcaggattttgatcaaggaaaattcagttgtaccttgtcatgtataaacgtgttattctgagcaacgagtcattatccagtacatgagcagcaca

SEQ ID NO: 33570 - DNA, 1501 bp, Oryza sativa
aattatccagtttctactgcaacttcgcaattctgcaacacaaaatatctagctttttttttttttttttttgcgggggacaaaaatatctagctaagctgccgttcttccactaacccaagaaatggccggactgttcgcatcgtcggccgtgaaatgggccatcgacaacctctcctccctgctgccggcggcggcggcggcggggtcgaaccggggcctggacgcgctggaggagctccggatgctggagcggaccatgcggcggatccacgccacgctgcgcgacgcggagcagcgctggaacatccgcgaggagtccgccaagctgcggttggaggagctcaaggagctcgcctacgacgccgaggacgtggtggaggagtacgagtacgaggtgaaccggcgcaaggtggaggcgctcgagcggctcgccgccgttcatggcggcggcggcgccagcaagcgcaagcgcgaggaggtaaattaattaattaattaatcaactagtccggtcgctgcatctgctgacgaaatctattagactatcattagtggggtagtagcacgttgtctgtgctgtgattagtcatagtattttatactgattactagttttagctatactttgcaagtcccattcaggtcccaagtgtctgaaccctgaacaaaccccctgaagaggggataaaagcaaacagaaaactgtaacccctcttccatttttttttcccattagaaagctacaagacaagcactatattagtatattactgaattagctggttcagtactttgtcctagctgaatcaaaaccatcaaatggagttttctagcttggtattggtagtatatcgattcccaatgaagttagcttgaatcctaaacaaatgtgtctataggtagagacatgaaaagaatagtgaactgtcttcacggctgcacccagggttctgggattcgggccaaaaggtccgaatttcgtccattttggtgaggtccgagacacaatttcactcccatttcgtctgaatttggttaaaattgtcaaatttgatgttttgtccgaaatttctgaaattcgtccaattcggtggagcacgatttatatttgcaatcggatcccaaaaccctgtctgcaccatagatgactgaacctccctctttcaattctttttcaaaaaaaaggtacatgaagagcagttctccactgagtctggaatagttccagttccaagtgagttggctgacagaacaaggacagttattcagagattctgtgagatcaaagactactgcgatagttttagtttgtctgataatgatggggacagaaggattgtccctgatatcaatgctatgcggcagactagctcttttgtatttgcacccagaattcttggaagaaagaaagacatggagaatgttatcgcaaaattgctctctggggaaggcagccgtgttggaggttgcatgtctgttttggccattgttggtatgg

SEQ ID NO: 33571 - DNA, 527 bp, Oryza sativa
cactgaccgtgtaaattcctttgtcggccaccctccgcaacaatgttgggcctaggctgcccttttttttttgtgtcttttctttcttttctatatggtatataagggtagaatggtcattttattcataccgctacatgcgaggatgactcgacatgcttatgtggcattttttttgggtctaaggactatattaacctaaataataaatttggaggacttgtttggatgatttgaaacacagaggattaaattgagtccgaggcgaaacttcaaggaccgtattggctattcaccctttatttaatgataaaacatgtcacaacaaaataaatgatatttagttaaaattttgtaataagaaggatggtcaactgtcgtgctaaaagccaacagcgtcatgtattaaaaaaatagtgggagtgctatataatatttcatatctatctatattatgaatattgcattgaatagaccacttttgagcaagcaaccggcctcctcctctgccacctccgtccccacaa

SEQ ID NO: 33572 - DNA, 518 bp, Oryza sativa
  unsure (1)..(518): unsure at all n locations
acaccatcttcgaatctcgaaagcgctcactctagaccgcacacggagatgcaatccaccaattttcaccaagtttacacgcatcccgcggtgtcagaacatccatgacgccaatactgagacaacaattaacactaatctaaaccctcctgaccatccatgaaaagctagaggggaacagaaatccggaatcctacccatttcgcacaccgtacagcaccagaaacaaaaacgagccgccacagaaaaccccccgcccgccgcgccgtacagccgggcacgccggcggcggatcacgcgcacgcgcaggcagaatccgccggagaagcgcggggggtagaaaaaaagggaggggatggtgtcgcctgatagaagggttgctttggtgggcttgcctttgttgaagaagatctggccgccggaaatggcgatgtanaagaggaggtggaggtacgtcacggggccgtccctccacgcccccttccccccagccgctgcttccgccgcggtcctctcca

SEQ ID NO: 33573 - DNA, 1180 bp, Oryza sativa
agtgcgctagttcatcactataagccgcaatgcttctttctgaatttatttactgctaaaaggcctaaaacatttcttacttttttattacgtgtccatatctcattgagtttattattgtttaagacttgtaaagtatgcgtgttgcctgttcggatcgcgtgttagagcacatggcaggcgctcaaaattaggcagctaatcatccattgtccactagccacttgtgatgtttttgaaataattaatcaataataataatgtgcctagccctgtacatacatgtccagatgttttggctgtcatctcttctgctaactctcccttttgactttacttacttgctgagttcctcatcagttcccttcctctctttccaagcttgcttccatcgtcgacatctcctccttgatccgagtagctcgtgatggccggactacttgcctctctggccataaggaaagcactggagaagctctcctcctacctggcagcgagcctttcggcatcgtcgtcctcgccgacgtctgggagggcaaggcaggagaaggaccacgaggacctgaggatgctggagcggaccatgcgcaggatccacgctactctgcatgacgcggagcagcactggaacatcagggaggagtccaccaagctgcggctcaaggagctcaaggatctcgcctactacgcggaggatgtggtggatgcgtatgagatgaatcgccagaaggtggaggctctcaaggcatttgcaggcgccgccagccacaagcgcaagtaccagcaggtaaacttctgctagcttctgccattaatccgattccggagtggaaagataactaattaatcgacatatatattttcttggaataggaaagcgagggcttgttctgtgattctcatacggttgccattacagacgagttggctatcaaaacaaggaaacttattgagcgatttgacgagatcaagtattattcagacaactttactttgtcggagaatgatggagagatacggcttactcctgatattagtggtttgcagacaagctctgttgtctttgagaatagcattgtgggaagagtgaaagataagaacaacattgtagaaaagttgttgtccaaaagaggtgacaatctagctagtccggtttctgtcatggcaattgttggtatgg

SEQ ID NO: 33574 - DNA, 357 bp, Oryza sativa
gtgctctgatggggcaggctttgggcggggcgctgcgccgcctcgggcgccgccggggcggcgatcccgccgccgcgctgctccgttgcggggtcgtcccctcgtcgtcatcatattctgctccggggacgctgctcccgctgaaacaaccggtgggggattgcgggggctgccgccggagcttcagctcgtccgcttgggtgggttcccgcctgtggcgcagtctgcatcggcgtcagagcgcgggggccgcggccacggccacggcttgggaggcgcaccactcgacgaggtgaggtagagtagctagctagtggctgcttggcgaagggctgcgcattttaattcctcatttca

SEQ ID NO: 33575 - DNA, 1501 bp, Oryza sativa
cttattattccacagatcctccaagaataaacaagatttaccatcccccacagtgcagtttgaaatacccctgaaaatatccacaaactacaaaacatccctcctccaaaaagaccctttaggagcatttcatccctatgttgggctcaatccctccccactccctttctttcgtttcctctcctaggccaggccaactctccctccctcctctcctttcctcctagatcaggcgagccaagccgcctgtttagagagaaattttcaaatgatctctccgcccaggaaaataaaaataaaataaatatgaatgtaccagtgtactaagtacacaaagtaaattaatgacaaaggaatcattcattttattataattctcaaagaattacaaaaatacaagttccttggcgaatcatgctccacgacctatcagcgaagcggatctaacttggtgattgtgttgtcctggttccggggttcggaaaatacccgattaattactccaatgagtttaacttgtgacaccttcgattaagctactctagtcttcatcatcaatctttgcttcgcattctctcgtgtatgatgtagatgcgatgaagtgggcgttggtgggcgccacagtagcattcatggacttgtcagtccgtatgccggtggtgttggtgatatcgtctttgtgtacattggtacattttgtgattatccaatgtttgagctcacatgttttatatgtttctttgtgattgatcggaatgtttcagtagagattcttatggtctttcattttttttactctgatacttgtgcatttgttgatgtttcaacagttgaatactgatgcttctagtgcatgagtgaaatgcttaatctttatgcaactatgtttcaccattttaatcctttgcaacattttttttatctagaggtgcagcattttcatataagccgtgaaacagttgaactcttaatacttgtgaatgtaatacaatgccagttaaaattgataagaattacaaaacagcgggagtacgtagtattttaagtatatactcattatacttttatttgcaattaatttggatatgatatcaaatctttgcgcttcataacttccttctttgtcatccaaatgtagctataaaagtagcgccttagttgctttttcttctctcaacatcaccccatcaagtacaccaaacatagaggtagttagaggtcgatcgatcccattacttgctttgtgcaggcaacgatgctggacgacgagaagaccatcctcgagcagcagattgccattggaacagcgaggctggaggaactgcgacgcaccaaccgtgagttggagatcaagctcatcgtctgcgacctcatgttaggccgtcgcaacaacttggatgacctgaccatggacatcctccaggttgtccggatggctattgtgaagtactgcctggaaatacggaaacgtatcaaggagcttcgttccatggatttctcc

SEQ ID NO: 33576 - DNA, 355 bp, Oryza sativa
  unsure (1)..(355): unsure at all n locations
gtactattcgtgtntgctaatggatcccaatcatgctaaggctaaagtttcttaatctttctattgtcatcgtggcctatttaggagttaacctacatagcatttatgggatacatatatatttggctaatcagtggtttagtctatcaagtggctatggaaggattatggctaagcatgcatctatctacataggacggttatttactagaggttctgttgttagatggatttaggatcaatcaaatagttatagtgcatcatttgtattattattttattgatggaagctttactttaattatgaacatattttacttgtcacaataaattataaaaggttaataattatcca

SEQ ID NO: 33577 - DNA, 1501 bp, Oryza sativa
ctgatttgatgcggcttattggggtttcgggaaatttcaatcttgtttattccctttgcttacccatggggagtttcaatcttgtttatcccctaattcttgttgctttgtactagccgaaaccctagtttcggtctaggaattttgagtgcggaaattgggaatttccttttgctaaatttaggggaatttcaatctagtttatccccttcttaatttgcttcggcttagggtgcggggaaattgggagtttcaatctgtttatcccaatccccttctcttaatctccactgatggataaccaattaaatagaaaacttgaattaaacagcttcttctactgatgaccgagaccaatcagtataacatggcttaatatgcaaccaagacttaaagaaattaatctaatctaattcaaaattgttcatgccgaatcaatcttgaacctttttttagggatggcttctaatcacagggatgatgtgattatgagggattgagtggactaaagatcagctctgataccacaatgttggagttcttattacaggatattaggctttagtctacaaacaatcacctcttacttatgcggaaaaataattgatctactgacctatgtttgaagccattgctgttctccttttcttcttcttctagagatgcctcacgaaccccttccagtgccttgattgatcgggcaattaattagggttcgaaattagagagagatcagtcgtcatttgcctccttccttctctttctttatatagacgacactggtggggctcgggggttatctcaattagtttagaattcgttttctgtaccgatcacacaagaaaacaaatttgtctcttagtttgtttcttgttaggataaggaaaccggtggtttagatcctctcctaacccttatcgacataagtcgataaaatcaaccaacaaagatgacttatcggcaatttcatgcctactcggtagtctgagaacggctaggttattttgacataattacgatgcatatatagatggctttcatacgggaattcaaagtcgtgcaacgcacgactaagtggctagtgtcatggaagattttgaccactgttctgatatatatatatgcgttcaccacacgaagcacatcacgtcggcaagtatatatatatgcatatacatatcctttgaagattttgcaattagttgtaaatgcgtagtccagcttacaagtgcacatttatgcattagttcttgggaaagcctacaacaggattgcaggagcctagaggaagcacgccagcgaaatagagcatataagcaatgccaaaactgatttgcaactgcacgcatactactaccttgagaatcatccaaaatggatgaactgaaaatcgagcaggcggaggccatggtactttctgccataacatctgccagatggagaaaccggaaattgacatagttctgaagttatcccaaatttgcacataaatggatccagt

SEQ ID NO: 33578 - DNA, 299 bp, Oryza sativa
attccaccaacccccttcctttctctctccctcttctaaacaaaaacatttcccgttttaatctcccacacaccgacactctcctttctctctgtctcctcgtgaaaatctttgtcacaaaaaaatttaaaagaaaaaaaaacacacccttcgctgacctagcaacgcggaggaggctgctctgctctctctccaacaaacaccattattataccaccacctccccttccccccatttcctcctcctcccccacgcggcgcaccagctatcgccgccgccgccgacgaggagggtgcga

SEQ ID NO: 33579 - DNA, 1501 bp, Oryza sativa
agtctcaggtgcaaattcaaaactttcttcaatgtttgccagatacgtcttaatgtcattagagtcaatgatttctccaataacttctagagagatggcacccttgacataaattaagcacattctgttggacttctcccagttggctaacttcttattgtaggcccacatgagattatcatattcttccccaattatattgagttcttcggccggttgaggttcctcgggaggatcctctcttatggctaagtcataatccaacatggctaagttaataagcacattatttctccattcaatgtaatttgatccatcaagaagctgaatggccttaagctgtcctaatgctgaaaaattaattattaattaaacattagtaatgcaattaatttccattggcttaattaatcacatacaaataaatcttaattttcataatcaaacaccatagggtagaaaggattatgaaatggcagagaataatgaattactgaaaatcaatatcctaaatcaaattaccaaaagtaggtaatatgatatagggcataaagccattagtaaatgacatgaaattaaaatccttagccatatcaccgttgggcagaaatggtaaaggaattaagcttagtaacagattagagatcattgatcatatcaccgtaaggcacgagtgacagaggaattaatgcactaatggcataagtaaaattctaagtcatatcaccgtaaaggccaagatgacaaagaaaatgaaattaatgattgacgatacttagatgtttccttaattacatcaccgttgggcagaaataattaaggaaataataatcttaatgaaatcatcttttttctagataaacttcccgttggtccattaatctagaaataaattactcagtattgcaactgatcttaaataataagcattgccaattgcataaaatttacattggcttagtcgatcatatgcaaaataaacttagaatttcatagtcaaagcaccattggtcataaataattatgaataatcttaaaatcaattcctcaattatatcactgtttggtagaaaataactaaggaataaaaaattataattgacacgcaatcataataaagtgggttgaatataacttcacatcttaatgctttctagtcgaatttctcgttggttccattcgactataaataattaatatactaaggaaatgaccatcataatgatgttgacatgaaatcataaatactttctagttatatttccattcaactagaaataaattaagtggcttaaggaaataataatcttaataaatattgacatgaaattatattaacgttggtcaaatataatatcatatcattaatttctttctagccaaacttcccgttggttccatttaactagaaataattttctaagtgatcaaataattgaccataattttccagcaatttatatggctaagaaaactcataaataaatttctggaaataaat

SEQ ID NO: 33580 - DNA, 990 bp, Oryza sativa
ataatctgtacccataatatgattaacctgaacaactctaacatacaaagcatggataattattaaccttttataatttattgtgacaagtaaaatatgttcataattaaagtaaagcttccatcaataaaataataatacaaatgatgcactataactatttgattgatcctaaatccatctaacaacagaacctctagtaaataaccgtcctatgtagatagatgcatgcttagccataatccttccatagccacttgatagactaaaccactgattagccaaatatatatgtatcccataaatgctatgtaggttaactcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggtagtcgtgaggcaacgtctgcaacttccaggaggtgaaggttgatcaagattatatcaagaataaggactatcctgagcaaggcaagtcatcactattccttgaacatgttgatcctaattgcgaaattgttttgtttacaaataaaattgcatgcaatcatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacataatttgtgaaaggaaaataaagtaaaacaattgttttcgactggggcggctggaggatttgggtggtgtccggaaaaggctagtgccgtccctggtcaattaaggaccgagcca

SEQ ID NO: 33581 - DNA, 174 bp, Oryza sativa
ggggtgtgacaggcggaggcattgcatcacgtgagaaaccttagctgtcacttccctccccgagcaaaaccctagccgcgcgcgggtgctagcacatctgtgcgtggcgttccgtccctgtacgtgtggataccagtaaaggctctgctggtttgcggtgctgatcggcatagg

SEQ ID NO: 33582 - DNA, 427 bp, Oryza sativa
cctgcaatctatagattgcagactgcttatgatggaagcctgtttgcgaagctggtgaaggcgaggagataggagcaaaaccaggcatgattgttgacagctgacgagagcttctgcattgatcctcctaattaagcatctcagattatgtgccactgtgctatgtgaacggctgactgtgtattcttttactccctctctaccaatatacgagacaaagcttttgccctcctttaaaaaaaagagaacaattgagattatgtccttttttttcttttcgagaatacgaggagacgatttgtaccggattttaaagatgagggaggccctatacttggttgtgtgattgatgcttgatgaggttattcaaccagcagatagaaatcagggatgctaaatagacttattcagcaaatatacgcttgga

SEQ ID NO: 33583 - DNA, 1501 bp, Oryza sativa
tccatgggtctatatctcttcctcccacgcacacgtatcgctctcccatacctttcatgtgtcaactgcactcccccacgcatgcatgcgctcgtattgagtcgccacacaggtatcagatctgatgtggtgtcagattcaatagttaatacttgagataccagatttggttggaatccgtatcagattcgatacttgatacctgaggtaccagatctggttggtacccgtatcagatcgggttggtacccgaggtaccagtctgctaccaaaggtatcagatccgatatttgggatatcagattcggtacttggggtatcagacctgataccatcgtactaaggtggatagtacctggtctgatatccacgaggcatcaagaccagtagttgtatattagacttggtaaaaaaaaaagtatcaaagcgtacctagaggtatcgttttgtaccaaacaagtcattttcttcctctccccaacacaatatggatgtgttctttcacacatttttccaacccacatctctcattttccgcgtgcacacttttcaaactagtaaacagtgtcatttatgcaaaaaaatctttctatatgaaagttgttttataaatcatattaatccatttgtcaaaaaaaatagttaatacttaattaatcatcaaataatatgagcttcgttttgcgtgcagcctctgccgtcgtcgcactcatgtcggcttcttggggacggtaccaatggctggcccagatggcgttgcggtcgacgtggcaagaaaagagctcccggtggcaagtggctatagtggttgtaggcacagagagggtgatagaggacggagggagtagcttgcacgcggtgggtggtggtgcgtggatgactttgtgtagacgaatcaagataaggtgtagagcgttgatcattagtctatcctgttcggacggtataccgtggtctaacagttctccttttggattccatgacgacggaacaaatcacccggcaaataactctttaatttccgtgcgtggctagcaaataaccgttgcaacggattttaaaaaaatgatgttggatagactatcaaagatccatgtccgtccttgtcttaggtgggcaggcaagcccaccacaccacatgcaaggcctacccaggccagaaacccatacgctccaggcttcaacggagagtagacaggcctgcatgattttataagagcaggtacaatagcaggatataagccggctataaccatatatcgagaagaaaagagaagagagagaagaaagcggactataaatttgtagccggctataacacggactccaagatgttatatgtgtatgagaggtgggaccgggtattagtagtgtagtatatttttatagttaactattgtatgaaattagattggctatagatgtcttggagccagtagttggctatactattaaccttgctctaaagcgatacacggaaatacttcgcatcggatacaat

SEQ ID NO: 33584 - DNA, 1501 bp, Oryza sativa
catgaacaattttgaattagattagattaatttctttaagtcttggttgcatattaagccatgttatactgattggtctcggtcatcagtagaagaagctgtttaattcaagttttctatttaattggttatccatcagtggagattaagagaaggggattgggataaacagattgaaactcccaatttccccgcaccctaagccgaagcaaattaagaaggggataaactagattgaaattcccctaaatttagcaaaaggaaattcccaatttccgcactcaaaattcctagaccgaaactagggtttcggctagtacaaagcaacaagaattaggggataaacaagattgaaactccccatgggtaagcaaagggaataaacaagattgaaatttcccgaaaccccaataagccgcatcaaatcagtctagaattcccaaatcgaagaacccaaattttgggaagaaccctaaatcccacatacccgtatcaaaactcaaatcaaatcaatctaagctagagttttggttcacttacaagaattgcgaaacctcctaagcctaccggagcactccgggaagcggcgtcgctgccttcacctcctcgcagccgcgttgggttctctgcgcgcgccgtcttggagtttacctccaccgtccctcaccggggacaggaagcgtcggcttggcggctgccttcgggttcccccccccccccccccgccgacgaggtctggccgtagcacacggcttggcgccgccctcgggcacgccccccagccagtcgaggtggagccgctgcggcgctcgccgccacatgcgcgcgccacctcgccggaccgccgtcgcaacatcgccgccgattcgctcgctcgctcgccggacgccgaatcgggggagagaaggggagaaatggggattagggttagggtttgacccgttcagcgatttcagcggcgaaggcgaaatcttggccgtctgtttgatcggacggccatcctcgctcccgcgtcgggccgtcgccgtcatgggccgcgccgatctgggccgagtccgcctaagcgccgcgcgcgcacataggtaggccggtcctttttgggccggcttatcgataagaatgcgctttttattttaatttattattaagcccgcgaatttaatttctcagaatttacttagcccattttatgggccagcttaggaagtgatgggccgcattattattttaagcccgccatttatgtcttatttatttccagaaatttatttatgagttttcttagccatataaattgctggaaaattatggtcaattatttgatcacttagaaaattatttctagttaaatggaaccaacgggaagtttggctagaaagaaattaatgatatgatattatatttgaccaacgttaatataatttcatgtcaatatttattaagattattatttccttaagccacttaatttatttctagttgaatggaaatataactagaa

SEQ ID NO: 33585 - DNA, 1501 bp, Oryza sativa
caaacctattcgaatagccgtgctcgcggttattgagcaccgggacatgtattacacttggctagactctaaattcttaacttgtgtgggatgggatattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatacaaactctggtactaaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagtgggagatgaagcctcggaggatccctatgcctattatcaggaaggagatgaagacgatggcgtccagtaggtcttagcacggtcgttgcctgtggcaatggcatgccgctgcctgaattccgctgccttatctatttctgcttttggatgtattccggacctctcggtccgatgatttaaggctatgcctgcgggcctatgatgtaataattcgtattaaacactcgtgtatgtgcacttgatattccagctatgaattcgtgtgtaccaaactacttgatccagggaaatggtactgtttacacgattgattcctgttataaaaacgggggtccacaattggttaactagaatgtatgtatactatgtatattagaagtataggaatatattttctttatcttttctttccacttagcctaaataatatattatgagaatgagtaataatgcttgtgtgtcatccctgcttagaatatgattatcacaagtaatatataaattattagtcaatgttctctctacatgatcttcccacgggttaaaataaatacgatacccttggaatactctcgggtgaaatgctacaatggtatatccgtgcgcttgcggataaactttgtaaccataatataccagaagtatttctgtgccattgctggtaattatatttctagtaatgtcattaagaaatatcaacaagcatttctagcgccgttgtcggggaagattcataatagagattacttgaactaatactttatatttacctctgtataatcatttttctttgcaggctaaccttagttgttttcacttttgttgtgaaaatagggtagtgcatgactggtttcaacttgccggaaaacttcaaagaaaatccagaagctttcttccagagcgtcacgccgcgagtcgctgctccgcaaaaaactctaccgacagagaaactagccgtactagccccacagaccttcaagattgtggctaacaaggctctccgcgagtttgctgctccctctgctgacaacgtggccattgggccgcaggtcaacataggggacgtggat

SEQ ID NO: 33586 - DNA, 1501 bp, Oryza sativa
atgccttgcagtatattaataatagcaattctacggtccttgaggaggtaccatgagataccaaaaatttagtgtaaaatttggtacctcatggtaccttatagtacctaggtacaaagagttaccaaatttacaatagaaaaagtggtacctcatggtacctcctcaaggaccgtaaaattgctcattttttctattatatatccataccaattgaaaagcatttgggtagtaactttctattatctcggtgatgactgaagggttatttattagatttctgtactgttaaactgtatccaaatctgaccagaacattatctttatcctgaaagaatacatacagtcatctttatcctcgatatggcgtttctgatctgctacttgccttcccccacatcgtactgcttaagtccatgacccccatatatatcttcaccattcacggtcgtgctcgtggagtcctcgttccgatcgtggccggcctcgcgctcccatctaattatctcacgatcagaagagaaagaagtgtctcgtttctatcaggattgagatcgtacgaatatagggaaattaccggacagacatggatagatagatacgatcgatggcctatcatgtacagtatatggattgaacggctggcacattgtagttagaggcagagcccgcaacattagtgtaaaatcaaatgtgtttttgattattattctatgataaacaattggcattgaagattgttggttttggtatttggaatttattcacgaagtggttttggagatgattggatttcacaggtgatctacagaatactgctgaattgcggtccggtcaaaccgggctagtgcggccggtcaaacctgaggtatatgcgtggtcagaccggcgcagcccgcggtctgaccggccgacgctatgtcggtttcggtttcggattgtttgtttggatatccgtgattgtttcatgattatggcttctagatggatactatacgtatgtaatactgttgtttgttactaatgagtcaagttggagatagcttggtcttggaatatgatttctttgtttatttcatgtgtaggtgacttgatgccttgggagagtatttgcggtgatggaccgggagttggcttggggataagacgacgtccgtggtggtcagagatcatgcgggatacttaggctagagttgatgcacatggttgatggagattccatatggcatacgatggaggtattgtgtgcgtatgggatgcggagtcgaatttggaaggagtccaaatttggtatgattggttatgtaaagtttgtttcttgtactagatggtttcctaaggtgtttaggacttctagtatgagtttggttcgtggctttaggctgcctacctcgggtataaatagagggagagcgtgaggcttcccggtatcgcttttgagagcaattgagttgagttttgagttagggtttcgagtttagtcgaaatttttgtaaggagt

SEQ ID NO: 33587 - DNA, 449 bp, Oryza sativa
gcttttggatgtattccggacctctcggtccgatgatttaaggctatgcctgcgggcctatgatgtaataattcgtattaaacactcgtgtatgtgcacttgatattccagctatgaattcgtgtgtaccaaactacttgatccagggaaatggtactgtttacacgattgattcctgttataaaaacgggggtccacagagctggtatcagagccatacgactgtaggaaaagaccaaaaggcgccccacaccttttctaagttggccaagggagaaattcccatttagcaatactttcaaaaataaaaactctatgtttacaaaactcggtacacttttcatcttactcttaactatttcctttacaaagcaagttttactctcgactgaccttgggtttttcttaaaattagatggcagattcggattcacccgctacctgggagt

SEQ ID NO: 33588 - DNA, 375 bp, Oryza sativa
gcccagcccccagccctcattcctcacctctcaaatccggtgaaaaaaaaagaagagaggggaggagaagagacgaaggggcgaagccctgccggattcagacgccgatttcaggtaatattcgtagatcctatatgtgactattgagttaaatagtgtgtatttttaaaaaatttgtttgaataaatgcattatatttttatggttttagttgtactaatttagaagtgcgtattgtagatatcggtaacaacgtagatctgctagtttggaatcaatactttaccgttgcattggcttacacaagaagatattacgttgtagatgtttattgtatgaaagagtaatatgatctatttaattcgttgacagata

SEQ ID NO: 33589 - DNA, 383 bp, Oryza sativa
gggcccgcccgccaccctcgctgacgggtggggcccacctgtcatccctgtcctcccgcggctcccgcgcgctcgcccgtgccctagcgccgcgcgcgccgccgcgaatcccgccgcctcccgcggtccacgcacgcaataaagtggggggaaatattccctgtgattccctccctctttccccccatttttccctccctctctccctcggattcgtttggaaacctctcccctaacctcgccggcgccatcaatggcggccggatcttccgcgcccatttccccctcgtccggtcgctctctcccccttccaaccctatataaaccctccccgcacctcctccgttcgtttccgcctctcgccgctctctctcctcgccaga

SEQ ID NO: 33590 - DNA, 968 bp, Oryza sativa
ccccaccagagggcggcaagggttttcatgcaaaaaaacccaccctccgtcaccgcccgtcctcccccgtttgccacgtcagcttgccgcccaccattggggcggcaggatctatttttgcaatttttctcgccgatagattatttctgtaaatattaaaaaaaatctaaaaacgaaaaaaattcttccctcccatacacccacgggcccccgtgtattgcaaatatacacactaacacacatctttgtaggccacacaaaccagatgaaagcccaaatactaaagcccagttacttattcacacatatacaatacactagcaaaaaccctaggtcacactcgagaaaatggacatttggccacgttcacaacagggtttcgctattatgccattctcaaaacgtgattcgataaaatgccaatacgaagtacacgcttaccgccatattgccatttgtgccattttattcatttccgaaatgattttagctcatccgcccgatgataagacggaaatgcccttgctttgccaccgcatctcggctaccgccattggaccgagagaggaaaggtggcggcatggactactactgggagagtcagggcgcccccgtgtcggaggacgctggagcggaagcagtcggggagcgaccagagaaccgcggaggagtgtgagtcggtcgccagggtggcgcgaggacagcgtctcgccgacagcgagcgggcctcgcggttgcagccatggaagatggtgcctcctcctccccctttacccgcgcatcaccaccacttcctagtccacctcgacgcgcagtgccgtcaccaccgcctcccacttcaccgcatcactccctacttaactagtactactagtactccccccagcagcaagcaagcagcagataagcatcactccctcccactccaaccaccacatcaacatcagcagcacatcgatcgatcgcca

SEQ ID NO: 33591 - DNA, 664 bp, Oryza sativa
gccataactggccatttgaactcgaaattggaccgttcaagtctctatttttctttaagaagtcaagaagccattttgtgctttgttcctgcttgttatatgagtttatagagtaaaagtttttcttttccgttggtcgtgtagacgctgcagcttcggaagatccactcttcgtggaggttaaagccgacgtttgggaaagcgagcaaggcaagtcacatcatccttgagcatattgaatcccagtttataaaattattttaatttaaattaatgcattaccgctttatttaaattcccgcgttatcactgttttatttagccatgcctatttacctttgttaagacattattattgctattgttattattaccttgttcacccttggataaacaaaaccccaactagtgggtactctattcatggttccactagtatgaatttaggtagatgcttcgctgattaattaggcaacattaggtggttttataactttagactttgggaattctcatatcatttggacactatgtaatggttggcttacgttggaagtggacacacacctccccctctattcaaaacacccaaaatggttttaggctgggctcgaggtgcgtggttgggttttgttagtcgtacctcgggtactataaggattaa

SEQ ID NO: 33592 - DNA, 1501 bp, Oryza sativa
tcgagagacacaagaaggacagtttgctagcaattgtgaggatggtgtggaagtggaaggtgatgaggaagggaagctgcagctaggagacagtgaagagctttttgattcacaagattccgaggatgcctttgccaaaagcttgggagtggtgctacctaaagaggagatgggaagtcaagaggaggaaagaagggcaagcaagagattcagagacagggaggacaagaagactctagagatgacaatgaataggaaagaagcacaaaatgcattcctcaacaaaggtcagggctcatcccctcttcatcatgattcaagtatttctcttgctaacttagctagtcttataggagtcagccttggctgctctattgaggctgttgattagctggtagttgaggacgcaatggtgaattggagagaaatgagatgagttatggagagatagcataaaactctaaggcctgcataaaactctaaggcctgtgctagctggatttcattttgtctctgtttcttttgtgagcacctgggggttcttcctctctggttttccaagactccttttttgtaagaactcatgcgtttctttaatggaaatggagggctctgcccttatatatatatatatatatatatatatatatatatatatatatatatatatatatatatatatatattaattaaatttgtttggtactccatggtgcccgggtaacatggttgaaattgaatatatatatatgtctatagccaactacttcatcagattgatcatcacataacaaaaaatcagaatttccaaatcgatcatcacataatcctggcctttctttctttgacatacagcattattgcatctatgcatataaattaagttatcgtttcgtgtgcattcgtgggagttaaagtctgcatatattttttatttttttacaaccatattatcgcactaaatgaaatataggagagttaagttttcctttgtttagttgaaaaaccttaattatgtgatgatcagagagggacagagggaatattgtcttagagtaagtttaataatatatattactacaaaacatcaaatagatgtcgccactatagataccggtagtgctaaaaccggcacctataggccttttcccacctccgcgggatgaaatcgtaaaaaaccagcacctttaagtaattataggtgtccgttctaaataaaaactggcacctattatattttgtgtcggttttttttaaaaaataggcacctataatatattataggtgtcggtcaattaaaaaccgacacctataatatattaaaggtgctggtttttttaaaaaccgacaccctaccaaacgagccgagccgagagacgaccttatccactcaccgagtgggaggtgagggggcaaccttatcctatcacccgtgacctctctctctcaccctatcctttctctctcagcctctctctctctctctcgcacccgagggagg

SEQ ID NO: 33593 - DNA, 860 bp, Oryza sativa
cccatggtcgggttgccagttcggtctgaatcatcgtagaccttgggttaaggcaggttcgtgagggttcacggtcttggttaataatattgtgtagctctaggatcgtctttatatatggctttgggcaactaagtgactcttaaatgctgtttctgcaaaacttaacccctatattattaccccttgtaccccccttgcattaatcatgcatctgccggtgtggcttgctgagtactgtggttgtactcattcttgctcaatcttttcccccccttcagtaagagaagctttggagaagaagtcttaggtggagtcctggcttataccccagttgagcgcctgtggagatggagccgtaggcccgctagtccgctgctgtttatttttgattgtcaggccttaagtgcctttgtaataatgtaaatattatcgataaaataaagatgtgccttttgtaccatgtttgtgtggtgtaccccggcttttcctgggacggggattaatacactagcgttcgggaaaatgtatttttctcggtcgcgacaagatcacaatgggccacgctgataatagaattgggctgaagtactattttaggcccaagcccattagtactcccgataccctaataacaccaaagagaaataaaacgtctcttcgtcttccccgccgagactcttgccactttccccatttcccgctacagtgcaaagatgcgccggcaaagctagggttcatcgatctgctccaatccatcttccaaaactccgcaaaaaccttccgcgcaacaaccgcaccgatcccccatccactcccatccatttccaaagcaaatcgcatcacccaattcgcatcca

SEQ ID NO: 33594 - DNA, 377 bp, Oryza sativa
aatcaaatatgcgcaacaaaatgtactattcgtgtttgctaatggatcccaatcatgctaaggctaaagtttcttaatctttctattgtcatcgtggcctatttaggagttaacctacatagcatttatgggatacatatatatttggctaatcagtggtttagtctatcaagtggctatggaaggattatggctaagcatgcatctatctacataggacggttatttactagaggttctgttgttagatggatttaggatcaatcaaatagttatagtgcatcatttgtattattattttattgatggaagctttactttaattatgaacatattttacttgtcacaataaattataaaaggttaataattatcca

SEQ ID NO: 33595 - DNA, 322 bp, Oryza sativa
  unsure (1)..(322): unsure at all n locations
gcagtgnnatganancattttgaanctagctggccccttgccggtctagctcgctcgctcgctcggtttgtccccttgtgatctctgcttccaaaacgggctgacccaagtttgaattgaatcgcgacaccaaccacgcgctgcgcgggcacgcacgccgcgattgacttgtagagtcgtacgtccatgcaatatattgcagccaccaatccaccgcccggttaggcgcagcggcgtattggcatcatattggagtagcggattagccgtgctgcgtcggatgcgcgttggcagcagttgccagttgaacccaccgtgacca

SEQ ID NO: 33596 - DNA, 970 bp, Oryza sativa
tgtcgttagttgcgcatctcacaaacgttgtatcttcacgaacttgtcattaccagccattgtgtcttcacgagaagcttagttctgttggcattctcgactagtccgatgtggtctacgtaatacctatgtgctctatgtaaacaaaatatttattcgagtcaattgtgagcacaagagccaatagttattaaacggtgtataacaatacttacaaattcaacaaaactagaaattccgtgaatgtcttctaggtgtagtgtgccagatcacgcactacgaccaagtagtcccatggatataccagaaataatatatagtggtcgctgcaaagaagatatgttaattataggtgatattgtagtaaaaaaatagtagtatggaagaaatatgtacggcaaagtggacattttagtcttggtgcatgtgcatcactttccccaagtacattgctacattgatcctctttttcttgtgcaattgtttgatgaaagctttttttccctctgttttatctttcaactccagacaatctttacgaagttcaaccatgtgttccgtccagcaaacccttgttgggtttacgtatcctaccggtctgctagcccttgcgcccatcaaggaattgcatcctaagtaatgcagcgggtaatttatcagaagtgagtttgcaaatgaattcatttatgtcataaaatgtaaatcacttataggcaaaacgcggcaactagattgatgtccattttaccgagcttgagaaatgtgtgaaggtcgttaaaatagataacgagcatcccattaggtccactaatggaagcgttatccgggaccttcatagtaatcatgtcgagtccctttttagatgccttcaagtaccaatcatgtatcaacctcatctcccatggtagattttccatgacatgccatcactggtggagaaaccctttgtagtcccggttcgtaacccccc

SEQ ID NO: 33597 - DNA, 1102 bp, Oryza sativa
atattgaattggatggttgatttttgtttagcaggacatgaaggaatagccatagacaggttgtaaattcccaaacttttcattagtaaccatgtttggttatctcgggaatatttttcaatgtgtatatgcaataccataccttaacatgttataataaagttatcaggtcaaagcagagattctatccagaaaaagggaagtgttctcaattttccatcagtgataagtacaaaagtcaaagtgtcctctgaataccggtaattaaattattagctatttaattttgtttgaagggatcgtgtactgcagaaagctgaactcaaggttgaaaatggatagatttagaaacattaccaaatagtataacttttaagacatatacttctacagaaatagcttacagcacaaagatgtcatcatctgctcgcagagatgctctattgctaggaataaatgctgcagtaattgtatggttttcaggttggatgctacatgcagaatatgtaattaaccatgacatattgccataaaagattgtgaatgcacctaaatgcaatctgagaatacaatttgagcattcagaaaggcaaagtcctaaactcccaatctactgattaaagaagtaagcactataggctaggtaaaacacttcccattttacgcactaatttttcctgtcattggggcacacgatataataatcttgccgtgtaaataagcaaacatatgttgtaaccacatattcatgactatggaatggcccacaaaaaatgcatattcactaatcacaaatcggcaatgacattatgatagtagtctaatagacaatcacaaatcgacaatcaaaaataacaaattgatagcacagagcaagtttcaattaaaaatcagtatagagcatattaggtaaaggagcagacctgtaaagtacctgcaggggaaggccggaatcgaagggcgaaggccgaaggtggcaccggcgcactgctactgcctgctgtgctacacgccacgacctccctggctcccggtatcggcggccggtggctggctaggcggtagcggcgcgacggatagcgggagttggagcagagattta

SEQ ID NO: 33598 - DNA, 1501 bp, Oryza sativa
gcaccacattgtcaaatcatggagcaattaggcttaaaagattcgtattgcaatttacacgcaacctgtgtaattatttttttatctatatttaatactccatgcatgtgtccaaacattcgatatgacagggtgaaaagtttttgcgtgggaactaaacagggtcataatcgagtgatgcattcccatgctcaaacttgcaattccttttgcacaagacaaagagtcaatgacagatcgacaaccagatgatatgaccacctgattgcgcaacgtattaatgctagcaatggtagttaggagtacatgctagattgcatgaggaaatcttagcacacccacaacgaagagccaaagtttcattcagcttgaccctactgcttaggtgttcagaaactgatacttgagctgcctatgattctctgacccttccagttttgccatgacaaacaacaggccaatttgggtttcaggtgcatgaagatagctacagcctacaggggctaccaaaatcatcatttacgcaacaaccaaatggggtgatcaatcagcatggacatgaatgcacttgacaaacatcttaaatccttatcacggtaagccagtaataaggccccgacaaaggatacgtgctactggtacatcagttatgactgcgttgccgtgagaagcatgtgcaagcattgtgcgaatgcatttactccaagaaccaacactgctcgacgcgatcagttaagcacctactatcggaagcttaattagtcatggcaaggaagattctgtcctcactgaagaacagtctcaggtaatctaatgaacaagtggagaaaaacagcagcggacaaatgattaatcagttaattccattggctaatgcatctttgggagcaaactgactactcgagggccctgttcttccagatacgcaagctaactctacaaccaatttgcaggtacagtaatggagttctggtacttacgcaaggtaagtacaccggctaagaaatgtactatactaaccttcttgagggcgagggcgaggcgcttgggctcgagccgccgcggggagcgcggcatcccggcgagctcgtcgcgggcgcagcggaacgcgcgccgctgcagcgcgggcggcatgtcggccgccaccaccctcaccaccgccttcctctcctcgccgccgccgtcccccgcccccgccttcctcggcaatcccccctcggcggcggcggcgccctccgcgatcgcgccgaggccgagcagcgccctgacaaccccaccccggcgccccgccgcctgcaggccaccctcctcctgctccctcatgctcggtcgccgctcgccgttcccgccggccgcgccgggagctttgactcaccggaagcagagactctctctcactctcctctctgtgttactgtgtatgtgtcagtatgtgtgtgtattattattattatttttttggcgcttgggcagcggttggggcggctttatcgttcgttgg

SEQ ID NO: 33599 - DNA, 519 bp, Oryza sativa
taataatttcaaaaaattttgaataagacgagtggtcaaacgttacaagcaaaaactcaaaatctcttatattatgggacggagggagtatatgtgtggagctttccaagtccacaaaacatttaagttttcttttacctatcagtatatgctatattattctaatatgtgcatagatatatcttactccgttgcaatgtctctttgtaatttcaaatttatttttgtatagttcaaataactaatgtggttacaagcattacccgcagcaacgcgcggggccactgactagtttctaatatgcacacatggctctgtggccaatctccttgcaatgtgctttatttggcctttaaccttgctgtatttctaacatgcagagaatgtttttttttttgaaggaaaaaatttggaatactaagaaggaatttagcattcaatattgatagagaagaaattggtgagaaaacctgcgttcgaagggattcgaacctaggccagcacgttgctcctggcagc

SEQ ID NO: 33600 - DNA, 173 bp, Oryza sativa
ttggattccttccatatatgtaattcttccttatgttctccccatgtactcctatatatatcggcccccctgaggctcaatacaatgtgtccaatattccagtatcctctctccctatactatctaacactgccgcgcctgtgccgtctgtgcccgcgctgccaccctgtagc

SEQ ID NO: 33601 - DNA, 276 bp, Oryza sativa
aacgtgccatctccaggagctaacacgccggttccggctagggacgagtgcttggaggctctcgtcctgacgggatggggcaaggcgtgcgtcagaccgcctgtcgccacctaacccacgatctgaccggtctgtgaccggtcacagaccgaataaacgagcgcgctgcactgcgttacatgcggcgtgacgcgctcgtccaaaccgtaataaatgtggttaggtgagccccgctatgctcacctaccccatatacgcggcgcaaaacccacaagg

SEQ ID NO: 33602 - DNA, 1501 bp, Oryza sativa
ttcattcaaaatatgcactaatgttagctcggctatgtcacgtctattaatttcattaagttttggtctctactatgtgattgggagctctttttctctgaaattttatgaaaccatcttcttttttcttttaggtgtttaacagctccccaatctgctttcttcctgagaaagcctcgttgtgtagtgcccgttccgtcgtagcgcctagctaacatcgtcagatcccaatcccccaatccatcgtcaagttcgaattccaacttcaagtcccctccaaatcaaatctctcgacagaagtctatttcgcctccctaaagttttgtgggccgagctccctccctcggcacatcttctccctcagcccatcccctcctctcgcacatgccgtgcgagtgcgctgagccgagccgagagagagccctctctctcattttcttgctctctctttgttctctctctccccgatttcccgccaacgacacccaagttgccgcgccgcctgttgccgcgcgtgcactgtggtggccgaccggccggtcgccgccgccgtcagccctgcctgttagagtatatggtagttagagtcatattaggatagaattggtttgtttggattccttccatatctgtaatccttccttatcttctccccatgtactcctgtatatattggctccctgagactcaatacaatatgtccaatattcacagtatcctctctccctatattatctaacatggtatcagagcagacgatctagtcgcctctctctcacgcttccgctcgtcgccctcgggagggtttcaatctcctggggcggccaccgtttttttttcttcgcgtcgtcaagtcgatgtcccgagagagatcgatctctcggacgcttgcgtcgtcatcaagcggcagtagcagagtctccggtcatcatcagtctgcacttcgtcctccacatccggtccgccgcgtccaccgcccctacctcggatggccaccgtcggcttatcgacctccgccgggctccgcggccgacggacgaccttgtctccgcctcgaccgctgtcttcatcaagctccgccggggggatggaccgacgtcttcaccgcctctccgcctgccttctgcctcgtcgccggcaagacgctgctggtccggcgtctctggcacgggcgcgcggcccgacacctcgccgccaggatctgcaccattgtcgccgcttgcggcctcgacgcctccggactcagctccctcgtcgttgccgccggtcagcccctacgcgtccgcgtctatcttgcctctcgctccctgtattgtttggttgtccgtcactttgctgtgatcttacacgtgattagcaagggagaggagagagagagaagatggttgcagagagcttgttggctggctggctggctgtggagggaaccgattgtgcatgtgtcgctgctgctggtacagttgaggcagagaggttgctggacgtggacttggtctacgga

SEQ ID NO: 33603 - DNA, 928 bp, Oryza sativa
aacgtgccatctccaggagctaacacgccggttccggctagggacgagtgcttggaggctctcgtcctgacgggatggggcaaggcgtgcgtcagaccgcctgtcgccacctaacccacgatctgaccggtctgtgaccggtcacagaccgaataaacgagcgcgctgcactgcgttacatgcggcgtgacgcgctcgtccaaaccgtaataaatgtggttaggtgagccccgctatgctcacctaccccatatacgcggcgcaaaacccacaaggggtcggggcgcctcggccctcggggccgaggcggtagcggtccgacccctcggggagacaaagagaagggcggccgtatcaccctcgggcccgacccccccgagggggttaggccacgtgggcgatcgtgtctgcctcaagtctctaagtcatgatactcctggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctagactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcactattattccccttgtcttcgccgcttgcgccctaactccttgtttcctgtgccctaccttcgccacacgcgctcgctctcaaacatctcttcttccggcgtca

SEQ ID NO: 33604 - DNA, 1501 bp, Oryza sativa
aaaatgattcataataaaagatttgatctcaccctggtctaaaacgacaagtattatcaatccgaagggagtaaatatagagcttgaacctgacttggttctaccacagcgttacgcttcacggttcacattttttatatacttcctccgtttcacaatgtaagtcattctagcactctccacattgtgaaacggatggattatattagtagttcaatcaatcggattgacgctattttttttaaaaaaaataacttataagattggtgatttatactatgttggtagggtaacagtaagcgagcagggttggtgggtgtgggcgtgtggcaaagcagagaggcggctaagcgcgggtcaaagctgagaacaacgccgacgagagacgagtcgtccgcgagtataaaagcggcgggggaggagagtggaggggtggatggaaagcgggtgtgagtgaggaagatccccctataaatcgcacccggaaaagatcaccatccattgcccaattcgccgtcgtcgtcttcttcttccacctcgggaagtcaaatctcgtcgccactgctggttagtctccctcctcctcctcatccacactgcttagattcctctttggtggttgatcggttccgtagcaaagttctgcgcgatcggtttttccattggtgatttcatttgccgtggaagggattgtgctacgctgcggccttaggatctcatcgcagccttcgcaggcaaattcctctgttctgtgcgccgtgtttgtgttcatgatctctgtgtttattctgcgtgtgctcctcgatttcctggcgccctgatgcgcttgctgtataggttcgttttaatcatttgaagctctcggaacagaatttgctttgcaagttgcagttctagtttatttcgggattattgggtggttgggctgttgtgtgttctagacttctagtgagtgcagtggtcagttgttgcatgtgttccagtttacccgtacaaaatgtaggggcaccgagttcaattgatttacatttgtagtcttgtagatacttttttttttctgtattagaatctcatagaagcatttgactagcataactacagtacctgtttgtgttttatgagaactttgactataagttggcaaacaatgggagtagttcgctgatgtaagttcagggtagctatattagtagtttagtactgatttcatgaaaccaactttaatcccattcattttgattttttttttctgaagcaaacattcattttgatttacactctgttgcaaattggctgttaggtactgacaggtgattcagttcaagaatccatcattcaaccaatagacctttttgttcatattagcatagattaaagttttggatagattataagttatttgtgaatacctcatattgagactaacagtacttttttttacattcttaggttttgtctccaaaggaagagaccatacagttcatcatgtcaggaggatctg

SEQ ID NO: 33605 - DNA, 161 bp, Oryza sativa
atgatatgaaaagaattaataattacttaaattttttaaatgggtaccgagctctgatgaatcccctaatgattttggtaaaaatcattaagttaaggtggatacacatcttgtcatatgatcaaatggtttcgcgaaaaatcaataatcagacaacaaaa

SEQ ID NO: 33606 - DNA, 926 bp, Oryza sativa
gacgaacgttaacgtgaaatgcaatatatatatatatatatatatatatatatatacatatatatatatatatatatatacatatatatatatatatatacatatatatatatatatatgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaagtggtgcgacaagtagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtgttaattagacttagcatatacgcacgaaacacttagcatatacatgactattttagtcttagcatgtaatattatttgagttttaatattagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 33607 - DNA, 337 bp, Oryza sativa
cgccgggaatagaatacttttctgcatgcccgcaggtcgactctagaggatcccctcaaaggattggagttttccaaatcctatacaatttctatggaatagctcattgtatttaggttttggaggagatttagcaaaaggttcgatctcttggaaaaaaaatgctataactatatctttctcatccgattcatacgtttttcatgcggtctaatcaaacgattattcgtgcgtattctctgctttacatttagtcagaatcgtgtgtttttttatttctccaacccgtccatcgtgcgcccctccaacgtcgccggcgccggcggccgatcctgca

SEQ ID NO: 33608 - DNA, 459 bp, Oryza sativa
  unsure (1)..(459): unsure at all n locations
ccgtgtgnttacgagatgcaagcatgtgccnnnnnnnnnnnnnnnnnnnnnnnnnnnnnnnnnnnnnnnnnntggtgttatgatttgtgtcagtaaagcttatatggcgttcttacaaaaccttgtatgcattttgttcacagtaatattttattttaattattctttgcttgattcttgtataagatataagattaatgtgcaaaatactgcagcattgcaactgaagattgatactctcatgttatatgtctcaaaaatgcatttaggggccctgataaatagcgtcatatcatgttatgtctagttgactccttttcgtgtttttaccaaagctcttatgtatttaattgatctgtagtgttttgtaattgtattcactttactctttctccatatttgtcaataaagttattgtatatttgtattcatgttattaattttcagcaaaacaaaggt

SEQ ID NO: 33609 - DNA, 210 bp, Oryza sativa
  unsure (1)..(210): unsure at all n locations
tcgggnnnntttgattgcatgtctnaacnnnnnnnnnnnnnnnnnnnnnnnnnnnnnnnnnnnnnnnnnnnnnnnnnnnnnnnnnnnnncaatagaatttggcatgagattggattgcttttagtcagcctcttatagcctaaagtctttgagtgactagatgacatatcatgtaagttgctgataggtttccagttttccgctcctagg

SEQ ID NO: 33610 - DNA, 266 bp, Oryza sativa
tgttcaccgaatagtatctccaagatagagcattatatccaagggatacagaggccgggttttatttaaatctattatctctcagcaaggtcagccactacgtcggcacgtagaaatgcaactcatctcacactctcacctctacatatacgcttgcaaggcctaggcttttgcaattctatcttgcactcacagatccatctaaacgcgcagcttggtcgccatggagcaagtcgcgtactggttcatctgcgcatgcgccttct

SEQ ID NO: 33611 - DNA, 557 bp, Oryza sativa
  unsure (1)..(557): unsure at all n locations
gcagagtttgatgacttgncgatcgcatgcatncaacgcgaggggaggtgatctcatccgagcctatctatttcatatccaacccttgtgggatgtatgatttgatcatcccaactctctagccttgtagcctcgaggtgatgtttgtgacttcaaaaacccaacccaacctcgttctgctgattagtttcgcagatgtgaacatgatgacgatgatctattgatctagtgtgtgttaaagtaacatttggttggtgttttgcaggacgcagtagttcttctgtctgaatgagcaagattgcactgcactgttcattggtcaatatcagatttgcaattaccatcagattgatcaagtgggagtaaaaaggtggctggcacaccttggatgcttactgctggtggtgaagaatgagaaagagaagggcatacgaggccacattctgccaatggcacctgagctatgcaaaatatgccgctcgtgggcaatgttaggcacacattttgcatcccgcattcctgcctcatcgaatagggcggaacggaagggatagaaa

SEQ ID NO: 33612 - DNA, 241 bp, Oryza sativa
actcggtgcccctacattttgtacgggtaaactggaacacatgcaacaactgaaccactgcactcactagaagtctagaacacacaacagcccaaccacccaataatcccgaaataaactagaactgcaacttgcaaagcaaactgttccgagagcttaaatgattaaaacgaacctatacagcaagcgcatcagggcgccaggaaatcgaggagcacacgccgaataaacacagagatca

SEQ ID NO: 33613 - DNA, 519 bp, Oryza sativa
  unsure (1)..(519): unsure at all n locations
cttgatttgcattgcnnnnnnnnnnnnnnnnnnnnnnnnnnnnnnnnnnnnnnnnnnnnnnnnnnnnnnnnnnnnnnnnnnnntcagtgttgccactggctgtcgaaaactttgtcatgtgatgcaagcatgagtgttgtaaagacctctcccctgtgtgcagtgccggacattttatgcacaaaggaccatgcgacggttgcccaaattttctctacctggaggggaaatacacaacgccgtcacttgaagaacaacgacccgacttgtagaactcctgcggtatacaaacttagtgtgccaagggtacactaatcatttcaacagatgcatgaataaacaagaggaaattcttaattgccctggcaaacacaagcgctatcaggatagggacaggtcacctgatagagagtaactttaaaaacggccagtgtggggaaggactgcatgccgtcaagttgaattgatatcaacctataagagtataatatcgctttcttccctttctatctttctagg

SEQ ID NO: 33614 - DNA, 159 bp, Oryza sativa
  unsure (1)..(159): unsure at all n locations
cgggcgcgcnttnncattgcaaattcganattcgaccttggtacccggaactcgagaagcattagccgcatctctactactactactactacccttgctctgtctgatccaagtccaggcagcagctagctagcgtggtggtggtggagtcgacgggga

SEQ ID NO: 33615 - DNA, 1501 bp, Oryza sativa
accttgtttgagtgaagttcgagttataaattctgaatttctgtccagttcataagttctcatgcttgtaatcttgttcaacaacgttcagtgttatggcaatttgactgcagatcgttcatctgcggaaatgtctacttgtacactctgctctggtttctgctattattgtgtatttagtgtgctgctcatttcagttttcagcagagcatatgtggttgccagtgtgctaaatactatggtgactgatatcaactgtgtagtcttttgagtattttttgacaggtagagacgataaattcaccatttctatcatgtgaaatcattcagcagggggaacagctatttcctgtcactcccagctgtcaaggtaatccacacttccagagcaaccggggtgacaatgaagcaaatttttcctgtgttctttttgtctgaactaaatctatttgcagtgtgctgattcttatcatgcctactgctggggcttcaactggaaaaggttgagaatcagcatcggtcgccaattaaccattcagaaatcagaagagtagcaagtaccgtgtggaatctccctttcatgctggaatcaggttcttattctgttcatccaccggttttatcacaacttgctaaagtatcagtagccctgcagattcttgctaccagtcacacctcacttactgacgtaaacagcagaatatttcctgtgtattgacctcaattcagcaaattgcactggatgcaaccgatgcaatgcaaaggctgtgaaatgcgcttagatacggtgcagcattacatcagagtatcaacttgtgattgtgctccatggacactcaaacttaccactgaaatatctatgtttttactggatcttttttttggtagtacacgcaatctgtcatgaacagtatatagggttccaatccaatctagcgatgtgaatgtgatgagctacagagaaagaaagtactaggactttgcacgtgagttgcgtttcaggggattcagattgatatgccactacaatggcgagcctagagctctgtatttttcccccctttttcacgagaattaggtgaacttttctaagttatttcgtcggtttactactactccagtctattttgtgttggctttcctgttcggtgttgatgacagctcactgtacatgatcaaatctgattaacctgcctttcacaccacacgtgaattagttcaggaattttctagacggaagctacagttatgttgcatgttgctgttgctaacttgattttttttcttctattgctcaggcattaatacacggattattgtagctttgcctcttcataagcttccatttgaagttaattacggtgattagcttgaggctataaacgaagccaacccagacgaattagctcacacctaaacctcaaaccctccaaatataattaatatagttcgcgtcgcttcttcttcccgcgcgcttctcgcgatcgcgcgcccatggtga

SEQ ID NO: 33616 - DNA, 1501 bp, Oryza sativa
tcggacgatcatctcactttctggaaaaaaaacttaattacctacatcatatactatggagaaaaacgataaatcaaaaaatatatcaatagtaaaatcaaagaagcactaattaatcaagaaaaaaatcatcaaagccggcagtctggcacttatgtgttgtcaatagcctttaaactacgattttgttaaaaataatactacacagaaataagtagggggcaaaaattataactatttttatcacctcctcctcctttttgtccctctccgtccttcaatgcagggtatagtatttactatgctatcgtaaatattgcaagggtatacgtatggttgagttaaggtggcatcagtgaaaagattactgtaggcaatgtatataaagggacatactaactaatagaatcatttgtgggtgtgccaatagtgaattaagtgttaaatgatgctataggctggtctttgggggcatggctatgtcgatgtgggactgatgttccagggcattacataaggaagccttggcaattatagtcgactttatccgttagagaggcattcatgtctatttttaacggtgttattgtattattcgattcaaatggtatgtttagactatttatacatagatgtggaaataagtgatgaacaccaagttaaacagtgtagatgatttttagtgtattaataatgtataatttattttagtggtattaaactattaatgtcgtcttattaaaaaatgcacatagcttttgatgcaagaacaatagacgagtttatatatgaccacgacaaagggatttttatttaaatatgagagatattcttatttttatcatatttagtagtatattaaaatctaccatctattttacggtaaatatattgcttttttttattgttagataatttacatttccttaattacagtatatatagtgatgtatgatttattttaccattctttttcttaaacaacaaatattctctggcttatatcccacccttatagtgtttaaaatacagccctacgatacatagtcgcgcgaatgcgcgggctaccttccttgttagtcattaacaagtctaattagtattcaggaaatttctcggaaggcaaggatttaggctgcctcactgcttctcctgcccaaacttatagaacagaacttactccgagtatacttaacaatatattgacagatatttgtgaatattttaatatagtcacaaatcaaaattcatcatatgcgcgtttggttttcattgaaaaatactttagttgatatatttttatttattttaatcatattatatttttacactaccactcccgatcaacttgcatcctggattcgtcactgattgatcttatcgtgaacacccaacacaaaagcggcagcagccggccggcgacggcaagtttgtccacccatgagctcaccggagacgacgacggatcagagcggcagcaacaagcagcagcggcggcggc

SEQ ID NO: 33617 - DNA, 418 bp, Oryza sativa
tatatatatatatatatatatatatatatatatatatatatatatatatatatatatatatatatatatatatatatatatatatatatatatatatatatatatatatatatatatatatatatatatatatatatatatatatatatatatatatatatatatatatatatatatataatctcatgtaagcatataacattatctacaatttatttaattccataaatcaatatgcaagcatatccaataaccacactcacatcatttgcacaatattttaacaaatatatctattatttttataatatttaacatatacttcatgataagtactaataaaccctgatgttttactaacaaaatatattgagaattctcgtagcgaagcgtgaggaatcacctagtatcataaaaa

SEQ ID NO: 33618 - DNA, 1501 bp, Oryza sativa
tagttgacacatcagagagaaagatggctgaattgttcgcatccatgagcgtgaaatgggcacttgacaagctctcgtccttgctgccagcaagcctgcaagtagcaacggcgccgtcgacgacaagcgagggcctggaagacctccggatgctggagaggacgatgcgcaggatccacgccacgctgcacgacgcggaggagcactggatcatcagggaggagtcggcgaaagtgcggctcacggagctcaaggaattggcctacgacgcggaggatgtggtggatgagtacgagtacgaggcgaaccgcgtcagtacggaggtgttcgagaggagccttaatacctgcaacggcaagcgtaagcaccggcgattgcctacgggcggaacgccggtctgcctgggaagaccatttttgcccgcctgcaaataccttttttctagtagtgaccatatggtacgtcttcaacgtctctcccctctcatgtctttgattcttctgtaggcatgtaataattaattatttcggccaactaagtcaatactacataattacataggccatgtttagttgttttggtaaaaaaaatttgatgtatacgaacatacatttgaagtattaaacagagactaataacgaagcaaattatagattccacatgtaaattgcaagacgaatctattaaccctgattaatccattattagcaaatgtttactgtagcaccaaattgtcaaatcatagcgtaattacgctcaaaagattcgtctcgcaatttacatgcaaacagtgcaattgatttttttttcatccatatttaatgctccatgcatgtgtccaaacatttgatgtgacggaaaagttggaagtttggagagaactaaacacaaccatagtcattatttcatcaatgcagtccatatgtaatgattatttatatatctgtgtgtgtacatgaaaaactaattatttagtttactactttcctctcagaaaagtaactaaatttactgtttagtatatataactgcaaaaacattgatcgttccaatctaaaacttgtgtaaacaaaccgtaagttgtctgtatgattttgtcttgaaaaatgggaaaatgcatgtagaaattagtgttaaattagtaaatctccttcttagctaatatatgttttattctgaaggtaaatgacgagcactaccgcattaaacctggcgtagttccagttccaagtgagttggctgatagagcaaggaaggttgtacagaggtttactgagatgaaacattactatgatagttttagtctgtccaaaaatgatgggtatcggcggattgtccctgacttccaaactgtgcggcaaaccagctcttttgtagtggaagagagaattattggaagagagcgagagaaggagataattatcgaaaggctgatgaagtccggagaaagcagcagcgttgcatgcatgttgtatgtctgtatttccaattgttggtatgg

SEQ ID NO: 33619 - DNA, 1501 bp, Oryza sativa
caagagctcagaagatcactcgcagagtcccctacctggcgcgccagatgtcggagcgtggggctcctcaccgggagaccgcgctggcccccctttgccggttcggccggggaccctgggtgagactctaagctcccaatctgtgtgtggaaggttcgcgagataggaagcacagaagacgccggcgatgtatacaggttcgggccgcttagaagcgtaataccctactcccgtgttttggtggattcgtgtgtgaaggagctacaaagtatgagccagcctctcccttgttctgggttcctaatctggaaaagtccagtccaagaaaaaactccccctctctcagtgggcaaggtcctccttttatatcttaaggggataccacatgcaccatccccccctctctgtggggacttaccctaccttttcataaatggacggagatttgcatggttgccgttcgagtcaccttctgatgggacggcccgcacctacctccactttcgccgggaacaggcgcgacgcggaatcatggctgtctgctgacgacatgaccggtgtcagactggtcacaaatcggtcattcttgtccaccacgcgtcagcttagcaatctgcacgttggcccttcttcacacaacattttgcctgtaatggttaggatgaagcctggcatatatctgaccaggactaacgtgccatctctgggaggtaacacgctagctccagctggggacgagtgcctagaagccctcgtcctgacgggatggggcgaggcgtgcgtcagatcgcctgtcgccacctaacccgcgatctgaccggtctgtgactggtcacagaccggataaatgagtgcactgcaccgcgttacatgcggcgtgacacgctcagccaaaccgcaataaatgtggttaggtgagccccactgtgcccacctaacccatacacgcggagcgaaaacccacgaggggtcggggcgcctcggccctcggggccgaggcgggagcggtccgacccccttggggagacaaagaagagggcgaacacatcaccctcgggcccgacgccccccgagggtgccaggccacgtgggcgattgtgtctgtctcaagcctctattcatgatactcccggtcccatgtcaccgacaaactatatactccctccgtcccataatataagagatgagatttttagttgatgtgtcatgtgacatatcctatctagatttatattaatatgagtgtcatatacaccctaaatctcttatattatgaaacggagggagtagattacatgataaatttgttcacctaaatacatagtgccctggtttaattaaaaagcgtacccgcgacttatacatagcacggatctcaatgcacattgtacggttaaaacatgtagtacaaatctgggaaacaaacgacaccatctagcttcttgttcagattacgaggatctgtagttgtataatctaaaaataaattagaagccataaa

SEQ ID NO: 33620 - DNA, 1501 bp, Oryza sativa
cgcacccgtagaattcccttatctccgcggccgagaggtgtcgtccgtcgccgtcggtgtcaaagcagcggaagacgcggccgcgctccggctcggtctcccatttccagaacgatggatgaacatccagcctatccgagggcggtggcggcgacaggctacggctacggctacggctgcggcagaggcaaccgcaggagaggacgagacccatggcgagacggatcgtgcgccgcgcgtttccgtaatgatcagtgcgtgggggttttgggggctcttggccgatcggccattggcttcagggtttaggtgctctttaacggttttcctataaatttgtttaacagattttatcctcaaaatcacacgatttttttgggttaaccacgtcatgacgtcacaaccagattatgtgaaaaaaattgataatttaacacttttttcgttgttcaattgctctaatggacacttgtgagaatgacatgtgtgaccatataagcgaatgtaagtgggccatgatgtcaaataataaaaatccattttaaggagtgttaaattatcaaatctctatattatgggtatgtttggagagcttgaaattttgagaaacagttgattggtagctagcttttaaaaatttgtttatggcttctaatttatttttagattatacaactacagatcctcgtaatctgaacaagaagctagatggtgtcgtttgtttcccagatttgtactacatgttttaaccgtacaatgtgcattgagatccgtgctatgtataagtcgcgggtacgctttttaattaaaccagggcactatgtatttaggtgaacaaatttatcatgtaatctactccctccgtttcataatataagagatttagggtgtatatgacactcatattaatataaatctagataggatatgtcacatgacacatcaactaaaaatctcatctcttatattatgggacggagggagtatatagtttgtcggtgacatgggaccgggagtatcatgaatagaggcttgagacagacacaatcgcccacgtggcctggcaccctcggggggcgtcgggcccgagggtgatgtgttcgccctcttctttgtctccccaagggggtcggaccgctcccgcctcggccccgagggccgaggcgccccgacccctcgtgggttttcgctccgcgtgtatgggttaggtgggcacagtggggctcacctaaccacatttattgcggtttggctgagcgtgtcacgccgcatgtaacgcggtgcagtgcactcatttatccggtctgtgaccagtcacagaccggtcagatcgcgggttaggtggcgacaggcgatctgacgcacgcctcgccccatcccgtcaggacgagggcttctaggcactcgtccccagctggagctagcgtgttacctcccagagatggcacgttagtcctggtcagatatatgccaggcttcatcctaaccattacaggcaaaa

SEQ ID NO: 33621 - DNA, 605 bp, Oryza sativa
agagataaaaacatgactctatctataaattaaattaatcagcacaaattatggaattaactaaaaagtcatattttatcccctacaacgaatttacttctaatgtcgtgacaaagttacttctgttttattttaagttacttttagaatatatgtaaattacttttagactttattgaatttacttttatatgtctaagaagtaatttagtcaaatctaaaaataacttatatatatgataaaagtaacttatgtatataataaaagtaatttataaatataaatattttttcaacgtaacataatcatgtaagatcttgtttgtgaagatttaattgtaacgaacacaatggtgtaatcggattgtagatcggataagtaatttgagaggaaactttatttgaataggaaaaagatacccacgagaactttatttgaaaagaaaaagacacccacatgggtggacatcatgacgacgtgcacagttagacggctatgagatgcgtcacgctatagagctaaaccgagagcgctctcgaaatagatttcacgttttattttcttcctttttgaaaccccgtagccggcttctggttctaccagg

SEQ ID NO: 33622 - DNA, 411 bp, Oryza sativa
ttaggattcgcttttggccagcgaatgtgcaagctttgattcatcatatttacgtactgcaagcaaatactccatttggtcaggattcgctgcaggacggccgcgcggcacacggctgacacgagcgcacgctgcgcgagcggcgaacgtgcagaaaacaccgttcaatcgatgcgcccggccacgcgatggccaggcgtatgacacgcacacgctcgtgacagcgcgagatatcatcatatcaagcggccgaactgccaaaataccgtactccaacacgagatgatttcaatctctccccgctccgctaatcgtttgcataccgagattaaaaaactccgacccccggtatgtgtggccgaagttctcttttgtaaattgtaattaggagtattttggtaagggatgcaa

SEQ ID NO: 33623 - DNA, 205 bp, Oryza sativa
ttttaaaggaaatttttaattccctcaataattcacttgattaagttgatttaacttttatttaatttctagaaaatgtattattaattgatttttattcccgaacgaaaatcggggcgttacatctctcgtctgtctctctctcttgccccccctctctctctcggctctctcacatctctcagcgtgtggctgtggctagagg

SEQ ID NO: 33624 - DNA, 390 bp, Oryza sativa
agaagagggccttgtccacatcgcgaggacccgttcatcccaggcatgctggtgatgacaacgaaatcatcccgatctctctcgactcctccggtcctcccccgataataatcaacaagattatattttactccctccgtctcgaaatatttggcgccgttgacttttttaaacatgtttgaccgttcgtcttattaaaaaatttaagtaattattaattctttttctatcatttgattcattgttcaatatactactattattcaagtttttgaataagacgaatggtcaaacatgtttaaaaaaagtcaattgcgccaaatatttagggacagaagggagtagttctgaaatgaaaaacattactcccattttaccctaccctctaga

SEQ ID NO: 33625 - DNA, 1501 bp, Oryza sativa
gcccattcaagtctcagtaaatcaagaaaattgtgtagaatcctttaaaaatggttttgttctctgtttcagtagtcttatagcctgtttgcaatgtttgccttgtatgtcgctagattccggttcctccgacgctccggtgtacttcgaaatagtcgccgaggttcctccagcagcagagcaaggcaagtcatgcttgtcacttgaacatgttgatcctatattgcaaatgctctatttttttccttcaaatattgcattgttttataatgttactatggggtgtttacctattgtcatagccatgctattgttgtaccatgtccctttgtcagcttggggttataacatgactagagattggactagggattgcttagccatgcttagttcaactagtgcacaatggggaaaatcttattaatgttcagattgttggattagtgccaccgctttgatgctggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctcgagccgacgcatccaggcaagggtgggcgtgatggagcggggcgggccctgcgacggcctctgtcgcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggtaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttggaatttggatagtttaggtggatggttgggcctattgcaacgtgggataacgttggacagtggatagttaatactaattaaatgtgacaactgtttaatctttcaacttctgtttataaatgctcgctttatgcaaatgaaccactttagctcttctttgatgattccctgcatcatgcctctattccggtatgacttgctgagtacagtgggtagtactcagttttgctctacttttcccaatcccagagtacgagagtgtgtcagatgaaggtttctccgaggagtaggcttcgtccgtgccgtcgaggatgcctgtggagtggtgttcccgctgcagttctagtcaaggcgtagctcctgtcgtctttcttttcttccgctgcatttgtgtaagacttttatgatgtttgtaagacgtggatctgaatgtcaacattgtcgtttgtgtaccccggccggtcctggatggggattttaatgcacattctacttggaattctactcgggaatttctg

SEQ ID NO: 33626 - DNA, 1501 bp, Oryza sativa
ccaagaaacatcagcaaaagtacacacctggattattagcatcacgatagcaaagacaacttttgtaacctccgtcaaaaagttaacgctgatgggactgaactgaaacttcccatcaacctttgacatgaacactaggatgggctgcagatacaaagcaaatcattagtacagctctccaggctcaggatgattattaagcataaacaggaattttcgtcagaccatttcaccaaactaccgagtatttgggattggctaaacatgtaacacagacacctagcggttggatacttgaatgaaatatatagctacaaggagggtgaagccacacctggaggccgacaaggatgcagtccccgacgacgagcaggacgttgagcgcgcggaacttggacgatatcttgctgcggtgcttgtcgtacgccctggacacgctccgcgggctcggcaccaccagccgcgaccggcacacgctgcattccaccaccccgttccgctgcatcttccttccccgaccacctctccgcagcacctcacgccgccgccgccgacgacgaggtttgcctccctcccactacccgcgggccgcggcgaccgagtcccgaggatcacggactcacctaagcatacctacggcagcagcagcagcaacaacaccaccaccattccagatctgggggatctggcgtgacgcctcggggaaggcgaggatggggggcgtcggtgcggatctctcagatctggcgcggcgtcggcgtcggcgccgtcccccccacgtgcgcgcggagacccgggggctcggcctgggcgggggcgggggacgggtgcgcggtttagctcggcggcgactccggcgagcgcgcgggggctggatccggcggcggggaagggagggggacgcgtgcgagacgcggtcaccgggatctcggattccggtgtgtgtaggtgaaggcgaaaggtgtgagggggaaggggagaaggggggaaggtgggtgggaggagggagtgcgcgcaaggaaaggaaaggcgggtgtttctgtctatttatatttgctcgaatcacgaattatttgctcggttcgttcaaaatagagcgaaatttcgataaaccccactcattatgaattatgatgcaagttgcatataaaaccacaggtattataaccagcggcacctaacactttaaagttttgaaaaccccccacccttatatatatatatatatactccatccgttcttaaagaaaaaaaaagtaaactctagctgctgtatcagatagttagagtttatctccttttttttcggagggagttgttgtcaagtatttactaaaaattttaaacataaaatatataacgtgtatatgaaacatttagttgttgattgcttgattgaggttgtcggtttaactatttaccattttaaaatatattgttttagatatattgaattcaactgaaatttaaataaagatggtgttttatgaaacatttagac

SEQ ID NO: 33627 - DNA, 1236 bp, Oryza sativa
tatgtgtgtatgacaggttgatatgatggaaaaatactgaagtttagatccatactttggatctaaacacagcccaagttaaaattgctgtgctcgtaacaaggccaggtgtagatccaagagctctgctgccagttgcttttccagtctggttacctttcatggaactgatttaggccctgtttacatcccacccaaaaattttcaccatgtcacatcgaacgtttaaacacatgcataaagtattaaatataggctaaaaaaatgactaattgcacagattacgactaatttgcgagacgaatcttttaagcctaattgctccatgacttgacaatgttgtgctacagtaaacatttgctaatagaagattaattaggcttaataaattcatctcgcggtttactgacggattctataattagtttttttattagtgcccgaacacctcatgcgacaccctatataataccttatgtgacacgccaaaactttacacctttgaatctaaacacccccttaactgcgaggctagctctctggctgtgcgcttgtgccgaaatcacttcaagttcgtccatgctgctaacaacgttgaagagctctggttgacttgacatagaacatggacacaactacacatggcctctccaagctggccccaaggtacttgacaccgcttcctcccataggattaaaaagagcaatttgatgtagcttatgggttttcagcaagccagcaatatatttttgcctcgttctaaacggcaaatcgccactggtaacgttcagagcagcataaggcaaccaacagcaagacatcaataggagcaggttttgcagctcaaccagtgtagtaaatccatgggtctccatactcccatggcactgtccccctcagcgtccccaaggatgacgctggcatgcccagactctagagttgtttagtcataattagattctcatcgtacagtgtttgttgcatagagaagtttcttgatagttttaagatcctacaattgttaaatatttatatatatcccaaagaaaaatgttgcaaccaccatgtctgatttctgtgtatattattgtttattaaatccaaaattgaagcgttggctgtgtcacatgtgaaaatatgcagagaaagtgcattaacgactgccttggagtgatacagactttgagggacctagggatgcagccataccttcattaagctgcattattttgagg

SEQ ID NO: 33628 - DNA, 1501 bp, Oryza sativa
tgcctaactccttgacgacttgacgatcactactacgactactactcccttgtttgtagttgtacttgtaccatgccaagttttactggtcgtagtagtactgtcgttgcagtaggtacgtatactgagagagaggttgcatggcagaaatgagcaccgcaaaaataaatactgacagcacatgttcctgcagcaaataatactgacagaatatgtgctgcatgcgcgtgtatcaccaggccattaaactcaccggtctattttgattcttctaccataatttctacagagatctctgggatcgatttactgcattgtatgtggagagactgcaggtgcctgtatacggcatgactgtagtgtagtactagtagtagtactagcacgtatatgaatgaggagtacatacaggacgagaggagagggcgagtccgagttgcattgaatgggcgagaggagagtgttgtgtgttggtggcgtggtgttggcgttgaatgaggcccaaacggcgagacaaaagagacaaggcggggtgttggttggggcaggcccaggccgggactggaatatggttcgtgcatgccatgcccgtgcattgatgagagatgcccgtgcggttgcggttgcaggcaggggaggtaaatgcgagcgagacgccggggaatctcgccctgccaccgcctccatcggggcatcgggcccgtgcacgtaaatgcctcgtcgccggagaattttttttatttttatttttttttattaaaagttttacaaaaataattttccattttgaaaattgacggaagtagtcgcctaccgccctctgggagggcgatttttaaaaatcgccatcccagagggcggcgaaaatgacgtggcagacggccgttcgctctcgggcgacggccgtcaacgaaatttgcaggcggcctccttgccgccctccgctagggcgattttgtactgtgcggggggccgcctgcaaatgggcggcgagggggcatggaattttgcaggcggcccccttgccgccctgggggagggcgatttttgccttccccctataaagcccagtcccccctctctgaaatttcattatattcactaaaaatccaaaaaaaacgaaagagagagaggagagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatacagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 33629 - DNA, 477 bp, Oryza sativa
cctatgttcagattcgaaatattaggatatgtcacatccagtattagcttagttttctatgaggtcgaagggagtagctggctgctacattgaccgacggcgcctgcctcaccaaggcggtggcaagggctgcagagcggaccacggtcgacagcgagacgtttatattgacgctcatttttatgatactaggtgattcctcacgcttcgctacgagaattctcaatatattttgttagtaaaacatcagggtttattagtacttatcatgaagtatatgttaaatattataaaaataatagatatatttgttaaaatattgtgcaaatgatgtgagtgtggttattggatatgcttgcatattgatttatggaattaaataaattgtagataatgttatatgcttacatgagattatatatatatatatatatatatatatatatatatatatatatatatatatatatatatata

SEQ ID NO: 33630 - DNA, 1501 bp, Oryza sativa
tgattgtgcatagatcttccccaactatctttctctgattaagtaacctcgatactgagcttgtgagatcactcggacgattccactttttttttttaaaaaaaataaacaaatgcagaagctctgtttcattcattctcttagattccacgtttcggtttatcccgaatccgagttccatttttatagccatgagctttttcgttgttacaaaaggatccacaagaattataaatgttttcagcttgaatcattgtttgaatttgctctgataagcttcaatcatttcagcttggtcttaaaatgaaatttcatcatttattcgcttgtggtgaagaggctaatgattgcaacccaatccacccaacttcaacaccaacagttatctatgtccaagtgccagggtatctatcccagaagaaaagggtgtctggacaaaatctgattgtttcaaaggtccagaaagttcttcctgaggaatcaagaataaagtcagatgctacaataaaatgggcacttcagcttcatagtgctggctattctcttagtggaaaatttcaggcctctgatctctgtgtcgatccatcaacagaattaagtgtttagtcacaaagagtgctgcttaagaaagcaactatgaagaacaaaaggaaggattttaaaagattgaggctaattatcaagcaagacatccttggaatcaaatgtgaagctgacctcccaaatgatgtcaaattgctattggaccttcttaaagactatcatgctagtgactaggtattaattgctcatcacccggggttgatgaatgaagataacaagatttctactatattccacataatattcactgaacttgaagctctaatggtaacagatgccgtgaagtatcagcgcatcatctctgctttggcttcgctgtatggaaatggttgctggaaaccttacgcctattgcaacaagcatgtcaagggagtttttgttgacggctgttaaatacaaaattctcgccgtcaatacctgcataaaaccataaaagtaaaacatccaatatagtgataggatttatttctaaccatttccacaaatgttggtgtatattcgtatgcaggtaatcaactaccaaagatgggaaagaatgagcatgaagaatacaaatatattttgtgctgatggacccacaaggttttgagctacagcatataaaatgtgcaatcattttgagccaaaacatggtgtaccataaagtggggcccacatgttagcattctgaagaaggatatgggccaggggagccggccacagttggaccgaacccccagctggcccaatccagcccaacttcggcatgatagttgtacttctcatcctatgacggttgtggccgttaataccggtggaaaccgtcatcaaaagagacacttggcaagagaaggatgaatatgctatttggattctatggagaatattccttagcatctccactctctcaagtcacctc

SEQ ID NO: 33631 - DNA, 271 bp, Oryza sativa
cagtttgaatagctgtgaactgtagaagaacacaataggcaagcgatggtgatgctatcacagtggtggtgccgagatgacagttagcaaggagtggtgatgctgcgatgctaggcaacatgggtatagggctgggcgggggttggagtgaatgagggaatctttgtctgacgatatagaggccaggctaggtcaggtccggtccgggcaccatgcatctgatctatctatgctatgcgtgtaaatgccctgaccctgaccaaagtaacca

SEQ ID NO: 33632 - DNA, 169 bp, Oryza sativa
ctgcgcgcgccggggttccgccaccacgcggccctcagcgacgtcgtcgccgtctgcgccacggtgtacctcgtccacgagcggaggctgctgtggcgcgccgatctcgctgacgagaaccccaaggtgcagcgcagggacacggggttcgcgctcccgtcgctcgagc

SEQ ID NO: 33633 - DNA, 1501 bp, Oryza sativa
attttctcgttcggaagtgtcgggatcgaggtccaatctcacccacccaaaatgcttgaagtcagcagtccatactttgccgtttatatgacatatgctcaatctaaagacggataaatcattgaatacctgagcatcatgccagcccacctaaaatacttaaaatcgaccattttctccatgatgctagttgatgatttagcacttctaaatggagaatatgtcatcctaacccatacattacgaattcagagaagaatctcacatatcactatgaattcatgataaatgagaatctaaaaatgacaaatcatcatttttctcatgcagttcaggaaggaaaccacaaaagcggcatagacgttccccttgcgagccatatactatgcatgcgaaagattttattattttttaaagatttcataaaaccccatatttattgtcaaatttgtgcaaaaccgctgatattttgtcttgtgtctcataaccatatattttatggtctaaatgtttcataaaacaccatctttatttaaatttcagttgaattcaatatatctaaaacaatatattttaaaatggtaaatagttaaaccgacaacctcaatcaagcaatcaacaactaaatgtttcatatacacgttatatattttatgtttaaaatttttagtaaatacttgacaacaactccctccgaaaaaaaaggagataaactctaactatctgatacagcagctagagtttactttttttttctttaagaacggatggagtatatatatatatatataagggtggggggttttcaaaactttaaagtgttaggtgccgctggttataatacctgtggttttatatgcaacttgcatcataattcataatgagtggggtttatcgaaatttcgctctattttgaacgaaccgagcaaataattcgtgattcgagcaaatataaatagacagaaacacccgcctttcctttccttgcgcgcactccctcctcccacccaccttccccccttctccccttccccctcacacctttcgccttcacctacacacaccggaatccgagatcccggtgaccgcgtctcgcacgcgtccccctcccttccccgccgccggatccagcccccgcgcgctcgccggagtcgccgccgagctaaaccgcgcacccgtcccccgcccccgcccaggccgagcccccgggtctccgcgcgcacgtgggggggacggcgccgacgccgacgccgcgccagatctgagagatccgcaccgacgccccccatcctcgccttccccgaggcgtcacgccagatcccccagatctggaatggtggtggtgttgttgctgctgctgctgccgtaggtatgcttaggtgagtccgtgatcctcgggactcggtcgccgcggcccgcgggtagtgggagggaggcaaacctcgtcgtcggcggcggcggcgtgaggtgctgcggagaggtggtcggggaaggaagatgc

SEQ ID NO: 33634 - DNA, 1501 bp, Oryza sativa
aacaaaacttaagaagcgcatgcacgcatgcaaccaatgagtattaagatatatatctcctcgggttctaatgaaacatttaatttactctctatttaagtcttgatatttactctctatataattcatatgctgttaactgtatgaatttttataacttgttgatcaaaaatagatatgtttgacttgtaacaaagctaaaatgagaattactttgaaacagaggaaataccacatttaatatataggtgggacctcgtgaaactcactagatgataatataccacacttaggctgtgttcagtagcaagaaattaattcgtcccgcacaaaaaacaaaaccatctattagcacgtgattaattaactagtttttaaatagatcaatatgattttattaaacaactttaatatatatttttttcaaaaatgcaccgtctaatagtttaaaaagcgtgcaggcggaaaaagagggaagtgggttcctaactactcttgccgaatgcagcctaaattagtgtagtagtaatttgtgtgcttctgtttaatctcacaaagctgctgcggattcggttcgttctaaaatataaaatatatgtatcttacatttatttatttcttttataatatattatcaataattacaaaattaacatcatattaaaataatttcaaatatgaatctaataatactacatgtatgacattaaacacatatactttactccaattactctctcatttccataatataaggcacaactacttttttcagatgctccataatataaatcgtgcatacatacatgtaattaattaatatatcttctctattaaattatgactttttaaaatactctacccttaagatctctaattctattgggtgcatgcattttatttattaggatgatacaaatttggaggtgataataattattttttggtcttagtattaagggtggttgtgccttatattttggaacggagggagtattagtcaaaattttcaaatgtgagtttgtaaaaaacacagggagttcttttatctatccccatcaaatcaataaaagcgtctgaaaccctcaagaaatccctgaagatggatagtcgtattagttgacttcctttttttttctgaaattatacatgatgagcaggtattagggcatttaagcttctttactagctagtctgactctcaagtctgaacccttaacaaatcccttagggaaataaaaataaaaaagtaaactgtcagcatgatactagtagatgactaagagtccccctcttcgatgttttttgtattatttgtgaaaaggtacatgacgaggattacttcattgaggctggcataattccagtgccaaaagagttgactgtcagagcaaggaaagttatacaaagatttggtgagatcgaaggctactatggtagtttcaccttgtctgagaatgatggggacagaaggattatccctgatatcaatagtctgagg

SEQ ID NO: 33635 - DNA, 187 bp, Oryza sativa
atcggcccccaaccacaaaaccagatatataacatcccttgacttataaaaccgttcactttaggtccctcggtggttttgaccccgattttgtcccacatgatggctgaatcagcgtgggccccacatgttaggatgtcatgtcatcccctcctatcccttctctcctcccgggcaagctagccga

SEQ ID NO: 33636 - DNA, 1501 bp, Oryza sativa
tgctggcgctgctgaagatgtatgtgactcatttatttctaaagaaaaaaagattaatttgtgttagaacaattacattattagttgcacattatcatttcaggccagccataggattggaactgatgagaggcaaccactattgccaacatgaagtatttttttgaggtacgcatggcttctttaaccagaacttttagtttggttgatgtggcttgtttgctttagtgactagtaatatggcacaagctaagatatgaaattatggacaagtaaacagagacgtgcttgtgcccacaaactggtggatagaataactagattgatttgcgggaattaggcagagacagactctccgcatagattaatagcggcatcaaatgtgtgacctgaatatctgatataaaaccgaagctcccattgtttgggtattgggtcataagttttaagaccaaagtgacctgataaattttacctgtaagttagtctgatatgggttccagaattagctttttgttcctaaaatggaaggaaatcatgaaatagtcagataccttgtgggtgtgatactttatctaattcatctgtccagaactaagtttctgaaaatgtatgttcttttgtttctgcaggtagtgtagaggacaattctttttgccatccaacttggaggcagcagagtttatatagcgtggcgagtgaaataaactattgtacactgtaaaggcaaagaaagaaacatcgatgtatttttcccctttgtcatttttattatcttttgtgatagggagggttgtcagctgtggcctaacgagtgtggcacaacattttttggataggcaaattccacatgaatccccagatacgatactagtataaagcaattttttccctggatatgtatactcaaatgtatcaatgagttactgttgttatatggaacttttgtactatcacactggtgttacatattgaaactagtcggttctagacttaccatggtagctatgaatggccttgagccatctcttcaccattgcatggtctgtcttttgtgcctgttctgcctggagagctggataaagattgcatataatggagatccaacaagcatttgcatagaagcgaggacttctccgtctaatttatgctcaataaacttatctgtggtgcttgctattcatcagtcgtcacatctgaaattttctcgtccttggttgcccggaccattcccccgggcacatggcgctgatcacactcaatactgtggatattgttcataggcctaagattgtgagcggatggtgcatatttctcctaacgcaacctctgcattttgtactctatccatttgcttcaactcgccaactcgcattgccatctagcttgtgatcctacgcaagcgcgcgaggcttggtgtccagtccgaatccgaaccaatcctactcggatttttgggagagtccgattcgaatcttactcggagacggtatcagccatc

SEQ ID NO: 33637 - DNA, 164 bp, Oryza sativa
gggggcgcgcatccctacgcacgaccgcgcccggccacaccgtgctactactgccctggtacgctcgctcgctcgctcgatcagatcagcggctaaacgcctaaacgcgcgcgtacgtcctcgactcctctccgccacacggccggtgccgccccgcaaacagc

SEQ ID NO: 33638 - DNA, 502 bp, Oryza sativa
cacacattgaccaaaaggtttgaagtttgatccatatccattggtgcccagtagtatataacatcctcattattttcgccagccatagtttcctctaagggttcttcggctttttcagacaaggatacctgatgacataagaatgtttaaaacttatttccatgtcattatcaattgaaaacggcctcattcaagtgttcaagcaatctcagcacatggaaagcatagaacaacaaaaggaaaacataggcatggcaagccaaaaaaaaaaaggcattttcatggagatgaaaccaaatagaacacatggaaagcatagttccaatactttttaacatctgaagcaacaattgtattgcaaaattgcatttagctggtgcagcatagaattgcctacatgataggcatcatgagttcatggctagagggaactgttgctactgcttaaaaaatcctctatgaaaaggtcgaggaacctattttattatattgtatgtccagg

SEQ ID NO: 33639 - DNA, 1501 bp, Oryza sativa
aatatttaactagtaaaaaaagtcaaaacgacttataatattataatatgaagtggacggagtattgttctcacgtttgtaagagtcgagcaatttgatgtgtccggtcatctggtgtatataaagatttaatctttgcagccatttcgtgctgtaatctgcgttgttaggagcatgtgctatttttcagacaatgattacgcgagccaatttgtgcattgaaaatttagaactgaaccaaacaattttatactctgtatccgtaggctccgagcttgaggcacattggaaactttgtactgatcatgtgtttcaacactattgttgcttaatttgggaaacggattctaatctcgacagatatatatcctcgtgtacctttgtgtgcaaatagttgtaaataattacattgaatgacctccttcggtcattccggtaaaaaaaaaagttgtaaatgtatattttttaaaaatatatagcaacatttatcattccactaaaaatcaattcaaattcaatatacagttgttcatttatttctcaatgtgtgagttgagtttggaacttaaattgcatgttgcaaaaaaaaatgtcaaaatttttaaaggatttttttatagtttttaacgggaatatcctcgagagatcagcgtagtttcatcttaatccactagcaaatcagcaaaatacttttaaactcttgagggaaatgtctaattgtttgctcaaacaccatgcaaatagttataaagaaaatctcaaaatatttgacaacatttattcaatatatatacaccactccacaaaaccttaggcctaaactcaactcacacctcaagaaattaaaaataaaaaaaataacgtatgaacaaatatagttcaaatttgtcttttttacttctaaatgtgtagattgagtttaaagtttatttttagtggaatgatagttattactccatccgtttaataatgcgtgggcaatgctagaaagtcttacgttacgaaacggaggaagtactactctacattgtcaaattattttagattttttcataacaatttaaattaaatttaagagataacactacactccttcgagattttagaatccattcccgccaaatcgatgtgctaggaatgcgtgtagtgtgtttgcttgctatgatacgaattgtgtcaaacaatatttttctttgtctcaatcatatggccagtcattcatatgtgcttgacaagaatatggctacagaaaatcttcagatgagactccaagctccaggactgatccaattttggggatcccagcttatctgtagcagtacgtgaaacatagacacttaagcagcacccaaaccaaagcatgcagaaatcaaaatacgggcatcaaagtatatatatggtgttacgtctgtttgtatgtgcgtgtgtgtgcatcttccgtgtaattgtaaagaaaaatttaaatctgaacatgtcggggtttttgaaaaatagaaaatcc

SEQ ID NO: 33640 - DNA, 275 bp, Oryza sativa
agtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacataatttgtgaaaggaaaataaagtaaaacaattgttttcgactggggcggctggaggatttgggtggtgtccggaaaaggctagtgccgtccctggtcaattaaggaccgagcca

SEQ ID NO: 33641 - DNA, 346 bp, Oryza sativa
taaaattgtaaaccatcataaaaaattgcaaagccgaactgagaaataatagtttaggaagttgaaataacaacaacaataaaagcatccagaatcttacaactgaacaaacttttatgtataaagatgtcaaatgttaacagtttaaactctattttgtgtatggagctggcagttggcaactgtcaaatatgctgtaagttgacccgtacataatatatcaccaagaattacctgttttgagaataaaagagatgtaagttaattaggcttatctttccataattttacatattctaatgcaatattttggttgagttgttttgatttttgatatctttattcg

SEQ ID NO: 33642 - DNA, 337 bp, Oryza sativa
ttagtacttgggtagtgggttgttgcaaatcaagccttcagtggttatgacaatcatgtcatcgactttagatagagaattgaatcacttgcattacgagcttgactggattagttagctgagtgggttctggctcctctagattgccatgaatagctggagaaatggataaatatgagtttaagcatgcttaaataagttatcttaatctttccttgcgatacttttgctttaattgttagttgtgtgacatcttaagttcacagagttgcactttacgtccttgaaatattatgctatattctaactttttggctttggatattttgtagtaaca

SEQ ID NO: 33643 - DNA, 246 bp, Oryza sativa
ctacaaatgtgtagttgacgtaggctgggcgatgctggaatcgcagtgatattgggacaatctgtcacttgaaaagaaaccaaggacagaaagggcgctacaggaagagacagtatgttatctgcacatctgatggaaagcctgtgcaagcgcggaaatgcaccatcatccaccccagaccactctgaccactcgggcatctgcacgaatttcagtttcttcagtgctgggaagcccttgaaacca

SEQ ID NO: 33644 - DNA, 242 bp, Oryza sativa
tagacagggtgatgtttatattggtagaaatacgagtaatcataaaagcagtaaatttgtatatgccaaatttaacagaggcatcgaacgattgaacatataagaatatcatccaaagatgttcaactgttaccgcaagaacacggcaataaccctctttttagtgttgtgcggaaatatgttgtgcggttaattgacaatcaaggattaaccttacttataggcctgttaatttgccatta

SEQ ID NO: 33645 - DNA, 1371 bp, Oryza sativa
tactggttagagcatctcggttggagaatatttccggcgatgacaatgtgacctattctttggagccgtttggtagctagaaacggtgtggtattattatcatgcattgcaaaagtcatgacggtgtactactaaaaaaaaatccataaaaatcagcactataggtacgggaacaactaaaacatgtacctatagtgattttacctcctccacaggctgaaaacacataaaaccgacacatttaagcaactatatgtgtcggttctaaagaaaaaccgacatctatagtataggtgccggttttttaaaacctagcacctttaatatattaaaggtgtcggttaattaaaaaggcacctaggtatcagtttttttaaaaaaaccggcacctatccaaactgagccgagctgccgagccaatctaggccgacgcatcggccttatcccctatatgagtgaaccttatcccctctccatctctcttgtcacgcccagaaatttagcccaaatctccagactattttgtgtattaaatccttgtccaggaccagccagggtacacaaaacgacaagtaatatacagttccaaacgtaaataaagcgtaaaatacttacaaaagaggcacttagtcctcgcaccgaaacgaaagcagcagcagcggaaaaggcgatcctagcggggcttcagctccactccacaggcaaaactcaactggggtctgagccttggtcctctaacttcgtcttcagctcagaagtactacacttctgaaaagggggaataaaagcaagactgagtacaaccaccgtactcagcaagccacaccaacgatgcagatgtgcaaggggatacaaggatggtttgtggctatttgcataaaggcggttataaaacattttattgagcaaaacagtaaaactgttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagctttactcttatcagagctgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacaggcagtcccctctcgtgcctaggtgaatccggaagcgacagaggccgtcgcagggcccgccccgctccatcacgcccacccttgcctggatgcgtcgacta

SEQ ID NO: 33646 - DNA, 299 bp, Oryza sativa
ttccacaggccaattccgaattaatattcgcattgatttaaaagggtttactcttgctttgcaccggtattttcttagggtcatttataaattaaatttaggcttgggaggagaacttcggggtgtgacaccgccgccggcgaccacctggccgtgcgccgccgccccgctcgcctgggccgcccggaccccccttgtcgcgccgcgtcgatctcgtgcgccgccgccgcccatgcgtgccgcctctcccgcgccgcccgtcggtcgccgtcgccggagaccgcgctaccgccgcgcca

SEQ ID NO: 33647 - DNA, 207 bp, Oryza sativa
ttcaagcctctaactgatatattatcttctgataatttcttgtgttctatgtccgtacaagccattaggatgccaggctttgtggatttggagatatttgtttttttcaaccattacacatctgtcattgtgccaatttggtttcaatggaagtcatgaaaacttagcttgctgccttactttagccaatttgtgtcattatgctaa

SEQ ID NO: 33648 - DNA, 185 bp, Oryza sativa
gataagaaccgtacatggatggcgaggcatgactttgaccatcaaccaggtgcttgtctaatagcatcactccactgattgccgcgcattcctgaggtcgtgcaaataaatacagctctgacgagctgcaacttgaatggagtaacgaataatggtatgcctggcctgatagaatttggtgttta

SEQ ID NO: 33649 - DNA, 952 bp, Oryza sativa
ttaaaaatatacactttatttttaataaggcctcttagtgatattttaatttttagtgtagcatgtaataatattatagtgaacttttttttatcttagcaaccagaatgctggtatgccttttgggtgtaaaagtataattagaaccaaaaatccaagatgattctatcacctaacagatactacatgattaaaatgggcgacaattttattttttatcttttgtaaaataaacacgctaggggtgcgcttactaatttgaaacatatatatacttcagtttcttttttggaattttgatatttttcatcaaatattttataaatgaaattgtgaaccgttattttggttttgacaaattggtacatatggtattgaaaaaaatatgtatgtataaataatttatttattatgcatagaaataaaaatatttttatcataaataaatataaactcgtatgcaatgttaagcaaaaggatagaatttaatgccatgtttatagtaaacgtcaattttgagaaaatatatgcaagtcaaatttaagattcaattaaattaattggttccaacatgtacacttgtaggtttgaatatttgaaagagcaaacatttagtatattaagagttctttttttttgcaacgcaatctgtaacataaaatccacaatcaagtttcctctttgcatctgcaagacctctttttatttccttttgttccacaagatttttaggcctactatggagtaggcatagtatatttgaagaaggcaaatgaatggaagtttgtgtgatttgtaaggggaagatagttttggagtaggcatagtatatttgatgaatttattttttttctcaccggtgattctcagattattttctctagtatgaattcatgattttttttcgtcaaagggaggggtgccatgtggacccaatcaaaaagttagcaga

SEQ ID NO: 33650 - DNA, 688 bp, Oryza sativa
catcatctcatggagcgggttgaagcccgtttggacctatatgacactcatgacaagtttggggacccaaaaaattcattttgatagtttagggacctagatgatacatccgtacaagtttaaggaccgcctgtgcacttcactccttatgaaattatttcatcccccactaatgtctttatgaaattctgactttgtgccatacaagtttccattccatgcattattaagttgactgatatatgctgatactctgtttcttggcactcatcgattgcaagttcaggatagcttttttctcttgattaagtgatattattatctttttgtaccttccatcccaacttcctataaatgacagttagagccgtaagtattgcttaatatatgttatattttgctcttttacgaactttgaaacaaattgtcttttgtctcttttgcattgtgaaggttgaggtggagaagcaagtcctagattccagagagaaactagaatactaccgtacaaagatgcaagatcttgtaagcacacttgtaatctcttactagttttcatgtgcaaaatgatttggttaattaaagtaattctggcttgtacatgtgctgattttttaaatgaacataactaggttgctgaaaattgatttattaatgtgatttagttatcattcctttatttgttttg

SEQ ID NO: 33651 - DNA, 1501 bp, Oryza sativa
aaatgattcataataaaagatttgatctcaccctggtctaaaccgacaagtattatcaatccgaagggagtaaatatagagcttgaacctgacttggttctaccacagcgttacgcttcacggttcacattttttatatacttcctccgtttcacaatgtaagtcattctagcactctccacattgtgaaacggatggattatattagtagttcaatcaatcggattgacgctattttttttaaaaaaaataacttataagattggtgatttatactatgttggtagggtaacagtaagcgagcagggttggtgggtgtgggcgtgtggcaaagcagagaggcggctaagcgcgggtcaaagctgagaacaacgccgacgagagacgagtcgtccgcgagtataaaagcggcgggggaggagagtggaggggtggatggaaagcgggtgtgagtgaggaagatccccctataaatcgcacccggaaaagatcaccatccattgcccaattcgccgtcgtcgtcttcttcttccacctcgggaagtcaaatctcgtcgccactgctggttagtctccctcctcctcctcatccacactgcttagattcctctttggtggttgatcggttccgtagcagagttctgcgcgatcggtttttccattgctgatttcatttgccgtggaagggattgtgctacgctgcggccttaggatctcatcgcagccttcgcaggcaaattcctctgttctgtgcgccgtgtttgtgttcatgatctctgtgtttattctgcgtgtgctcctcgatttcctggcgccctgatgcgcttgctgtataggttcgttttaatcatttgaagctctcggaacagaatttgctttgcaagttgcagttctagtttatttcgggattattgggtggttgggctgttgtgtgttctagacttctagtgagtgcagtggttcagttgttgcatgtgttccagtttacccgtacaaaatgtaggggcaccgagttcaattgatttacatttgtagtcttgtagatacttttttttttctgtattagaatctcatagaagcatttgactagcataactacagtacctgtttgtgttttatgagaactttgactataagttggcaaacaatgggagtagttcgctgatgtaagttcagggtagctatattagtagtttagtactgatttcatgaaaccaactttaatcccattcattttgattttttttttctgaagcaaacattcattttgatttacactctgttgcaaattggctgttaggtactgacaggtgattcagttcaagaatccatcattcaaccaatagacctttttgttcatattagcatagattaaagttttggatagattataagttatttgtgaatacctcatattgagactaacagtacttttttttacattcttaggttttgtctccaaaggaagagaccatacagttcatcatgtcaggaggatctg

SEQ ID NO: 33652 - DNA, 247 bp, Oryza sativa
tataagaaaagtagtaattaacatggtttagaccaccaaatatattataaaatatatttaatagtaggtttaataaaattaatttgctattgtggatgttatatatttttctataaatttagtcaaatttcaccaaaatatctaacattccgaaagagagagtactatgctacggaaatactataaaatgctatccgatatagtttacatttgtaaacaccatcctaatgtcatcatgttacctaga

SEQ ID NO: 33653 - DNA, 1501 bp, Oryza sativa
gcggcgaggcgggagcgcagggcggggttccggagccaggcctcgaccaggaggtcgaggagctcgttcctggtgaacggctccagaagcccctcgattccttcctcctcctcctcctcctcgcgctcaccggccgtcgccggcggcggattcatcttcgtgacgtcgtcgtcctcctcctcctccacggcttcatcccctaccatttctcgctcggattgctccacttccgcctccgcctgcgtggcgcgccgcgtccgcccccgcttcctcttccgagccatggggggtttggactttggagagaatcgccgggagatgtggtgggggtttccggcgccgccgtccgccggaagtcggcggctagttttaagcaggccgtccgctggtttgggccgtggaatccaaaagggccataggattttgacaagtcctcccagtgattttcgagacactatcaagtttcaaagtttacacgcattcaaacttgtgtttagttcacgtgccaaaatttttttaagcatacgaacacacattcgaagtattaaatgtagactaataacaaaataaattacagatttcgtctgtaaacgaaacgaatcttttgagcctaattaatccgtcattagcaaatgtttactgtagcaccacattgtcaaatcatggcgcaattagtctcaaaagattcgtctcgcaatttacagtcggactgtgcaattgttttttttctcgtccacatttgatgctccatacatgtgtccaaacatttgatgtgacggaaaagttagaagtttgaagaaaaaagttagaatgtaaacatggcaaatacatatgtcttttttcgaaacacatcattgcgttcttttttttgtgaaacaaggtataaatgcacatgcacgccttactttagcaccttgaaagccgtatacacaattacatgtgttaagtttataacttaatttcaataagttacctaaccagctaggatttcctcaattcattgcatcgcatagatttgagcatatgtacttgtgatttatgaacatctcacactggatttggatagaattttcagcataagtttatccaacacgaatattaagctttacaacaaacagattctaaccatatcaaagatcctgaaaggccaaagagatcattttccatatgcactcaaaacacatcactttccttctcaaatctccaccatcgatggtccgtacaatattgaacaaatgcctgaattgactaaaaacgaattcaaattctgggcgtaaatcttcgcaagttcaactcaatttcaatagcaaaaatgagtacttgaatcccaaattcaatccgcaccgttggatcatcatcagacgccaaaccgacccgaaaaggcatcacgattgaatcgggggagcagcctccctcttccccacccaacccgcaaatccccaaatcgaacccgccgcctcccaaaccctcgctctcccagccccaagaacctcgccgccgc

SEQ ID NO: 33654 - DNA, 1501 bp, Oryza sativa
catcgctatcctcgccatcatcttgaggacgtcaatctccctgttaagccgttcctccgactcctcgagctcattcatcatctcgagcttcagcctgttaagttcctcgacccacttggcctcaaacttgttgaggtactcctcttgctccctcgccagggcgtcgatctgctgctccgcaaccttcagcgtctgccagctggagatggaagaccccaggagccatccaccggtgaacactgatgcctgatacaaacgaaacaaagggaaaatattacaattcatgctgcaaaaagattgtaggtgtaagtgcagtcaagtgtagagtataactccaactccaagttacagcaagtaagttgtacgtgtaagcattctccctggagagaagatgtagagggatgcgctgcaaatcctgggagacttctatgaatattcagcatcatttagatccctctactgctggggggaaatatgcgacagcaatcacaattacaatcattttccattccctattctgttggtgtgatggaggcatcatcaacattgctggagaccattatggcatcaagaaggaattcaatccagaaccaacattactccgattcaacattttccagctcgtttagacttcctaaggaaagaaccttggaatatttgagagtttgttacagagatccaattgaatcactacaattctggaaagatggaggtgcaggttgacactacctgtgattctgggttggctattcctcacatagatggtgttgtggtgatgcaactatcctaccaacttttcagcattgccttgtgtctgtcagtgttgccaatgcacctcgtggtcaaagagtcggctgctattcaggatgacttaaccacaatgatagtgatttcttgggaccctggaggcaaggcttgggtagctcaattgcatcagcttggggacaagctgaaccttaaagagggaggaatgtcatggatatgggctgggccagtgtacaagataggctatggcttgttaggcccaatgggctggcatcgagcagccactacaaaaagggaaacaggcgccactaggatggatatcatcgatcattttgaaagaactgaatggccgcgggctctatccccttctttgctcttacctgaacccccacatctgtttctccaattccctgtctattttatctaattcccatcctatattgcttatccccaattccccaattccactctgctacactttgtatccaagtacttgagttgattgttgtgaactgttatatgctgttgggtgtaaacgtgctgaattaaggggggcttttaactatttcccactgttatatcctccttaattcaggaggatgagctgggatcataacaacaagctgacgattaagatgaattgtgggaaccgcagagaatttgctagagagatgctcagatgctgggccgtcaaaactgaaagaaatttgcgagatgtgattttttaatttttttt

SEQ ID NO: 33655 - DNA, 174 bp, Oryza sativa
caaggtagtataaatgttacaggcttagagtaagtgttcataggccaaatgcgttattgattagggccaatttctcgaaaacgctcacctgagctatgccacattaccacattggacaaaaataggcgaaaaaaagagatgacattagaaagccatgggcattacctagcacaa

SEQ ID NO: 33656 - DNA, 1501 bp, Oryza sativa
gtcgtcgccgggaggcggtccagcttcagcaccctggtctggtcgtcgaggtccaccaggaacgggctccagtagaactccaccgtgcagttgtaatcctgtccgtgatcgcaaaaaaagttcaactgaatttcggtttgatttgctgatgagtagtagtaaaatgcaaaagttttttttttttggtttgtctttagttaccaatgcttggaagatcttgtggtcggcgctggcgtcgtcgacggtggcgcgtgagcggtcgggcgccgcggcgtagaggatgcaggcgagcgactcccacatgttgcggttgagcgagtcgccgacgagcaccactcgcttgtcccggcactgctccagcatctccccaccacgcagcctgataaaaaagtgaagcattattcagtgcgacgtgtgcgatttgcagaggattactcatggagaatcaacacgattattccggtcggaatgatgcaccggaggaatcaggaacagtgaccggggttggttgtcatgtgtgcaactagtgtcaactatgtgtttcaaagtgaaaaataattaattactgccataacactagtagtactatgcacagggcactgtcagagctgtgttcccaactcaaaagcaacgcacatcgtcacaagttgacaactttacccacttttcatttaccttttgtatccaagaacgggccctgagacagtgcgacttgcacgggcttgttcattttagccatcgattacgactgtgtcacaggggatacacacacacaacggagagcattcatgaacgattcatgcgcatttcaaaaacaaatcagattcagaatctactaaagagaccagctttagtttgtctgtccaggatttaaaacaaaatgaagagaaatttcaaaaaggcagaagagatgcaaggtaggtagcagtggccacgcacctgagagcggcggcgcaccgcctgggctgccaccgccagtgctcgtagccggagtccggccggccgttcctccggcaggtgacctggtcgctcaagaaggggcactccccggcgtcgtagagcggatagccggccgggtcgtacacccagctgccgtcgaacaggtcgcaccggacttcatcctgggccggcgccggcgagccatcggaagcagcagcagtagctgggctcggcgcaggtgcagcagcaataatggcaatgcggtcgggcggcaatgagattgaggacgcctcgtccggtcgcttgacgggctccgggtcgtcttgggagaagaggagggcgcgggagaggagaaagagcgagaggcagccgagggcggcgccggcgaggcgcttgcgggtggccatggagggtggtttcagcttcaggggatccattgctagcttagctccaactgctacttcaccggttgctctgcctctgccactgcacttttcactgggatggatgtacacatctgcaactcggtagtagcagtgtatatactggagtggtactacta

SEQ ID NO: 33657 - DNA, 483 bp, Oryza sativa
ttcaatcatacacaataatccatccaatgatctaaatcacactactctattaggacaaaggaaaaaaaaacaatagcaccacaagaagcataacagagtggaagtcaggcagaagatctgtccaaactccaaagcttgcaatgcatttgcagccaggattggagttcaccaagagagcatggggctggaagacgaacatgtggggccattcccaaaaattttcatagaatccctgcattgtctctcgcagtcactgctgctcatcagcctctcacagacctgtttgcctgctgctgctctcttttcatgcagtgaacctgttgaccacacacacacacacactgactgggccccgggccccacccacgcctgcccagcatcggtcagtgaggacttgtcgatccgatgatccaatccgtgtcgggcggtgtggcgccaccaaactggcgtgtgggccccacctgccccaaccctttgccacca

SEQ ID NO: 33658 - DNA, 1501 bp, Oryza sativa
tctgaattctcatagcaatgggctttgttcgctatcaagcaagcgttaattctcagtacagtgctttgctttagatgttcagttagtataaagctattgcaggttctgaggtgctcctgacctgcttccacaatgcaagctaaagaatccaaaaagtcaaggttagatccatctcgagctctcaaatgccaaatttattgtttgatttaaaataaccatttcttcatttaagttagtatactgttgtgtgcagggacaggggccgggaccgtgtgaaatggaatgaagaaaatttgaatgacattgagtcgaccaagccagtaagagaaaaaatcaccgagcctaagacgccatatcactcaatgattgatgaagatgatggtatgtgctttggagcttgcatatagaatcatgttttaatacagctaaagaaaaaattccggacaacatgcatctgatgcttgcatctggtccaagggactgtttctccaaaaagaactattgaagaatcagtggataagtccactcatgctgatgcgattaagactgctttgatggaagctgtttcaagtggaaaattatcagcaagagaacatttggaatcctgtagtaatgaagaagaagaagaagaagaagaagaagaagaagaagaagaagaagaagaagaagaagaagaagaacaagaagaagaagaagaagaagaagaagaagaagaagaagaagaagaagaagaagaggtggccatcaaacaaggcacaggttagtaatctgcagtcttttcttattgacaatgaaaaacgaaatatccttgtgagtggtatcttgactcttaaagtcttaattggcattttgtattttgatgcttgtgcaagtcgttatgatttcggtgctgtactgccatatagcatatcatgtctgatacatctcacataaagaagataaacacaggaaggaataatttcaggtatcctggtctcaggctatggggttgattaagtaacctgatcctgtgatctgtaaatctgatttgaattgtcacattttagaccgatttgtcttcctagctccagaaaatatctactgatagaaagttcaagactcccttttgtctgattactcctttatccacttcacttgtttttttttttaattcaaccctgctgttctattggcatcatggtatgccagaccaaaacttttgcttgatagcaaggtaagagctaatgcagtgtacaccagtaggttagctctagtcctggtttagtagctagttggaccatcaaaatttgtataattgtaaatagatataaatctcccgtgtgtgttttcccgaatcagttggatattttttgtgggatgatgaccattggggaagactggttgcaagctgtgttgctattttcctatctctagttcagattccggaagtcctcaaggcactggtggatacgcttcaatttttactatctatgtgttttgcaagagtaacctcaaatttcac

SEQ ID NO: 33659 - DNA, 1501 bp, Oryza sativa
cgggggtggtggcgatgcacggggaaaaaaaggagtcaggagatggaagaggaagatgcgatgcaaagatgccgacggcttccagggagaaggacgcgaagccatgcgagtgtgacgaagtgcagggcagggactgatggacgagatgacgcggttgccgtcgtgacgtccctctctgctgctgggcttgtctatatggcatcatcgccaagagccgttgaaggcggtggcaagatgggtggtgcgcaggggagaagcttgtcggccggctatagggtgtgggccccaaggacttggcatgtcgctgccgccaactggagagagagaacggaaagagataggggagtagagatgaaaaagaaaaaggcaataaggatgattgacatgtgtgattatttttttaatttttattgacatgtgggtcctacaagcaccacaataaaaccgcttttgaaaccacgaatgagtcgatttacagtggttttaaagatgggagaaacgttatgcctggtttttaggttaagggaagcgatttaaacagaggcaagagacattattacaagggtggggctcggcctttgaaccatacgtgggacaagtttctgcctcatacaaatgagagacaaaatagacttttttttcctgcaaaatactactagtagtaaattaggttgggctcactaaactagaaatgacaaagaagcaagttagcggattatctttattttacaacggtataaaagaagaagagccgtcctacttttattctctcctcccaccacatgctcgcatctcatatataaacttgtgaaacttactctaaccatatagaaccattgcaatacacgggcatatattactagttacacctaattttgtggagtttcatacccaattgagataaggaataattagatttaatgcatatttttctataaattagttttgatatatatcttttagtttctaatttcatatagtttatcttttaaatacaaaacatattttaaaatagaaatatatttcatacacgattatacacaaagcaatcaatgtaaatactagacgccaaaattaaagatagatatatactagctaagtagatgtatagatagatagactcatagataggctgttggagacggaattggctaattataggttgtatttgggcgagtttatttggcccgcaaacgaatcgaccaaagctttgcataggaaatttttgccgatcgtcggagagtacaaacgaggcgcgcgcacgcagcaccagaggcgagtgacccaacaacaaatggaggttcgtcgacgatggtcgtctccggcgacggctgcggccatggctctcgtcctgttcgcctcgtcgtcctcctgtaaacgccctgtaacacacaatatcctctgtggcacgcgcgcgtgcgtgcgcgtctgatttgttggtctcgtgtctcgttaatttgcttactcgatcgctacgttttccattacgaatttgcgatcg

SEQ ID NO: 33660 - DNA, 1501 bp, Oryza sativa
agaggagggtcttaatcaatcatctaacaaaagttgatgacatttgatttagtgattacaatagctaagttaaatgtgctataataaaaaaataaaagaaagaaaaggagtactccttcatttggtgtacccaaaatgaaagggattacaaatgaccaatgtcttagagatatattagcttgaaaacaaatctgaatattcttttatttggacacatgcatacccgctgatcaggctacacgctttatcactaaacccattcacacgtgtatatagtattacatctatccacaaatataatcgattctagatatgcacaggagaagtacatagcaatgatgtctgaaatgtacgtgtaggtacttcctactttccataaaaaaataaattctgactacgaatatgaagaaccatatgtattagggtgtatttagttcacgctaaaattaaaagtttggttaattaaaatgatgtgatggaaaagttggaagtttgtgtgtgtagaaaagttttgatgtgatagaaaagttggaagtttaaaaaaaaaatctttagaactaaactcggcctaaatttatacgcaggatttgatctgttttaggatagggagtctcctcatgacatgtttcatgagaaggaccacttaattctgaatattctcttggacaacggacataaggtgaaatacaccacttaatttgcattcatgctaataaattacatctatggttaaccacaagacctataacatcaaatacctagagttgcaaagaaatcatcatctttttttagctttaataaagacatacactaaagtggtcaagaaaaatagtaggaaaccaatcagtcccagaagaattttacacattcttccttctttacttatctgcacaagacgcacaagaaagaccaggttatctctatgttaggctctttttagttgcaggggtgaaaagttttagcgtgtcatatcggatatatggacacacatttgaagtataaaacgtagactaataataaaacaaattacatattccgcgtataaactgcgagacaaatttattaagcctaattaatccatcattatcaaatgtttaatgtagcaacacattgtcaaatcatgaagaaatgaggcttaaaagattcgtctagcaatttacacgcaatatgtgtaattaactttttttgtctatatttaatactctatatatgtatccaaacattcgatgtgatatgataaaaagtttatgtgtgggaactaaacagggtcttcttagagtagatgttatcccggttttttataaggaaaaagagaaacaggtactctaggaccaggccatgatgaggccaagcggaatctggctcctcgaacttaagctgagccacagaagatcagtacgctgcgtccaccaaccttgcaccagttgggctcgtccatgctccataccccatgttaccccatcgctcattcggccgcgacagcgacagcgttccattgacc

SEQ ID NO: 33661 - DNA, 1501 bp, Oryza sativa
gatagtactttaactcgaatcagtggtttagatttagcaatgttgaaataatcagcaatgctgaaatattcgaagagctaaacgtcaggtgaggctagtcaaaacgatatatgatttgattagtgtttatatatatatcatcaagcatgatccatcacatgcattgcgtacttactccccttaactatacttttttctgcagggtactcctcttaactatatgatacacattctaccggactctgaagtcgtcagagaagaataatcaagcctcaccttccaagtaatacacatgctcagttaagatatcagatcggtgtctgactatcttgagacccccaagcaaatcatttgacaaaccggccaatcggtcagtcgacgatcggcagtgcatgttactccccggatcttacaatattaattgcacatgtccacgtcgaccgcggatgcaatcaaccaaatttgtcaaaaatatatattgctccatcggttgatcgaccgaatagtaaatcacgtcctgtcgtcgattatttatctattgattctgtttcgtcgccaaacaactccatcgactttgattaattagtgtacactatactccttgattctccattaattagtgtttgttaggctaatatatgctgcagtttcttagaaaatcacgagctagaggtagcaggtttctgatcagaagcaggcaagaaactattgaccatatgcagacttacagagcttctctgctgcagttcaagtggttttatgccaaattacatgataatttcgtagctcacgtgcactttaaatcgacctgctgattaagatattagtaagcatggtgtcactgttcaatttaatcatacagggggaatttgatgtagagattaattaagcacttagttgttcataatatgcatggaacatgcattgcagcagaaatattcgagggcatctatcatcgattagaaaatttctttagtcgatggtctgaccgaatctcactaatacgggctgacggttgatgcattattgaggatcataaattcgtacaaataatggacgattatctgcataaactagtttgaaagaaaggcatttttggtggcatctaactgaacgacgggttggctgagattctaactggacagagacgcgtgaaactaaagctttcagtttcacgtagaagacgccattgattttaactgacaaacacgcatcaaatttgcgaaattctgattcgctatgtagtcatttcgtagtcgtaacatagattcaaacgcaggaaagttgagcactttaagcatcctgaccaactacactgatggagcagtacaatttcagtactaagtaggaccgatcagtaaagaagattcagcatggaactgagaccaaacttcaccaaaccgtccggagaatgttcttgacgatgaaacttccggaaaacagagagaaacgaaaagagggcgataaaaatgcgcatggcaacaaaattattttggagcaa

SEQ ID NO: 33662 - DNA, 1501 bp, Oryza sativa
gagtcgtcgtcgtcggcgtgctccgatctccgcgcggggcattcgtccgccgtcgtctcgctctccggtgagggcggccaaaatatatggtgctcgatcgagatgtgatcgagcccggccggcctgccgcttcaccgggagagcgaacacgacgccggcgacttcgcgccgccgcccgtgctgtgctcgtagcccgcccgtttcccttctcgcgcgactcagctcgctttgattttggttgggtttacagcgcagactgcagcttgttggtggcgtgccgggagacgagccgctcgagcgcctcacgcatccaaccgtgctggcatccatccatcgcctgctgcaccgtggcctgcacaaaatcgaatcggcatttagacgcccgtgttcgttctttggtcgatcgaattcgatcgttctcgccgtagaatggcgaatttccgtgtatcaaagtgcgatgggggggtcatgtactactactactcacccaggtgcgcttgcgggaggacatctcgggccactggaggagctcgtcggtgacgcggagagggaacatgaagccctcgtaggtggtgtcgtagcggcggctcttgtagtaccagcagccgagggacgtctcggtgtcgccgcggacgccggcctcctcgagcgcctcgcggcgggcggcctcgtccatggactcgtcgagctcccacccgcccttggggaacatcatgccgtgccccttctgcgacgtgatcaccagcacctccatctcgccgccgctgcgcacccggtacgggatgcaacccaccacgatgcggcccccggcgctcgtgtaccgctgcagctcccgcccctgcctcgccaccagcacggccatcgaatctttgattgttggagagagagagtagggttgtcgttagggttagaattggtgatgcgagaggatggtgctttgcggccatggaggtggagctcgcgggtattagtagcgggaagcgcgtcaggtcaatggaacgctgtcgctgtcgcggccgaatgagcgatggggtaacatggggtatggagcatggacgagcccaactggtgcaaggttggtggacgcagcgtactgatcttctgtggctcagcttaagttcgaggagccagattccgcttggcctcatcatggcctggtcctagagtacctgtttctctttttccttataaaaaaccgggataacatctactctaagaagaccctgtttagttcccacacataaactttttatcatatcacatcgaatgtttggatacatatatagagtattaaatatagacaaaaaaagttaattacacatattgcgtgtaaattgctagacgaatcttttaagcctcatttcttcatgatttgacaatgtgttgctacattaaacatttgataatgatggattaattaggcttaataaatttgtctcgcagtttatacgcggaatatgtaatttgttttattattagtctacgttttatacttcaaatg

SEQ ID NO: 33663 - DNA, 1501 bp, Oryza sativa
tggtcgcggccgccgagctcgacgatgcggcgctcccagtggccgcgctcgcggaggagcttgttgatctcgtcgttgaggtcgcggaggcggtgctccccgaggccctcgttctggatctcggcgaccttggcgccgatctcgcggaggatctcggagcgccaccgctcggcgtcggcgaggtcgcggcactcggaggcgaggtacggccgccgctcccgtggcttccgcttctcctcctgcttcatcgtgatgaagcggttcagcatggactgagccttctcctcgtttcgcgccatggcggccggtcgggaggcggcggtggccggtggccgaaggcggcggcggcggcggcgaggttcttggggctgggagagcgagggtttgggaggcggcgggttcgatttggggatttgcgggttgggtggggaagagggaggctgctcccccgattcaatcgtgatgccttttcgggtcggtttggcgtctgatgatgatccaacggtgcggattgaatttgggattcaagtactcatttttgctattgaaattgagttgaacttgcgaagatttacgcccagaatttgaattcgtttttagtcaattcaggcatttgttcaatattgtacggaccatcgatggtggagatttgagaaggaaagtgatgtgttttgagtgcatatggaaaatgatctctttggcctttcaggatctttgatatggttagaatctgtttgttgtaaagcttaatattcgtgttggataaacttatgctgaaaattctatccaaatccagtgtgagatgttcataaatcacaagtacatatgctcaaatctatgcgatgcaatgaattgaggaaatcctagctggttaggtaacttattgaaattaagttataaacttaacacatgtaattgtgtatacggctttcaaggtgctaaagtaaggcgtgcatgtgcatttataccttgtttcacaaaaaaaagaacgcaatgatgtgtttcgaaaaaagacatatgtatttgccatgtttacattctaacttttttcttcaaacttctaacttttccgtcacatcaaatgtttggacacatgtatggagcatcaaatgtggacgagaaaaaaaacaattgcacagtccgactgtaaattgcgagacgaatcttttgagactaattgcgccatgatttgacaatgtggtgctacagtaaacatttgctaatgacggattaattaggctcaaaagattcgtttcgtttacagacgaaatctgtaatttattttgttattagtctacatttaatacttcgaatgtgtgttcgtatgcttaaaaaaattttggcacgtgaactaaacacaagtttgaatgcgtgtaaactttgaaacttgatagtgtctcgaaaatcactgggaggacttgtcaaaatcctatggcccttttggattccacggcccaaaccagcggacggcctgcttaaaactagccgccgacttccggcg

SEQ ID NO: 33664 - DNA, 1501 bp, Oryza sativa
ctgattcggactgatagtagtcataccatatcctaaaccatattttttaagtggattcgaagcggttgcggatagtgtgcggatacggatacagagcggattggttcggatgtcagaaatggagtggagtcggtgcggaatcggttcggaaacggattaaatttatcggatgttacgtgtatatgcaatcaatacaacatcgagttagcaatgcaatgaataataatacaataattaataaatgacctatcgtaataattatatgcttaaggctaaacaagtaaacaacatgaatacattatgtccataatataaaaaacagctacgtaagtataatatgagacggtgaaagtctcatattaagaaatctaggttaattgatgaattagaccattggatggaccaacttatattatatgtaatagatagagtggttacatgtgttaataatttcgtattatccggcaaacgttctatcggataatccgatagaaaagtcagataatccgcatccatcggatttcagaaataccatatccgcatccgcatccatatccgccggatttctaaaaactcctaccatatcctcgttacggacggattcggagcggatcggatcggatattatccgatccgttttcacccgtaattttatattatggagaaatttaacaatattccatctattatgttgctttgaatcgatcgctagtcaaatttctttaggtttgataaaaaaatagtaatatctataataccaacttagttttattaaatataatataatattgaatatattttgataatatgtttattttgtgttgaaaatgttactatgcttttttttataaatttggttaaactcaataaggttttgatatgaaaagttaaagcgacgatttataatataaaacgaagggaatattacataattaacgtgctgctgtattcttaatctagatcgagcatgattctggaaacgtcactctcagtctgagatatggttcggcctgtaaggaaattaagagatgattatgcactgttaggcacctgtaatttggctctctctagctccaagttgcagaaagctgggcgttcctattcgtaatgcagcattagttttttttttaaggaatgatgcagcattagtgagcagtagtactagattctattctagttaagcctgcatgcagtgatgcaggtcaggtcagttgaactaaagaattcaaagcagccgccctaagctagcttgaagcccgacactcgaataatgcacatatcattgacgagagtgagaggagtgtggtgctatatgcctttctttctttttctgttcctcgctttcagatcgccgggcgtgcattgcatcgaccggtttgcaggtcctttcccaaggtcgcatatcgcatcgatctctcaaaggtgagagatcaaatataatccaagcgtcatactactagtcaaagaacgcgtgcacattcttaaaaaggaagagatctta

SEQ ID NO: 33665 - DNA, 1501 bp, Oryza sativa
gacgccaccataaaagagggttgcagaggaaaagagcgagagggaaaaaagatccactcatccctcctacaaacctgttgccatgatgataatctgagggtgccaacgctaatgagagaaagttgttagagggcgatgcgcaaagacatagcctccaatgaggtcatgataccgagaaatgctatcaccgtcgcccacccaattaatttggacaaggttttcatctagagagtcccatagtggaggagaattaaggcaccgtgacaactagaggaggataatgagttagctcgtctcgtttgagcttgttgttttaatgagccagttcggcttactcgttaacgagctagaaggttgactcggctcgacttgcaagctggctcgttaagctcgttaatgagctatatctcatttaccattttatcatatattaacataataataacactaaatagtaaacaaagaactcactaaatatgaatagttttgatgtaattaaaatactaagcactagttaaaacactaattatataaagatacgatgatatcttatactaacgagctaaaagactagctcaattcgactcactaagactgtaagtttgagccgatccgagacgagctctttacgaaaccaatctaagccataagtttcgagttttttatccgctcctatcgacgacacctccaatggaaatcacaacgcccaaagcgtcgccgttgccgttccggcggacttttaggctcggctttcgctgggagaagacgcgtgggggtgatgattcgtgattacacgaggggatacgcccgtgccgggctgccttactgctacggcccacggcccaaacgctcgggccacgccatctgattagagatttgatcctataccttcctaaacatttgaggatttattcactttccttgtctcactgttatgctcgcgctgcctcacctcccgggagaagtgtgaaaaaaatctttaatatagtttaaatggtatatgttgtgagatcatataatgtcacttgtcaattttcagggctaatttagattgctgtcaaaataaacctttctaaaatttgacaatactaaaattttgataagttggcaacattgccaaatttcgatagaatcgattaaatatgttattgccaaaattctttaggtattatatatgtttggtaataaactaaatgtatccatatgtttatcaattttactttaaaaaataatatgatttaaaataacatcaatctgaacgggctttcaatttaaatggaaagtataggatcaaatttcacccagatggagagtaatctcaattgttgttgttaagcttaaccattaaggcaaggtatcaaattgttctctataagaaaaaaaaaaagcaagccacggaattggtgatctggccgtctcactgccaagtgggccatcccacggatgcctttttttattactaattaacgccttcttttcctactaaacgctcccatccctc

SEQ ID NO: 33666 - DNA, 1501 bp, Oryza sativa
  unsure (1)..(1501): unsure at all n locations
cggccgctagtcgggggcgctcgatgatgccgacggcagtggcggagacggggatggctgcgctcggcggcggcgcgaggcgggaggcggaggcgctcggagacgacaacgcgacgacggcggcggcagcggcgggggaggtggaggcggcagcgcgagccgacggggacgacgatggctacgttgcaaggcggaggcgggggcgcgaggggaaggcggaggcgacgacggcggcgcgagggggaggcagacgcagcgggagagggagagggtgggatgagaggtggcggcggctagggttttttgggggaggtggacgcggccgcggcggtagaggtgggcgcggccggggggcgcgaggggcaagaagcggcggcgcgtggcggcgacggcgggagaggggaagggagaggatgagggtgtgtttagttgagaaaatgaaaatttttgggtgccacatcggacgcttgaccgaatgtcggaaagggttttcggacacaaatgaaaaaacacacctcataacccggcnaaaaacgccacacgaatctnctnaaccaaaaaaacccatcannagnnaannangcncaaaagattcgtctcgtaatttcctccctaattgtgtaattagttttttatttatctacatctaatgcttcatgcatgtgtctaaagatttgatgtgatatttttgggaaaaaattttggggaactaaacgggcctgaggagagacgagagagaagagggcggcggcggctagggtttggggcagttagagttagtgcgcgtcgctttgcggaaaagcccctcgtcttttaagttttacatcgctgtccttactcgcgatttttccctcgttttaatgtatatccgacttttataagggtctcgacctaaaataacatctcacaggtactgtttggagggagctatttcgaattacaaacaaattggagggctttttcgaaaaatcaccaccgcgcgcactgttcctatcctacgtggcatagccgagcggacgccccttccgccgctcttaatggtttctaatgtgtcatttattccatactttgcgctggtaaaagttgctttttgatattttattattcttcaggcatatgcgcgaaccaaacgcacaaagcttcagcctgcctgatgaggcaagtgttacatctcccaacgctgcctgtccggcgtgagtttttctcaggcgtggccctcaggacacaaaccaaacaaccccttaggccttgtgtattatttacaagatggaaaaaaaaggaaaaagttcacttgacgtccctcattttgtcgtcgagttttgtaatactggatataatgcatcccgaatatttgcaaaacggtcacattaggtctgaagacagtatagctcccaaatttagttgacgtggcatgtgagtcagtgtgggacccatatgaaccccacatgtcagcaccacaagtccacaataccctcttccattcccatcccctctcttccca

SEQ ID NO: 33667 - DNA, 1501 bp, Oryza sativa
tcacgcatatattcacccatatgaacgcacatgtatactttactcatatattatctccagaagactgactgacatgtggatgaagtcaccacgggtgttttgctgtcgacagatatgtttgtcactaaaaaaataattagctgtaagtatgatcatcagtgttaagtctatgattaaaatttgggtgggttggttccaccataatgaacttaaccgtacgccgtattctttttttttcttcttttaaatttgaaggatttaggagtttatgatcctgtgtgaatgtagttcatacataggtccagttttttatggttcatgagttcataccaaatggcatgtggaataattaattgattttgtgtgtcactttgatttcaattttgtaattgtttttttccacattcttgactaggataaggtgatactaaccgggatctataatcatgcaagaaaaggaccggttcatcctataaaactagaattattcaaagtccagtcgttgtttatgcaactgcttgcttttgtcaccattgtattcagttcgtcacttgcgcgaacagtacggtaactttcgctcggaataccggctaagtcgaagtaaatcttatgcagtggctgtgaaatttcttttgagaaatactccctccggtttcattttaattgatattttggacaatgacacggtttacaaaatataactttgaccttatttttctattataatatacacaataaataaatatatgtttactttttatagtgttttgaaagacaaatttatatatgttgttcgagtttctttaaactaaatatttttaaagttattgatggtcaaagttataaaagtttgacctcaatcttatctaaaacgtcaattattatagaaccggagggagtacagttgcaattctttcatctgagtaattcagctgatcgctgcagctttcataatgccaccaccgatcattcagaataatcactggtggttgtagatttgtaggcggcggtaaaatatgtgtggacatctcgcattttcaaacctaggaataactcacaccaacttcttcaatttttaagactaactcaaaccaagtgagctactctagaaacttatactggtaattagctaggtcaaatcacaggtactgctattagaccctacttaccaaacagtagctgtacttttcctaccactatggattgcctgaaagcaactcagttaatacaagctatacatcactgacttcttttagcaattaaatacatggtgacatgttaatacagccacttgaaatgtttcattaatccgtgttttacagattactgagtaatggtcattatggtttttaaccacatcagtgtgatcattcaactaagctagctaagtttgtcaatttagggagcatttcttttggaagatacaccatttgtctttaaaaaaatcaaatcattaccatgaatctgaattgggacggaggaaatatctaacaatggattt

SEQ ID NO: 33668 - DNA, 440 bp, Oryza sativa
cagcatcacgaatatgtgtgagtccctgctccttggcagtttcatggcttgtcgcgttgtcatgatttttttccttcctgcttcacctaagcaactcgttgtaagtagaggaaaacagaggtcaggctgctgctcaaacaaagggaaaattggttttaggcacattttaaagcaatttggatagcggcagacataacattatggctattaccagaacctgattgcatttctgaattctgaacatttatgaacttaattgcatttctgaacttttgtgagatcagggactcttttaccatttctttcttgcttttttaatgcctaaatcatcttatcttatgttgtttgctatagaaaattatataatgttctgtcactgaagtactaccaatttaccgagaacttagtggaaacaacaactgtaatttactgcttgcagt

SEQ ID NO: 33669 - DNA, 1501 bp, Oryza sativa
gaaaaaaattcattaattttttaattatagtgtatagtgattccaatgacttagctcttaatagttgttgttgtatcataaaaaatgtatttacccgttgcaacgcaccggtattttttttagtattataaaaatttaagatgtttttgccactgatttcgtccgtcgccccccttcatcattcatcaggttcatccgattccccattttcaaacgcttcgtagtcggatcaggatttccgagtaaaactaacaaagccattttgtaaaattaattggatcggtttgtggcagcaacgatcatggcccaagacacagcccacgaagccagttgcacggcccaccatttgctacgtatgcaggttatacagagaccatataacagatggtctgcaattatacgtggaattcaaagtatttcttttaccagcatgtatctatttgtcgggtgatttctaataaaaaaaatcacccaattttttttaccctttatttatatccaacggactacaaaagaaaaataacaaatacatattaacttacacattatttttatcaaaattacagtacacttacatgtcaaatcaactaaatttacaaatgtaattttagttatataggactgtaattttaaaatataattttatattttaaagaaaataataagtacatatttacttacacattatttttatcaaaaattacagtgcacttatatgtcaaatcaattaaatttacaaatgcaattttagttatatagggctgtaattttattttttttattttttattttagtttcaaatgtcttaatttttcaatggttaaagaaatcaatttttatttagatgtttaagatatgttaaatttgttgtatcgattagtacttaatttgacatgtaaattaacatagagatatttcttaattagacatatgaaaattacatacttcacgtattttattcacacgacaagaataacacaccttaactccctgtcgacctcatccacggcaattgctgcacaaatcttggcgcaaagatcatgtggctaaaaaaacgtcaaatgccaagaaaaaaaatcacgcgggagatgtttagcaatttttccctctaacttggttcggactcgaaacatactaaggaaaaggctaatcaagaaaacactaattacttttggtaatctagacgctaatgactctactaatgaaccgtgactaattaacctatcaacactggaattgaaccaatatatcttataactacttaaaaaatctgtaactttccattcttcacatcaatttttcgtcaatgagtccagtcgaacgatggcctccgttcccacacgcgcgagtaatacatcacgtaagatggataaaacacaaattcaaatatagatacaaaatccaatcagacaatccaaagaaagagaaaggaacagaaaaaataataaaaaacacacaaatcttatcttaatcttcgtcatcgcctgatctacccgtggaa

SEQ ID NO: 33670 - DNA, 1501 bp, Oryza sativa
gtgggcccccgtcacactgcgccatataaaagaggggtggaggccggcacggcactgggtacgaagttcaccgccgccgccaactccaccccacaaaaccctaatccgatcgagaggggggcagccagtgacgggaaacgccaccgccgcgccacgcctcatcgccgggacgtctacgaccaccactgccgcagccgtcatcgccgtcgacctcaccggcgccgcatctacgtcaagccgcgacgacaacgacgatgtccggcgcctcttcctcctcgaactcctcaaccggtcggtatctaaaccctctccctttcatcgacaatgtcgttcatcaaacccaaatagaaccacccgactagatctaacctaggtgatcctagtgcaaagtctaacaatggtatcagagcaaccctagggcttagatcggttcgggaaaagaaatccaaagaaagaaaagcacaagatccgcacggatcaaaagagccgaaaaccctaaccctaatcttacctcgtcgccggccgtcgccgacgccggcaacggagggggggaggggcaaagaggcgccgcctaggagccactcgacggccgcgcgcgcacctgcacgcgcgtaccggcgagggggcccgcggcggcgccgccatctccgtcgtcgccatctctctctcacacggtgggggttagagacggtggggggagcggagaagaagagaaaaggcgctggccatggcgcggcgggcgcgaaggtcgccggcgatggcgacgccgtccacgcggtcgcgtgagagagagaagagaagagaatctagggtttttcggcggccggccgggagaggggggttttgatcctccgatctcggcgcccggccgtccgatcgaaaccctagctgatcggacggtcgacgccggccgggccgaaatcggcccaagaaggcgcgcgcggggggcggttttcctggcccaggcccaggttgcggcttggggaaagggggcgcccgcccgtgccaaaagggccgtgggccgccggcaaaagttcaaattaggtccctcgggggccgaaaatgaataaaagagaacagtagaaattttccattttattttgtcaattttcatgcaaatttcaatagaattttgaatagttttttgcatgttttacctctgtttaaatttgaaccaacgggagaattttcacagagagagaattacagagattttgctactgttcatatgatttttatagttttccgctgcaaatagatgtaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttgatgttaattttgttctcaccgcacatgattatttcaggtggctact

SEQ ID NO: 33671 - DNA, 1501 bp, Oryza sativa
gatgatgagaatgccatcgaacttttgtgtcgttgggatgttcaagattccgtctttctgtgacctgtgcaggtgagaatggaacaattgatgggcaaggcagcgtgtggtgggatatgtggaggaagcgaacactgcccttcacaagaccacatctattggagctaatatcctccactgatgtgatcatctccaatgtcgtcttccaggattcgccattttggaacatccatccggtgtattgcaggtgaacacaaacagatcactttgttatacttcagagcctacactccaggcattattgtgaactccattgctcacatatggcttttggacactccgttcaattagcatattgtgcttctgcagcaatgtagatccactttgatggatgtagaggctgggttttaatccattatctaaaaaattagcatattgtgcttctgcagcaatgtagtaattacgaacgtaaccgtgttggctccacatgactccccaaataccgatggaattgatccaggtacaagagttgtttcactttgtaaatctgtgcgcaaaattccctatgcctattctgaatcaagatcttggactcaaacactgcagattcaagcagcaatgtctgcattgaggattcctacatttcgacaggagatgacttgatctccatcaagagtggctgggatgagtatggcatagcctttgggcgacccagctccggcatcacgatcagacgtataacaggatcaggaccatttgcaggctttgcagtgggaagtgaaacctccggtggtgtggagaatgtccatgtagagcacctgaatttcttcggcatgggtgtcggaatccatgtcaagaccaactccggaaggggaggattcatccgaaacatcacggtctcagaagtgaccctcaatggagctcgatacggtttgcgaatcgccggagatgttggagggcatcctgatgcatcatatgatccgagcaagcttcctgtcgtcgacggcgtgacgataaaaaatgtctggggtcagaacatccggcaagccgggctggtaaggggtatcagggactcggttttcagtcggatttgcctctcaaatgttaagctctatggtggtgattctgttggtccatggaaatgccgagctgtcagcggtggcgctcttgatgtgcagccatcgccgtgcgcagagctgacaagtacatctgagatgagcttttgtacaaattagatcagatacaaaagtgaatgatagtcatataatccatcctgaaataaaattcgtcatgttccttttttttggcaaaaggttgagttgttgtgccgattgattaaaaatgtaactgaaacaatgaattgtacttatccaatataataattcagtaccatatgtggcataaaagatcaattcctgcgttcatatgtatctgtaaaactacgtcaaatctacttccccaatagggaaatgcatacaaattacaattgtatgtatggatt

SEQ ID NO: 33672 - DNA, 198 bp, Oryza sativa
tatctgtaccgttgaatctgcacttgttaagtccacttgtttgaaactcatggtcactatgcgccaagaaaaaagaaaagagttgattgccactgttagtgccactagcaattaacttctctgcatgttactctgttcttatattcttttatgttgatagttaaggatttggtcaccacttatgtttgttttttcatg

SEQ ID NO: 33673 - DNA, 235 bp, Oryza sativa
  unsure (1)..(235): unsure at all n locations
agctcctacctgaattngactggtagaaacngcccanccnngntatgaacgcgctgatcctgatgcaacaacctgcagctatgcatactgatcgatcagaggattgcccggggaactgggttgtttggctctgtggtcaactggaagagcgagcttattaaaactgagaagcatgtgcattagatcgttccaaacatatgatgagaaacaactcatctacgcccagacatccaca

SEQ ID NO: 33674 - DNA, 1501 bp, Oryza sativa
tgattatagatcccggttagtatcaccttatcctagtcaagaatgtggaaaaaaacaattacaaaattgaaatcaaagtgacacacaaaatcaattaattattccacatgccatttggtatgaactcatgaaccataaaaaactggacctatgtatgaactacattcacacaggatcataaactcctaaatccttcaaatttaaaagaagaaaaaaaaagaatacggcgtacggttaagttcattatggtggaaccaacccacccaaattttaatcatagacttaacactgatgatcatacttacagctaattatttttttagtgacaaacatatctgtcgacagcaaaacacccgtggtgacttcatccacatgtcagtcagtcttctggagataatatatgagtaaagtatacatgtgcgttcatatgggtgaatatatgcgtgatatgagcacctatgtctatattattttctcattcaatgctttcttcgtaaaaaaaacatattgacggagggagtactacctcctttctaaattagtggtcgttttgactttcttcttgcaatgtttgattatttgttttatttgaaaaattagtgcaaatataaaaaagataagttatacttaaagtacttttgataataaagcaagtcacaaataaaataaataataattctataattttttgaataagataaatgatcaaacattacgaacaaaaactcacaacaacaaatattttgggacggaggtagtaatacataagaagaagaagaaatgaatgtgagttggcatttactttctccgtcccaaaaataagtgtacttttacactgttcacgtctaacgtttaaccgctgatcttatttaaaaaaaatttatgattagtatttttgttgttattagatgataaaacatgaatagtattttatgtgagacttacttttttttattttttttcaaataagacggatggtcaaataaataatatttctataatttttgaataacataaatgatcaaacattataaacaaaaactcacaacgataaatattttgagacggatacagtagtacataagaagaagaagaaatgaatgccgagctggcatttacttagctaaagcacagcgtttattaactcggtagccgttccgaccgtttcctcccctccctctcccgcggtttgcaaggacgccctctcgttcaaacgttcgtctgttcaaacgtcaacctttccaattcaaacaatcaaacccctttacccttctcccaacctcctcctatttgaacccttcccaccacctccagtctcccgtattgaactcttctcagctcaaagccttacaccacaacacgcagctgttctcgctgggcttctcttcttgcgctgcggtgatcgatcgagagcttgggatggcgctgctggcgcggagggcgcggaaggcggtgatggcgaaggcgccggcgccgctgctgcagaagaggggtggcggcg

SEQ ID NO: 33675 - DNA, 487 bp, Oryza sativa
tgatctatcccttccccaccttctcactctcttgtagcgcccattcattcagttgtttgtaacaagccacacaataaaataaaacagaatgccgaaaccaactttgtctaatcttaatggtataaaagtgaggacttaaaaattaagatcttggtatacagatagtggttattcagatgtaagatgatcgcatgaatgctgtgcaatttccataacataaaacaattccccaactttctatcagtaatttggtcctggtttatcaatatgccaggttgtaatgagttgtgtcagaaaaaacaatcaagacaaaaatgagcggtcatatgagtatcacaaacaatcacagatagagtcgcatagctcaagactgacagtaatggccatggttcatgtgtcatgattgagttgaggaacttcactatgaaaagagaaaataataagtcattgagtggttgagttagatgacacctagaaactgaaaaca

SEQ ID NO: 33676 - DNA, 1501 bp, Oryza sativa
aattaaagtccaggatatggaaaatgatgatggaggaatgtgaaatcgatttttgcaatcagttagagtagaaaacatacgggaggtagatcgaacgtggcagtggcgctagggttcggcccagaccagacgagatcgaaaaaagacaaaaaaaaaccggacttactgcgtgcgaagaaaaaaaaccatttcgcgtgcaaaaaaagcaaaaaaaataaaccgctcagaccaaggaaagcggaagcttggcggctcaggcggggcacgctaagcgcgtgcggatcggatcagagatcaggaaaaagacaaaaaaaaaaaagaaaaagaaaaaaaagggacttcccgcatacgcggagaaaaaaccttttcgcgtgaaaataaagggtgacaaaaaaataaactgcactgaccaagaaaaccgcacgattggcggctgaggcggggcgtgctatgcgcatgcaaataagagcagagaacggaaaaaaaagacaaaaaaaaaaggacttaccctgcgcgggaaaaatcccgttccgcgtgaagaaaaaacggcgacaaaaataataaccggacgaaccaaactaaaaccggatactctttttttttattcgatcatcataggcaaaaaccgaggtaggtaaagtagacttattccttccccttaagttgacagcccatattatcagtttggccagctttctacagcccaattagatttgcacacataaaggaatttttttttatttttaattttttttattaaaagttttacaaaaataattttccattttgaaaattgacggaagtagtcgcctaccgccctctgggagggcgatttttaaaaatcgccatcccagagggcggcgaaaatgacgtggcagacggccgttcgctctcgggcgacggccgtcaacgaaatttgcaagcggcccccttgccgccctctgctagggcgattttgtactgtgcggggggccgcctgcaaatgggcggcgagggggcatggaattttgcaggcggcccccttgccgccctgggggagggcgattttttcctccccctataaagcccagtcccccctctctgaaatttcattatattcactaaaaatccaaaaaaaaacgaaagagagagaggggagggcagcagaaggggagcggcgaagccctgctggttcgctcacttcatcacatgtttgctcccatacatcttttgcatttgtactaatatgttatgtttgagtatatatgttgcgtttttgttttagttccatatattttagcatatctgtagcacacagcacatatgtgtagatccagagcatagaatataatagtatgaattgagacatagacaatagtgttaattgtaagatatagtttagtttgatctagagaatgtaacctacttttagaattttggagaacaatattgtagagaatgtaacttagggcgtagtacagaaatgcgaggttaacgcagttattgttttcatcaggcacaa

SEQ ID NO: 33677 - DNA, 1501 bp, Oryza sativa
ccttgtgtgattgatacattggttaattaatgatgcagaaccagccttttgtttttctgtgctaccaaaattgaccttgctagctatgaacgacatacgtcttggcatatctattttggtaaaaagattaaattttattgtacatacgatttgtgccctttacagttcctaaatcctgctggcggatacgttcacttaagctttgctcaatgcgatcattcacactataagtttctcagatttttttttctgaataagctgataagtagtactatgccacctgtgagaagaaaaaaagttattgtttgtatgtgtgagaaaaaaaggttattttctgcatgtgtgagaaaataagttattaattatctgcatatgtttccctagttcaaatagcaggcttaatcttttgtcaagctaggaaaaattctaaccgtctcagcattactgcagagtgtttgggctgcaactaatttttgaagtacagtgagtctcagaccttggagataaattactgaagaactggactctaatgtgagtacctgtttaatatctgttctattaaccttgaaagatttctttgtaacaagttttaaattcagtcaacactgcttaagacttaaaataattaagtatatttttcttataaattctgtgccgctatggctcttttcaatgcgcgcattcactgtttggaatgcgagtatgttcaaacttaagagtagcatttggatattgctgttttaaaaccatattggtgaatatgcagatttctgacttgctcttttcaacaaaaataaactatgatatacacacattacttcagcaaacatgactttagcagctaagcttttctgaaacttgatgtgtgtgtgtttagtacttcctccgttttatattataagactttctagcattgtccacattcatatatatgttaatgaatctagacatgtatgtgtatttagattcattaacatctatagagggagtatgtttgttgaagtctgattttagagataaacttagaggtacaattgctcagctgccaagatctgttttatagaggtacaattgctcagctgccaagatctgttttataggggtacaactatacaaatgtgactcatggcttcttcttttttccctctctttaattaaggctgatgaaagatcgggtccgtgcatttgagaagaggatgaggagggatctgttcgttggttgcaggcttgccaacttccttgggttttgtggtgggtgctatcttttcgcccgtgtctacatgtagttgtttgatgaaaacaaatcaacgaacacacagaaaatagagaaaccctgtattttattaatcatgattcattaacatgaatgtttacaaaatacataggagggctcccacagaagttcgccttttgccttcgcgaggaatgcttaatggaaaggtatgctaactggagattgcgtgcagtctgctgattcccggcgcctagcaatgaggctgcc

SEQ ID NO: 33678 - DNA, 1501 bp, Oryza sativa
gagggaggaggggagaaggagagggagatcgatctgagcggatgggaagggaggacggggaggagagggccgggagatgggaggaggaaggggaggaggcggagggggaggaggagagggagatcgatctgagaggataaatgcgaggcggttgtggaggagtggataggaaagaaggattatatattaagcgttgaattttagtcccggttggtaatatcaaccgggactaaaaatcttctagatctttacttccagttgataacaccaaccggaagtaaagttaggatttttatcccggttggtaacaccaaccgggagtaaagatcccggggggcctgacaggtttagaaccgggactaaagatcaaatatatccactgtagccaccaaccgggactaaagatcatctttagtccttgatctttagtcctggtttttagtggaaccgggactattgtgaatttcggccgaccgaccaaagatggtttctccaccagtggtcgctcaattcggttcaacacaattaacctcggatgatattggttatggtaacagcccacggtgggtgggttactgggtcgggttgtgtcgtgcatgccgcctatggccatatcatttgactctcgattcaaatttaacgactaaattataactttgctacgatattatcgacatatttttaaattgccttaccgcaatgatatttcgacgattatagataaaataatcatagaactgtaactctattataatcctcaatgattaccataagcgacacatcaactctgactttaaagcagatgcaacatcaatacctagcaaactgccagaatgatcaagcggccttgatttcccctgatggactttagccaaagccgcctaaacgcccaaatctattcgcggccagcaactatacaccctaagagctggtacaatagcaggctataagccagctataaacatattttaaagagataaaagaagagagagaagagcagcgggctacaaatctgtagccagctgcagcacggtttccaagacatattgggtgtatgataggtgtataataggtgggaccatgtattaatagtataataagcaactattgtatgaattgtctattacattggctatagatgatttggagctagtagtggactatactattaaacttgctctaacaaagaaattggttaattatgcctcgtgagccgaccgcgttggtttcccgcccatgctcgttgagttgtagcccacatatggcatagaagtattagagcaggtacaatagcaggcaagctagctataaacatattttaaagagagaaagaaaaagagagaagagcatcgggctatagatctgtagccagctgcagcacggactacaagacgtaatgtgtgtatgaatatgagaccatatattaatagtatagtaactaaatattgtatgaattagctattacattggctatagataatttggagctagcagtgggcta

SEQ ID NO: 33679 - DNA, 209 bp, Oryza sativa
gcaccccgatcccctcagttatcacgaatggacccaaaagagtagcagaaccgttgaacatatcacaatatagtttttccacgggtagataacgatatatcaaatccttgccgacacaaaattagagatgtcataaagaaagtgatatgcccatacacagacagaccagaacaatacgattgcatgattacaatgacacattaagaaaa

SEQ ID NO: 33680 - DNA, 1501 bp, Oryza sativa
tccaagattttagagctggttcatagctttataaatttatgaatatggatttacaattacattgataatgaatcattttgttcccattttacataaaatataaaattataaacctctgcaatttcacatctattatgcaatattgtttccgaaatcttttgatatgtatgtatagagggtgcattagcatataattaagcttaatttctgaaagatgtgtttggagaaaacggtctgaagaagagacgcgccttcaacatatattacgacgactctccttttccttttgcttacttaattcttgttggtaatcttcaatgcatatatcaaatagtttgtaataacgtatggcttgaacttgtcgtcacagctaaaaaacaatggcacgtggaggtttactgaaagttactaaataccacgaaggacgggctgcgatttcgtgattgtctagctcggagcgatcgagttgaaacataaaacagaaaagcaaatggacaactcgctgcagcgtaaaattgtcgagcttattcatttggactctaaacaatcttttctaaaaataaaaagaaactaattgattctgcctaattaatagataaattgctatgccatatccttcttaaatttggtctcttccagataagctttctttattaattgattaatttacttaaccaaatccactaagaatatgactgctggtgaccttcaatcaaccaatctctagaactctaatactctaatactggtactgactctaaccgatgatgactttggaggttaattactaaatttttgtattaatacgtacaagccaggagtctatctaagacttcttctttaaaaagcttatatgactggaggaacaaatattgagaaaaatgaattcaaccatcgtactcaataaatcatatcggaaaatgcaagtggtacaaggagtaatataataggttgaggttttgcataaaggcaattttcaaacaggcaaggtttaaagcttcaaagcacgatcttaatctattcatattattaatcagcacacctgcacgaactttgctttaactcatgccatcaagttgtagttccaaacattctagtttaacatagtaaaatctctaacttgggtatatttatttttagggttgtccataaccgattgttaatacattataggatccatcaaaacgtacaaactgttgtgctaaatgttagccctactcaacttcaaaacgtacattttgacttaacagagttctctctggtggtctgtcctcacaggacctgggagagagaatggtgatcacaatatctgcatgttttctgcttgatctatctatgcttatgcatgtttatacttcacatcctgcaaactatcccaaagcatttgctgtacgtagtctgcagctcgatctgtgcatttcacctcgtattccatcacatgcatgctttatcccattatctctatgaaaaaaaaaaactggcaagatagtcctcaagttat

SEQ ID NO: 33681 - DNA, 1501 bp, Oryza sativa
caatcagccagaccgacttatgtcgggaaggtataaaaagcaaaataaaaaaatgaaactaggaaaagactagctactacagcggctaaacgcaactaggaaaagaacttgtattgttacgtgtaggatggataaaaaataaacttatttgaattttgggacagagggaacatagtttattttttcaattcgttgttcgaaaaaaaaaggaagctggatcgatcgagttgtcgcctcgttgatttgccaaataaatcgatcgagtattagtttattagtttggagtatatattgccctcgaaaaaaatagtttggagtatgactttattagatgcatgcttaattaattaaagaccacaaagttaacgggccatgtagctattttgacctcaaatctatactttctatatactttctatatagttggtacccactaacaattattagaaactaaaacttaacatgcaaagcatgccacattatcatccactagcaattactactattttagcccatttaaaattccatgcaagtatgccacatcttcactcactagcaattactattctagcctatttaaatctcatgcaagcatgatacatcatctacaatattatattttagagatcaacaagtatgtgtcaaatcatcttcctcacattattttctcaacatttcaaccttcatcatttcgacaatatttaacatatattcatcgatgaatcccgcagcgaagcgtggggtatcacctagtataattaaggagataaaccatacgcagaccgctaataaattacggctttgctaaaattatgtcgatatatttctaggctaaatacagtcagtttgacgatctgccatctaatcttcttcatgattcgtgcaaagtacatctgataagctgatcgaacaacttgttcctaagttcgcgactcctttttgctttgcatgacacgtgttggtcatcaacgaatgtaattactctatttacacagtaattacacatgtgtaatttagaacttagatatgtaattttggtacttacattgtaaatacactaaaattacatatgtaatttagtaacttacaatgtaaatacatgccgactattttttggtgaaaaatatggggccataaatatagctactcccataaattaaggggtagtagaaagtaaggagagagatatctgttgagatttgagaatgaattcagatacaagctagcatgcccgagtcgatgaatcgtcgtaccgtgcttgtgcttgcatggctggctgcaatatggagtatatccatcacctgcaccaactaatagtatcggcgtatgatggatggatcatggatctgtcttccgctgccggccggtgggcaacaagtagcatctatcgatcatatatcagcgaaggaaattaacatactaacatgcagctgctgagatatcatattgattctatgcaagctcgtcctcatcatcggatcggagtggctatcaaattaaa

SEQ ID NO: 33682 - DNA, 451 bp, Oryza sativa
tattttaaatttaattaagttttatagataaatatagtaatatttacaataccaaattagttcaattaaatctataattgaatatattttcaaaatatatttatcttgattaaaaatattattactttttttaacaaacaaagtcaaatttaaagtagtttgactttgactaaaatcaaaacaatttataacttgaaacagagagaacatattaagcagtaaaactttgaagaaaagattcatttgatttttaacaacaactcagaagcgtgctaccaaaaaacacagtacaatgaaaaaaaatgaaacttttccattggtagggcccacatccagccacggtggcaaaagcaaaaggtcaggagagagagacacacacagaggaggcatggcacattttcctctctctgttttttctcggattttccgggcacacacacggttcacgagg

SEQ ID NO: 33683 - DNA, 1378 bp, Oryza sativa
ctttcttttttcatcacaggaaaagcaaaaatgatgcaccaagtctttctttttctttctatccggttgtagctgaagttcatttctcttaatagaaacgcaaaggttagcctctctatcttaaaaaaaaatatgatctaggtgtattatacatctaaaattgcttaccgatctagtactagtactatatcttcattctgaaaaaaaaattctttccccggaaaaaaattcaaacccaaggtttgtatctggacgcacaaaccctgggtttgattttttttagacggaaggaggtatagtttatacagtactgcacatttccacgcatcaaatatgaagttaaggtttgtgcgaaagaataatcacgtaagcatggatgtccacatgattctactacctagataatgagttttcttggctaaatttgctccaagtatccactctactgttttgagccaccaaccaacacttctgtacttttcccctggagatgtcatgcattgagctccttttttttttcctttttttgtgattgtcggaactgagaatctggtccaagcatccacaactgatttaagaatttcattttcttttgtgggaaaaaggtcactactagctagtacatgccaactagttctcttttttgtttttttagaccaatgatatcctagacagcagccagttgaaaactcaacgtttgttaattagtatcacaagctataggatacgttttagatagctatcacaattcattgatatcttttttggcctcgccttgatggaaggttcgtcaatattgcaactttctgaggatgccaatatcactttcagttccaagctgatgtgtatgtcgccatgcatatgcttacctgactcttgtgagttttgaagcatatgtttacttaactgaaattgattaggtcccgtttgaattaggagtagctaatggattacaaaaactgaatttatgaaaattatttaagggcacagacgaatgaattgcatataaaaaatagaaagtattttttaaagaaaaaaatattgatgaacaaagtttttaatgaaatcagagcttgggaactgtgcccgtgatagtctcatttgccggttgcagttccgaacaggaccggatggattaaaaatttaagcttcttttaactagtcatcaggactaaaaatgaccagcttgttgctatgaagtatgaacagaacacaaccgcccgtgggtaaaaattgtttgcccatccatgggctaaaaactccatttctctctcaaaagacttttttttggaaaaaaaataaatctagaatattactattacgatgtttgctaatttcgactaactaaaaaatcatttggtctactgttgattgcaga

SEQ ID NO: 33684 - DNA, 1501 bp, Oryza sativa
cattttggtccttttaaaaaacttatttcgcaagtagatccctagaaaaacttatcccaaaaatggttctttttggggcgccagagtggctggcgccgtcgttcaacgggacggcgccagcctctttggcgccgtcccaccgccgacgtggcggggcgatgctgaggtggctagggggagtgcgccagagtggctggcgcccccccccgaaattttttatttttgttttatttgtttgatattttttgcacgcttagggacacacaagaaccaaccatagaaaaattgaactcaaatagacgtaatatgtgacatgtagaatttttcctctcctctcctctctccgaactagtgcagaggagagagatgtgcaacttttttatttttatttatttttttgatatttttttcacacttagaaactcacaggaaccaaccacgtaaaaaataaactcaaacggacgaaatatgtggcatgtggaattttccaaagctccaccgaaaaacttctctcctcgaaaacacaatcttgcaagcggaatttggaggttttaatatcgccgaacccggcaaagcgggggagaatcggatgtaactttttctgtagatgtccgtgcatatattatttgcctgattccgagtccgtatgagaaagttacgcctattttaatagatgtcatattttgtccgtttcggtagagttttggaaaattctacatgtcacatattttgtccgtttgagtttattttttatacggttggttcctatgttctcctaagtgtgaaaaaaatatcaaaaaaaaaataaaataaaaataaaaaaattgcatctatatgtactgtttaacttatatatctcatttcatgtggttatattttgaattagattaagtaatttcatatggtggtagagtgcattatgtttaacatgctgatcaaaggattttactaaaggagctatggttatggtctaattttagtgaaggtgcaaagtagactaagtggtatgctagatattttcagacttagctaagtggtagttcgagtttaattttttttttggttgtatcatgatcctgagtgtgaaaaaacatccaaaaaaataaaataaaaatgacaccgttgcaactccatacagagaaacaggaatggaggcggcggcgccagccatgctggcgccctcctccctggggcggcgccagcatggtatgctggcgccctcctcctgccacgtcggttcgcgtgcaccacggtggcaggaggacggcgccagagaggctggatgacggcgccagccactctggcgccccaaaaaggaccatttctgggataagtttttttaggggtctatttacgaaataagtttttcaaaaggatcaaaatgtaaaaaatccagcccacgttcctcccctccgtacgcaattacgttcctacacgtacgaactgcgagctctacacgacctggagttatcactgataagtgggtcgatgtgctgtatcg

SEQ ID NO: 33685 - DNA, 1501 bp, Oryza sativa
tttaaaggacataattgatcgaagattcgtcagcgagcagcctccagccacagctacaccgccacccctcgtcccctcccccattagccaccacacgcaccgtatgtgtcccctccaccctgcctgcatattaccctcctatcttctctgattttacatcgtctcgaaccttatctacgtactgtgtaattgcaatctcttcctccttacacttttaaggtgtccttgagagaggccaggcccttagccacccgtcactggctttacccttgtaagagacaatattattacataatggtggtatacatacagggaagagcttttttattgtccttgagcctgtgcagtatcgaatcctcgccgtccgtctagcccaatccaatagctgagcctctgtaccgcgtggtactgcagaatggattgatgcggtaccatgtatgggagggtatttttgtcttttcgcatactctttcttctcctctcccctagcggtcacacctgggcggcggcatcggcatcggccgctcaccactagcgtcgtcgtggcgcgtcggctagccaccagcgcgccccgtgcagctgctagcaccacgggagccaccgccacataggccccagctgctggtcgcaaagacaaccaggaactcctcgtcaggcaggcggcgtcatcttcgtcttcgttgaggccacagcaaacatcgaacaacgagcgaggtcgcgatggaaggttttttatggacagcaactggagaggacggacagcaacacacgtgcttccaaaagcaacacatgtgaacagcaaactcgatgcgacggcgggcgcggcggcggcggcctcgatgcgacggcagccacgacagccttgatgcaacgacggtaatttctttagcccgatcatacccatttctaaaccaacggttagattatattgctacctcatggtaccttttcaaagatagtaaagatgctctatagggaaaatgttttgtactgttaatggagtgtgctgtttcttgtagatgatcaaaatagttacgagaaaatctgaaaaaaaaaacatgacaagatagattatactcggtatcatatacatattatgaccagggttggaaattccggaacaaaatttctaaaatttcggtcatttcagacccctccgatacgatattatttcagcctaaatttttaaatttttttgtgaattttggtaatatccgaaatttcagaaatttcggcatttcggtgaggaccaatcaaattagctaaaccgaaaagtttaaccctaattatgacagcacaaacaccgagatcatattctatctacacatggagagaaaataagaaaagcaaaacagatagcgaaatgcgcggtcacgcgacatgtattgatttttgttatttttgtttctttgcagttacatgtaagtttgaccatgcgtaaattaagcgagaattcagagttatattaagtttgatcatgatgtttgtggaaaataggtga

SEQ ID NO: 33686 - DNA, 1501 bp, Oryza sativa
aatcttcatcttggagtaccttttccccatttcacttggatttaatacatatcatatattttcatttcgctcggacttaatctgtctgaacttcatatctaaccatctgctggttcgataaactcataaaatcaatgagctccttgtttggacataaattactcttattaaatcaccactgactatctaggagtgccagccatcacatttaaaaggaactgtcctttatttaagagctcctctgtctgtgtttatgcatctaccatgttatttttttttaaaaaaaaaactgtttgtgtattagtgtcggtgttaccgaccggttcacctattctggtatttgatgtcgcaagtaattaatcaacgaaacttattcggttgtcctcttgcaccatgcttgatacaccagcaaactccctcacatacaacacgaaacagctatcatcataacacaagtcacttttggacgccacacaatcaatcaaaaatcaaatgcgcaccgtgtgctctcatgttgaaatttcaggcatgcttgcagcgttaaactgttaatcccatctcactttttctgcaggaaactctcacacagattggacggccgcccgagctatactattaccgttttcactgccaataaccggcgacacctacaaatatttagttggttaaaaaaacactactaattgtttgggcttgacagcgtcgctggctatcactgtaggtaaataaatgtatcgctagcaagaaagtgagaacggaacaccccatgatccatgggacgacgcctttttcaaggcataaattcttcgtggccatgtgtttctccctgggccgagtggccggcgtggcatgaaccgaaagggcgaccacgaccgtgtgggcggccggggcgcgcggaatcgcggatgctggcatctttctccagaacttgcaagatacgtacgtttcgtaaaggttgccggtgacgttagaacattgctcacctcacacccccccgggttgatgtggacctgcccgtttcttagttttggtgattctttgcacgtttcccctcctaaaccttcagatttctatcagttggaaggttcaagtggggaaatggataaaagattgaaagaatagtactagttgaggagtttgctgattttctggttttgggagggggtggatggaagatgtttgtagggtgcagcttggaggataagttggttttcttctgcgttctccattgccctgttcgatcagacgatcactgaaccattccccggagaagagggagatagaagcaaataagctcttcatttccctctcaagagcagctcatcgaagctgtcagatttggccattatcggtgcaaattcagagatggttaagatcaaggaattgtatcctactagttcttgtgtccatggattttttttttcttttctttgctgtgttctttttctgtcatttttgggtgatcatgtgccatctgcttgaacttgggcatgccttgact

SEQ ID NO: 33687 - DNA, 1501 bp, Oryza sativa
atgaggtgggcgtcgtcgagcacctcgccctggaggacgaggctgtggtggtcgtcgtcgtgggtggagttcttggcgatctgctgcttgacgtagccgacggtgcggccgggctcgacgcggaacctgaacttgttgccgtggacggtctggacggtgatgaggcggaggtcggagatgcggatgacgaggtggaggacgttgccgtgggagacgccgtagtccatgatgcggctgtcgttccgggcgagctcccggccatcgaagacgagcttctgcttgcggacgacgaagcccttggaggtctggacgcggagcttgacggaggcgatggagtcggaggccatcacccgcatgggcatcatggagagccccggcgcggtgaggtagatgaggatagattccgcggcgcaatgcggcggccggatgccgttcacattcaggcgggtggccaggagctcctgctcctccctcgccgcgcacagggtggctccgccggcggccgtcgtcgtcatggccggccaatcaacctccgatcgatcgatgtgtgttggatggcgcgtccgtctggatgagaaacagctaatggctaatgggatgaagtgatcagtgacagactaattaacatgcatgcatggggcctggcctccgatcctgttcttggctcaggcaaccgcgcgagggggagacggcggcgccggagcgcaagaaggatcgctttgtttcctttcgtttcgtttcgttttgggaattgcgaggcacctctcttgttcatctgctctgctggggacgaccagtgccaaaattaggtgcctctggcggtttgtcgcgctcgccatggctgccatttggtaccaatttgagatgctttcgccggaattgccggggaagatggagtcctcgccgatccacccgcgccgcggaacatggactgctgcgattggttgccgtcccccagttttgcgctgcgctggacggacgacattgtgggccttctgtcgtcgggaccacatgcatttgggcccaaaatgatgccatgggccaattagctaacttttcggctggtaggcccaacgggagattgccatcatggtgtgtgtcctgaaacaacggacacgcacgcacacggcacatctcgctctcccgattcccgaatgcccagattccttgtagactgtaaactgctgctggtaattaaccgagtgtgtgtacttgtgcaagatccaggcagcaagtgatgattttcccagtgcatccttggtcgaattgaagtcgctgcagtgaagtgcggatcgatctatcgatccagtagaggacgtggcagccgccgctgttggctttcacttcaattcaattcactttgatcgatcagccaccgcgaagaagaagaagaagaagaagaagaaacaacatttaattccccagctagcaaccgccggccacctctctctcccaattatcctctcctcctctgcttcatctccaccacctccgatcgaga

SEQ ID NO: 33688 - DNA, 1501 bp, Oryza sativa
taatgtgtcacatttaattatatgtctttctctggtcatataatcatcctccccagactttaattttcactataagagctagttgatgtcgttcctggtatctaaaggggataaggcggcaccatcagctgcttaactttgacttccagtctcccaccacttcagcttgaagaagtaaacatgactgataatctggcatgtgcataagcgagtctgtatagattaatgatagataccctaacggcaactgtatggttgaaaaagacataaatattagagaattatctaatatcaaataattagaaggagcgaggttttgaatttagattgtttagcccaccatctagccggcgagcatttctccgttatggttgaaaaagaaacagaagagggaaactacgattcgatatgatgagacgcagacactaatcaaaccagactacaagataaaagtacggaatactatactggtacagcactagtgtagtaacaacgacacaaatgacacgattcgttgtacatgtactaatcgtactgagctctgcaaaagcgtgagaggctcagagccacggcgcgaacagagtgatgcacccaacgagccaaatcagcagctcggcgagcagccgaggccatggcacccggtcccccgcgcccgcggacgcgccgacggcggcgatgatcatcgtggcgccggacaccatcagcaggaacgcggcgcgagtggtggctgcgcctccgccgcggccgtcggcgtgcggtggctctggctcttcgccgaaggcgatctcctcgggatccatttgccttggctcgagatcggccgtcgatgatatgttttctactgtatttgcctttgtgccagagcgtgtgcaatatatgttccagatcgagctccgttggcagtggcaacgaccatttttatatacgcatcgagggcaatataggtgggaacacagaatgggcccccggttgaaacgataagtcaatttgtagtataaagtccatgcgagctgtgtgcatttggccgcttcttgtgttgcgttaaccttttctagtcaatttcttcactgtttctagcttactggctggtttgacgctggtacgttactttgaaataagtattctgttatacctgcaccaatgcgcggtgaaatcactgacaggtcggtccgatacagcacatcgacccacttatcagtgataactccaggtcgtgtagagctcgcagttcgtacgtgtaggaacgtaattgcgtacggaggggaggaacgtgggctggattttttacattttgatccttttgaaaaacttatttcgtaaatagacccctaaaaaaacttatcccagaaatggtcctttttggggcgccagagtggctggcgccgtcatccagcctctctggcgccgtcctcctgccaccgtggtgcacgcgaaccgacgtggcaggaggagggcgccagcataccatgctggcgccgccccagggaggagggcgccagca

SEQ ID NO: 33689 - DNA, 1501 bp, Oryza sativa
ggaaaatgactgaagtttggatccaaattttagatctaaacataacctagaatacgcccactttatcaaatcccaattcaatcattcctctctttatctattcccaattaatacacttatctcattatttcacaaactccagtgatctcattttatgacgaagagagtatgagatcatatatcgatcagtccataaacatgaaatgttgaatttgatttctacaagttataaaaaagaaacaaattaaacagaaactaattaacatgcattcacaattatataaatttcttgattatttatatgcagcctataaaaattaaatttgaccttacatcattaactctttagaaattagtttttattgggacggagatatcggtgggtgtctcttgttcctgatggactttctaattaagtcgtactcctaccattgtcttgttcccgtgacgacccaacaacacccatcgcttactctacagatcaatgtgaagatgtgttggaattaatagatgggctaaggcccattcaaaaattaattctttagaaaatcacaaaagcccatctcatggggtggcatgcatgtggagtttagtatcaccttgcttattctaggagagggggacttccttaaaagggatgatgccctcttagccacttgaagcatgtatggtggagagaagaggggaaacacgcgcgcgctcgctcgcctcgcctggtagggcaagcgttgcggcgcgcgtgcacgacgtacgcgtcaaatggtccataaaattggctcctcacccttgcgcagatgcagcctccttttgcagttttgttttgctacaggaaaattcggatttgttttgttttggaaacattccgaaaaatccggtgcgtgaaaacggcatggagtccggataagttacgcgcgacttatccggttcggttacgcggactggagatcgtgcgggcgccctgatcaagtgacctatcctatataaactgagccgccgccttcacgcaaaacacacgaaatcaatctagggtttgcctcctcctctgtgctgcgccgtcgctcgtgggctactccatcccgctcgccagcgtgcaccggcgatcgggagggcaggtctccggaacctctgccttcgacgtcctgcaccgggagaaggtagcaataaggtttttgggaagcgcttcgcgcaactgctccctgttcgtccgcgacagctcgccttcctctccgctcgcgtgctgcgcgccttcgtcgacgctcgcaaccgcgagtagttcctgccgagcaaccggtctttccgccacctcggtacgtgttcgacatgttacgcatatttgatctgtccatgttttactgcttagtttacatatgtagatctaatgatgcgttaatgctagtatacatctgtaatgtcatgatttatttatggaatatattaaatcattatatgcctatattatcaacaattcaaaaaccttactataggcgctgtgattttacta

SEQ ID NO: 33690 - DNA, 1501 bp, Oryza sativa
aagcttagaaggtagagagacctgcttccgctggctttgctgtgatccgccgattccagtgctcgtgatgtctgaagggccatctcagaatggagccgcaggcagcacatacccatctacaagacaaacatgccaatggaagagtcagatgacactgtaaaatgttattgagtttccagcttgattggtttctctttatacgataaaaagaagtcctgtttttctttacaaattgctgaaaagatctggatcactgaatgagtataatattagactaaaggaatgagaggaaggagtaggttactgaaaactaaagcatatgatgagtgacattagctctttatttttcagattgtgaatcatatcacagtgaaattatccattctttcaaactaaaatcaaaggcaatgcagacggaattcgatataacatttgtccttcatctttcgccgctactgctcttgagatgagaatgtgtgagagagggagaagcagaaaagtggttgtgcagccagccaagcgcaaggaaaagcagcattgcgcttaaatacctgcaccagacgcatctcggccgttggatcgtccctcgcggctaatccaacgctccgggagtgccctgtcctgtggctggtggtcaccatggagcatgcaccttcctcctcctcctctcgccctgcaagacccgttcacatgtagtaattttcttttgctcaactaatcagttcaaagttttcaaacatagtagtaatctggaacagacgtttcacataaatcaattcatgttgggaattcatgttctatgtataaatgacgaaaaatgtagcactctgaatcccaaatacattgatcgatttatatttctaatccagtacattgatggtatcaagcttaaaaggcagagacctgcagctgctggccatgctgtgatccaccgattcagtgcttgtgatgtctgaagatctcagaacgaagttgcaaacaggtcataatggcctgcaaggagacagacatgccaatggaggagttagatgacattgtgagaagttactgagttccagcgtactgaaatggtttctcattatacgtttttttttttgaaaaaaaagagtccgaattttctctacacattactgaaaagagctggatcactggttgaagtagaagacttaaaggaatgatagaaagaagtatgtcacaggaaactaaagcataaggtgggagttattagctttttatttttcagatggtgaatcatctcagggtgaaagcactcttccttcaggataaaattaaaggcgacgcaaatgaatttgatataaagtttaccctgaaaacctgtactttgttggttgaaaaataaccctgttagtattatgtgctgagcctattgtactataattccccccccccccccccaatagtgaccaaaatacatactgatatgtgcattctgtatcaggatcagcttctgcaacatgaagaacccatatgtgtatgtaga

SEQ ID NO: 33691 - DNA, 261 bp, Oryza sativa
ttaaagaagacacatagatatacatctcacatatttaagatatataataaaaagtttgagaaacatatgcctgcttatgtggacgggcttttcttctcttcctagtttatcaaactagggcgatgtcaaatattattcagatgcctggcttctttacacagctgttggatatagatatatagataagtaattttacagtctttataaaaatatcacgaggtatcattttttctattataattttgttataattttggtaga

SEQ ID NO: 33692 - DNA, 1501 bp, Oryza sativa
tgtcagtggaagtgatcttaagagctacagtaatttatgagttctactcttctactagtcatagaggaaaaaaattatattaccaataattgatgtacgtattggattgaaaaagataaacaatatatatttggtcctacagagcatgatactatgcgcaatggtgctacacttttgaaatcggtagccaagggtctcttattccactatgggtggcgtagttacataagaattgttagctaaaaaattttatgtggtttaacgctagtcaataataaaggggagttggggatttgtcccatcaccttatttctcattttgatttacttttatcttgcatttttattactattaaacttatggctgtgtgtcttttgacagaagtcggagatgtaatccatttccattatctaaaaatttggtcctacaattagcaaagagcattgtaaaacatatcttatcttagttacagatttacgatctctacagtgtaaaaatgcatttgctagttggtaactcagtactgtaagggcctgttcactttgatgtcattttcaaccataccatcttttagcaaagttgctaaaaaatatcacgtttagtttgttaccaaatttggtaaatacataagaaatcctatcaaaattttgtcaatattgctatcttgccaaaattttaggtttattttggctacaatctgaacaggcccttaagtgtgctgaaacaaacctgccgatttgttaatttgtctgccactatgaaaaagagcatagaggcaaggaaacatacaattcgcgcaatatgttcctgggcttccagatttgtccggaatgatgggccaagaccaaaacttccatacatatttgggctggaatagtgcgaagcgaaagcccaaaggattcagcaggaacaatttctaccaacccagcccaagagcaaaccttacacacccgttggtttgttgcttagcgcgtgtccgcagaatagcacctaaagccataaaccacttgcattattctcaactactagaagatcagccagaagtagcaatcgaacagtccgaaattacaccaagccatgtagccatagcatgcaagtagcgcataatgcatccgtttgttagagcggacagggacatgtcctagttggatcttggcgggtgaaccctgaattattggcggagatggaaacaagagtagagtagcaaagaagaaaatcccaaaatggaccgagtatttgctcttcgtaggtagagctgaactgagatagtcgtattggagtagtattagtacccgggatttgtgggtatagagagactagagaggcaggcataaattagtagtagtagaggtcaagagaggtaatggtggtggtagtagtagcaggggtcccgcgggcactatgatttcacatgcttagctgacatctgtggagcaaccaccacgttcgtgttaacgtcgccgcgagaaccaccaccccctcaaacacacgcgcgcccaca

SEQ ID NO: 33693 - DNA, 620 bp, Oryza sativa
ctaggccgaagccgttttgtcaatcgatcgatcaaccgtttttttctacgtataaacagtgaggacgatcgagcagctctgaaccatacatgtccctttcagtaaagcagcaattagccagctgcagggagatgtgcagtgagcaactggacatacacacgcagacacacacaacacaagttgtgtccactttaaacctgcacctgcggctacgcactgactgcaccgggatgctctgtacagagcccaagctttgctagtaaatataggcttgtgtttagatccaaaactctgcgctgaactaaacacaacttttcagtcacatcattttcaatttcaaccaaaatccaaactctgcgctgaactaaacacaaccatagattgctcgtgttcgtgctcctttccggttaacctgctcgtaatctttttaatcagtttagcacgcgagctagatagcgtagagaccaccggctttcgaggaggggaggtggtggttgccgctgcaagccacattgattgaacggacgcacgctggctgtatgtaaccgaacatcttaatgccgcgatacgctacaaaagttggcgtagcacgagccattttttcctttgtttcttgcagt

SEQ ID NO: 33694 - DNA, 446 bp, Oryza sativa
tctattaaaatttgaaataaaaattttaatttattacatttattttattttcaaaatttatgtcaaaattttctgcactaattatttagtttcattagtcttataaaatgcacatactgtgcacccaaacaaaattttttaattattttttaagcttatatttaaacctaaagcatctagggcaaaaaggatatttgcaaccaaacgtaacagtgaaatgatggaaaatgtaacggtaggggcatggaagggatcaaattgaattttcaggggtatagaagggattgggtaaatttcaggggtatgaaaggaattgagtgagttttcaggggtacacaggaaatttactcccagtacaaagtgcagtggactggagacgagtaaggccatgagattgcaaatggacggccacgatccgacgacttctaagccatgcgtttacaagg

SEQ ID NO: 33695 - DNA, 1501 bp, Oryza sativa
acatcaacccgggggggtgtgaggtgagcaatgttctaacgtcaccggcaacctttacgaaacgtacgtatcttgcaagttctggagaaagatgccagcatccgcgattccgcgcgccccggccgcccacacggtcgtggtcgccctttcggttcatgccacgccggccactcggcccagggagaaacacatggccacgaagaatttatgccttgaaaaaggcgtcgtcccatggatcatggggtgttccgttctcactttcttgctagcgatacatttatttacctacagtgatagccagcgacgctgtcaagcccaaacaattagtagtgtttttttaaccaactaaatatttgtaggtgtcgccggttattggcagtgaaaacggtaatagtatagctcgggcggccgtccaatctgtgtgagagtttcctgcagaaaaagtgagatgggattaacagtttaacgctgcaagcatgcctgaaatttcaacatgagagcacacggtgcgcatttgatttttgattgattgtgtggcgtccaaaagtgacttgtgttatgatgatagctgtttcgtgttgtatgtgagggagtttgctggtgtatcaagcatggtgcaagaggacaaccgaataagtttcgttgattaattacttgcgacatcaaataccagaataggtgaaccggtcggtaacaccgacactaatacacaaacagttttttttttaaaaaaaaataacatggtagatgcataaacacagacagaggagctcttaaataaaggacagttccttttaaatgtgatggctggcactcctagatagtcagtggtgatttaataagagtaatttatgtccaaacaaggagctcattgattttatgagtttatcgaaccagcagatggttagatatgaagttcagacagattaagtccgagcgaaatgaaaatatatgatatgtattaaatccaagtgaaatggggaaaaggtactccaagatgaagattggcacaaaggattggtagcatctgctgtctgtgaagatgctgcctgagacaatttgtggatagaagattcgagtggatataccatataccagtaggtaggatacatgtgggtgaccttgtactatttgacctccttatattgttctgtcacgcaaccatttcttgggtttactttgggagtatatattgcaggcattcatttgtttaaagaaaaattcacaagacctttcacgtaaatttataatttgtacttttattttgatctgaacttgtttcttgtccctaaagagaaaatgaataagttcatctaacgtcccttaattttacaccgaatccgattttcattcttaaaccccaaaactagatacaaccagtccccaagctgtcaagactggtgtaaaaaaggtccctcggcggttttgaaggcggttttagctgatgtggcgcctacatggctggtttgactaggtctacgtcccacgtggcaccgatgta

SEQ ID NO: 33696 - DNA, 1501 bp, Oryza sativa
agggggagatggaacggtgctgccgatgggggaggggaaggggagcggcgttgctgatggagggagggggaaggggagcggcgccgccggtggggagggagaggggaagcggcggaaggggagaggcgccgctgacgccgtaggtttgagagagagagaagggaggggaagtgattttagggttagggtttgggctgccgactttttatatatgttcggatcaatcgggaccgttgatcagatcagacgagtgtggcttctcccgcgtcgggttgccgttcccaggccgccacacaattgggccacgtgtatgcttcgcacggataagttcagatttggtccctcaagttgtccccaaatcttcatccctaaaccacaatgctaggccaaaatcagtttatttttctaagcaactgatttaattatttttatatttacagaaatttgtttggtactattttaagccatttaaaattgttgggaaattacgattaattatttaatcactcatagattatttttagataaatgaaaccaacaaaaaatttatctagaaagtattaatcatatgatattgtatttgaccaagttaatatggtttcatgtcaaaataattattgggcttgtttggtttattatcctatgttggtagtgccaaactctaggcaagttttgacactaccaatattttggtagggtagaattataaatgagtgtctttggatttatgccaattgagagccaaattttaaattgtgatgaagaatattctagaattgtgccaaattgagtataggcattaccaaacatttggcttcaaaccaaatcatcatatttactatttaaactaccaaaaaattgatatggcaatattttggtatcaaaccaaaacgccccattatttccttaaatattaaattatttctagaattcaaacatattccactaaagatttttgagtgaattttatttcgatactacaaagtgtgtgtttctttcccattgcagatgcctttaccatttttcttttgtagagcatggtgaattcagagctgtaactgcccccgtttatgaaaatttgtgaaagttggaatattgtctgaatgtgtagaaaatttggaatatagtttgagatacgacctgaatctgaatatgtatacagtatgagatatgttttgatattttcctgtataaaacttggagatatttgcaaggtatgtacaaattcaatatttttgtgcacatgtattataagtacacaagcaatcttaaccatccatatttgtttgatattcacccggtgcaacgaacgggtatatttgctagtccttataaataactattggcataggaaagaggtatgcacgtccactacctacaattagtactcctaccaattatcatctgcaccgcccgtagatcaggaaaaggaaacatgagttcctacacgatatcaaaattcaaactatcaacccaattcaaaagcaaaatctaaatactt

SEQ ID NO: 33697 - DNA, 1501 bp, Oryza sativa
accgcattgcatttttccgttgtacctgtgctgctcctggcctccacgcgctgggcgtttctggcggcggcgacggtttggttttctgggtggttttccttttcagctgcgagcgaatccctgatgctgcagctctcgctctccctctctccctgctgttggttcaaaggagtttcagagttcagatcaggagttcaggacggtgaaggtgacaggaggttagttggtttgttcgtgtgtataggtttgcgtagtttattcttgttctacatggtgattttatttgtttagaactagattagctaaaggtacatgcgtataaaagaaaaagaaaatctcccgtcccgttcccgtcgtcgtgtccgctccttgcgccaagacgagaggcgccgatctccatccggggaggagagctggggaggggaggggatcttggtgagcattcacattctctttctgattcatctctctcccaccgggagtagttttgtctgggaatttgcttgcgttaaccctagcttctcttctagatctggaagaagctcttaacccttaatacagattgtaacagttttgtttgttcccccaaaagtttgggggttcaactgaaccccccatgtcccaagttggatccgcccctggcttactctgcgagtcacccctttcattttcttctgcaccaaccaggcttgcgcacttgcacacaactgtatttgtggacaccaagatcaaaccttggggtggagacatcctttcatttagcatactggagtacttgttaagggagaaaaatgataggtttgtaaacaagtataaatttgaggaaatgccacaggaaggatcatttttttttgttaaatttattgggcttttcttgatgcgcctccacttactattgagattctacaggacagactgctcggctccttgagtctattagtagcgggaatcgcaagctgtccttgtttgagccatcacatatagttcataatggaaaatacaccatatgcaggcttgctgcatttttagtgttgtgttaatcagcctgctctcatgttcatcacttcatcctgaccagcagctgttgggtcttttttttttctctcaacttgttccacatagttgataggccgagcaccacccctacaataccagtgcagcctaagtcaactaatatattggagaactgagtgacattgtactaaaccatctactttgagtggcgttgtgctgattttctatctgctctacatagaactaacataactttacaaatgttctgtggatatatgtaggcataaagcacttcacctgagatgatgtagcaacctctcatctcaactgattctctatacagtaatcttcaagatggaacagatttcagtgagttaattccttctgttcattgtattgttcttcaaatcagttaccttatgaccaaaagtcaaaagttaagattgagaaatatgcttccttttttgttttggacaacttctatagc

SEQ ID NO: 33698 - DNA, 1501 bp, Oryza sativa
gcctctctctgttctcttgtgctcttctgttgtgatggggaaattatctagtacatttaagttcatacagattcctcatgaaactattaaaaacttttgtgagctgtaaatgtattctgggcacacaagtttttcgtgcactcagctcttggggttatggccataagcagctcttgattcgttgatactccaagagggcctattgccaaggcatcgattggatcgtccagcaacgtgcacgttgcacatcacaaacaaattgattgctttcagatcgttgcgctaactgtattttactgatcatcatgcggcgcgcttgaatacaagggtcgacactgtgctgccatgatcaaaacactgtgttgtgttgttttcgggggcacaacgtgtgactgaacctgctaaagcaatcgtggtcgccacgtttaatttgcttttgcaggagagatcgaaacgtgaatgggactgcgtgttgcaatttaaagcagccataaaggaaaactcaattaattatctaaagtgtcaagacaaaataaacaacattttcccttttccctttgggtggtagcggcgccatcgacagaaagagcagaatctagcatgcacgttttttttattttccttttatttttttcctaaaaaacattttttgagcatgtgtggctggcacgttggtttctgatttcttcatcatcaagactgagtcactgacacgtgtgcacctatgcggtccacgtgtggtaatcgcttggatgatccggtacttgtttcaatcgcgtaaaatgaccattcctatttctccctaacaaattgcagtgccatatttaaggatgaaaatattttatgattaaccttacttgcagagtgcatctttggcttgacgcagtgtgattatctaaaagagatttcgcgagggaaaatgacaaaaaaaaagatgtttcgactttgtgaatcttaagatatgttaatacggtcttccaaagacacaggagtagagcgtgagtatgtgttcataaaagtaaatgtgcgtgcgtgattgtattgtattctattttttttaaaaaaaataaaatgatgtcagcaatggcgaagaaaacaagtagaccattttccaaaactgtaaaaaaaagagaaaaggaaaacaagtaggcttgcagatcctgcggtccagcccaagagaacgttagtgtgcgcggcctacctgcgcgtgtcggcctacttcggtctggctgagaaatagtaactgggccaacatgcgtgttgactagctcggcctggttggcgaagacgacggcccaaacgcggagagagatatcgaatattccgtggcccaccaaagccgacaacgaccgcagctcgcttgtcagacatcggggaaagcaatcaagcaagcagcggccgcatcgatcggagcggagaaattccccaactctgctcaccctcaccgttgccgacgacttcgtgcggcggcgaagaggagaggcgatgggagggggagacg

SEQ ID NO: 33699 - DNA, 1001 bp, Oryza sativa
cgcccacgcaccgccccacgcccgtgttgacagaaaagacgaggcctgggagatctgcttaactccagtgcaggtccaaagctcgccttcgaatgtatgagcgtgccagatgatttgatcctgtaatcaacaagaaatagagacaaagaattcgtggttaaatctataaatgatagccgatcggctaggtgccgatgacatatcatttatctttgagccgatgtcatatatgaatcgatcggcggttataaatagatagtaaggaactaaatctattcgatcggctgtagatattaacgatatatagttcttatattaatatatacttaaatcaagtgattaggatagatcggtcaccaagccgagacagtataaatcacttagatcgaaatatatattaataacaggattatatatgtttatagcatagccgatcagatagatctagcatgtatcggctaatactccgatactactttatataaagatatcaaaacaaatataatataccaaacaaaagcttaatatacttaaatgcaataagatcctgacataaagggcggatttaacatgtcattgaagcatatagatcgaatatggttaaatcagataagatcggttgaaactccaatactaccctaattggcaaccagaggacaggctagagattgatattctaagcacgacttaatagatcaaactcaactgatgcagcattaagtataaaaaaagaacaatatctagacaatcaagccgctgagtgtttcataaaatggtagatatcttatataatcgagaacaacgtcgctatttaacctaatcggctgccttctattaacagatgttagtcaattgtaggttagatgacgatattgccaaagattatgtaagatatatgataacttgacgaattatatagacaagattagagtgtcataaagatggaagcactaatctcgagaacacaagtcgtcataacaagttttacctcttgttgaaga

SEQ ID NO: 33700 - DNA, 1501 bp, Oryza sativa
ccgcctacgttaatccgcaatataaaataatgattaaacatgttttaggctcatttggaagaaaagaactgtttagtttttcctgaagcatttgaatcctggaaataaaattcatatgaagttatctggaataaagagcatgtccttaaaagttttctatgaacatcctaaggaataaagcattccattacaattttagactaaaacaaacatgagaaagtccaactcatggttttctcttcctgtacatgtctacaatttctttttttttttgcgtgtgtaatccaaacgactgttttgaaatactcttgtgcagttgtgcttctaatttatgtaggaatttataaggcatgtgacccgtgttctttatatttttgtgctttcaaattcgtgtgtttcaaaggactcttagtctcttgggtgcgtttgagacgaggggaaatgaattgtttacagcaacttttttagagattatttttaccaaaagcgtacttcctccgggttgataatacttgtcgtttcgataagggcacggtttccaaaaaaaactactttaaccattattttttattataatatgtacaaaagtgttaataaatatatgattttattaaagtaccttttaagactaatctatacatatagtaaccatattgaaagacaaatattttaaaaataatttataatcaaatattctaaagtttgacttcactcttatctaaaacgataagtattatcagcccagagggaatatcatttaacagcttgaaacgaacatagccacgtcgacgtgtttcaaattcctatgcttgaaagcactttcctgtaaaaccttttttttaataaaaaatacgttgtttagaaatttgaaaagcgtacgcgcgaaaaataagaggtacaagttataaaaagggataaaagaacacacatttaggctctgttcgtaattcccaactccttccgcctcgtttttcatgcgcacgcttcccaaactgctgaacagtgtgttttcttaaaaacaattatatatggaagttgcttaaaaaatcatattgatctatttttaaaaaaaaatagctaatacctaattagttatgtgctaatggaccactccatttttcgtatgcaggagatttaagttttaattagtgttcccaacccattccagctaacacagcctaatgtctctaagagtccatgtcgacattctaaatgttgaataggccgaaagaaaggggtcgagggaggaaacaattaagaacagaagaattataataatttttaggacatgatatgatggagcttgtagttaaatttaactcatttctagaacagctctcctttctgttaagacaactaatgttatcttgaccaaaactatcctggatgccacaatgtctgaacttttgcagaaaaaaaatgataggtaatcacacggaatcagccattggaacgttcttgccacgcgtttttttattttttttaaattttttttgccaac

SEQ ID NO: 33701 - DNA, 229 bp, Oryza sativa
agttcggccgacaccggtaaagtaacatcttatcgtgtaatgttactatctcctcttcaaaatataagttacctggctcatcatgaagtgtactatctttgtctcaagatagtacgatagaatacggaatttgaacagtgtctaaatccatgccgatgaagtagctgtaaagctcatccatgatctatgcgatcgatcgattaatgggtgagttttgtttttttccagg

SEQ ID NO: 33702 - DNA, 1501 bp, Oryza sativa
cttcgctattttacagcggccaaagaaagaaaaagagatcgataaaaatcctaacgtgtgtagtccgtagcccaggtcgttccaaaatcgaaaggaataagactctaatccacctaaataaaatctgaagcatgatccataggagaaccccaatccagctgtgtttctaaattccaaatttctaactagaacacgaaattaaggttcgagtgaggcgcctggaggggataaggttcgagtggtgggaggagatagcgcctgggaaggggagcgagaaaacggttcccattttctttatttattttctttcctttttaaacgctacggtcctccggttagacatgaaagtctattgaaaatatctcatttgctaaaatttataaagacaactttaagtaaataagaaaaatacaaaatcaattattctacgtgaaagtaaaaaagactttcactttactttcacgtcaatatagcgttgagaacaggttgtattttttttcgaaacacagtatagatacatgcattcatataaacacgtgcacattgatccatatgaaagcacacacgcacaacatatctctatgagaatctccaagactaagttggtatattttttagattagagatatcatcacatgcgtctatcgaatcttgtttaatctttctattatctctatctctactacttaaaaaaatacttaaaaaattgaaggtgttttcgtcatcgtgataaaaaaaaaggcgaacaaatatataatgataaaccctgagctccactcaagatgctcaaagctgttgtttggaccgatctttcggtgagttgagataactacgatttggaagaaacgttgatgatccgactacaaccgtacaaggcattgcgttgcgcccttagcgatcgatacacctctccgattcataagaagcttgcaccttatgttcgattaggtaaaacatcattatggtttatccatggtgatgatgccctcatcatataaaaagaaaaaaaaaagaaaagtccgattcatcaatgacacggagaaaagaagacccaccgtccgtgataaaaaaggtagaattttttttgttcttattaatcactctatataccaatcatgtacgatggataaagcacaaaatcaaatcaaagatctacacggactgagagaacctgaaaaaagtcatcctatcaaacagaactacacggagaatctaaaagaatcatccaatcggatagttacacagattgagaaccctagaaaaaaggaaaaaaagagaggaaaaaaatcacacaaatgagcgagtttgccatcggatccggttgttctgagctcgtcactgtcacgcctagaaattcccgaatagaattccaagcagaatgtgcattaaaatccccgtccaggaccggccggggtacacaaacgacaaagttgacatacagatccacgtcttacaaatattataaaagtcttacataaatgcagcggaaaacttaaaagat

SEQ ID NO: 33703 - DNA, 1501 bp, Oryza sativa
ggatatcgatattgccaaggattatgtaggatatatgataactcaacaaattacatcaacaagattagagtgtcataaagatggaagcactaatcccgagaacgcaagccgccataacaagttttacctcttgttgaagatcgaaactgattcagctcaacccgaaagcaagaactcgtcgaaataaaactaaagcaaaaaagggtggcgatgcgccgagattgtattgaacatgtgtgtttaaaagttacatagggctcgggcctatttatacccgaaaattacaagatatgtccataacggacacgactactatctctaacaaactctaagataccataagtctttgcggcagacttttgcccaagcatatctctaaggaaattatctaaaacatcctaattaatagatacaattgccttctcaggactctatccatgtgcggcaatcaccttgaaacacctcaactcaacccgacgtcatacaccaagttgcattgtcggaatcggctgcatcggcttacctagcccgactcagacccagccgatcctaatcgtagccgatctggactccagccgattcctgccctgtttccgaactcgatctccgcctccgactttgcttcgatctaatcttctttcccgatgccgatattaccaaatttggttgttaacaatcgctacggtcgtcgctgtgggtgtcgtcatcatcgtccctcgtgcggcagtggggagaagcgaacgagaggaagttgacgatagacacggagttcatgcggcacgatgctgtgtggaaaggtgcatgatggcgatggagcgggcggtgcaacgactggcaaggatgcgggtgacggccgaacacgggtaagacatgaagaagatatttttcagcggttagggagatttttcttcacagacattctctcgagcaggtgatgtgtgtggagaaaagtgagggagggagagagaatatgttgggaggaagaagagttggcagctggcatgtagggtccacatgggtcccactcgccacgtcaaccaaaaccggccactatactgccaaatgaccaaaattaatacggtactgtaagttaggggatgtattatattcggtacttcctccgtttcatattataagactttctagcattgcccacattgatatatatgttaataaatttagatatatatgtgtgtttagattcattaatatatatatatatatatatatatatatatatatatatatatatatatatatatatatatatgtgtgtgtgtgtgtgtgtgtgtgtgtgtgtgagaataatgctagaaagtcttgtaacctaaaacggagggagtattgtggtttggggacaaatttcagactaagcgacaaattaagggacctaaattgaacttattccaaagaaaaaccgtagtaatacccaagcagtcccagcatactgtcattgcttttcacgagtccccaagcacgaacctagtctcctgcgtctacg

SEQ ID NO: 33704 - DNA, 1501 bp, Oryza sativa; identical to SEQ ID NO: 25382

SEQ ID NO: 33705 - DNA, 1501 bp, Oryza sativa
atatacttaaatgcagcaagatcttaacgtaaagggcagatttaacatgtcaatcaagcatataggataaaaagtagttaaatcaggtaagatcggctgaaactccgatactaccctaatcagcaaccaagaagcgggctagagattgagattctaatcacgactcataagatcaaacttaactgatgcagctataagtatgaaaagaaggacaatatctagacaatcaagccgttggatgtgtcatagagtggtagatatcctatataatctaagtcaacatcggtatttaacctaatcggctgccttctattgacggatgttacccgattgtaggctggatatcgatattgccaaggattatgtaggatatatgataactcaacaaattacatcaacaagattagagtgtcataaagatggaagcactaatcccgagaacgcaagccgccataacaagttttacctcttgttgaagatcgaaactgattcagctcaacccgaaagcaagaactcgtcgaaataaaactaaagcaaaaaagggtggcgatgcgccgagattgtattgaacatgtgtgtttaaaagttacatagggctcgggcctatttatacccgaaaattacaagatatgtccataacggacacgactactatctctaacaaactctaagataccataagtctttgcggcagacttttgcccaagcatatctctaaggaaattatctaaaacatcctaattaatagatacaattgccttctcaggactctatccatgtgcggcaatcaccttgaaacacctcaactcaacccgacgtcatacaccaagttgcattgtcggaatcggctgcatcggcttacctagcccgactcagacccagccgatcctaatcgtagccgatctggactccagccgattcctgccctgtttccgaactcgatctccgcctccgactttgcttcgatctaatcttctttcccgatgccgatattaccaaatttggttgttaacaatcgctacggtcgtcgctgtgggtgtcgtcatcatcgtccctcgtgcggcagtggggagaagcgaacgagaggaagttgacgatagacacggagttcatgcggcacgatgctgtgtggaaaggtgcatgatggcgatggagcgggcggtgcaacgactggcaaggatgcgggtgacggccgaacacgggtaagacatgaagaagatatttttcagcggttagggagatttttcttcacagacattctctcgagcaggtgatgtgtgtggagaaaagtgagggagggagagagaatatgttgggaggaagaagagttggcagctggcatgtagggtccacatgggtcccactcgccacgtcaaccaaaaccggccactatactgccaaatgaccaaaattaatacggtactgtaagttaggggatgtattatattcggtacttcctccgtttcatattataagactttctagcattgcccacattgat

SEQ ID NO: 33706 - DNA, 367 bp, Oryza sativa
ttcctgcagccctcatgtaaaaccatgcactgtttttgttctacccgtgtacgtacgacctgtgaattggcattgcgcggcatatacgtgtgcatgtattatttgttattggatatttttgttaataaaaaaataattaatctagataaaataaattgataccatcatcgagggttgtaagaatgtgttagtctagctaggaagagtcaaaatgtttaaggactttcacgcacagctattattatagtacaacttacaatttgatcggtaattgatcacttataatcgaagtacatattatacccctattttgaatgatgatcaaaattgatcagaaactgtgacgcatgtcatcgtctctcgcagg

SEQ ID NO: 33707 - DNA, 464 bp, Oryza sativa
tctataatatattatatgtaaattacttttaggctttactgaatttactttggtatgtctaagaagtaacttagtggaatctaaaagtaatttagacatattataagagtaatttgtaatttttcatcaaaatataatcatgtgagatcttgttgtaaagatttaattgttacgaacacaacggtgtaatcggattatagatcggataagtaatttaagagaaaatttcgtaagaaaaaaaaatacacaacctaatagaaaaactacttgtatgcatgtctgtaacgctactagtacttctcacgtaattgtccgcgtcgctagttaagtctaaatcgagatgcctctcgaaatagattttgcgtagctaaatgtatagttagctagacataatagaagaaggaaacctcagtcccaacaggctgcgaagaaacaacgatgggagaagccacctgcgggttgga

SEQ ID NO: 33708 - DNA, 205 bp, Oryza sativa
agatgagatatcaaatctttgacgggttgcaaatttaacacccctcacaggtgaggtcaaactagtaatgggctggagagcaaccccgtcactacctcacctgcgacggcttaaaattctggcccatcacatgtaaggtgatacatgtgacgggccacggccggatgcctcaccgatgacggcaaacctaacgacccgtcaaaga

SEQ ID NO: 33709 - DNA, 211 bp, Oryza sativa
ctagttcgttagttagcttgactattaatgctgaaacgggatggatacttattatggatgatgactgaacttatctagctaaggagacagtaaagtatagcaagggctgtggtacgagacaattttgattcctagaaatgggattttgttggataaaacaagtgaagcaagaagctaggtatggagtactacatgagtatatgatttttgt

SEQ ID NO: 33710 - DNA, 1501 bp, Oryza sativa
tttgcttggagtgtttggtgtcgcggtttctctcgttcttgtcttcgctgaatcgagcagcaccctgcgtcttggttggttcctgtttaccgcggtctggtcctcttttttcgtgttcttcgcttcccgtacccgtgatgttgttgcttgatgcatttgaggcgtggttttctcggagttggatgaggaggtcgacgagcaccgaagcttcatggttggtctccgttcgcctctctcccatcggagcacgttgatcttgacggttcctggcgcgaccaatgcgtgcgcgagaagttagacgccatgaattcgtttctcttctctgctttgttttttttttggctcctgttttgcagttggtgtgttgcggaggtgtcagtttctgaatttgtataaaccaaatgccctcttcttattctttttgctgttcctgatgcaatctgcccgtcttccttacgtcttgatcaagtagaacggcgcctctttctcttctcgaattttaaggcgtttcggaatccgaaatttgctaagattttacctggccgtgatcatttttttcctcctgttcttggcttcccttacccgtgttgttgttgcttgatgcttttgaagttgggtgtgtgagtttcttggaggaggttgaagagcacggaagcttcatggtgatctcgttcgcctctcctcggaacatgttagtcttgatcttgccttccgtttctctatttggtcttgatcttgccttccgtttctctatttctaccagtgcaagctcgagaaattaaaccacatcaattcgtttctcttttcagtttgttctgttttggtatgctgcggaagtgccagtttctgaatttgtattagctagatgccttcttctgttcttttcgctgctcctgatgcaatatgcaggatgcttcttctctacacgtctctctgttttctgcctcgaaagaactctctgtcctattgtggctttgtttactcgatgctattttttcgttcaatgatttctgcatgtgtcgctccattgaattacttgtaaatcttctgattctttacctatcaaagaaacttccatctcttgaatcttgatttggcttccttctcccttaccgagatattgtgcattttttgtctgtaacctgtttttcacttctctgtgatggtgttcggtgccgtactgtactgttaggttgttcttgctttttttcttctgttcttcattctttgtttgcaattgtttaagttttgattcgccgaagcagtgccatatctaaaggaaatcgatcattcttgtacagtacactttatgcgctcgtttcctcttcttatctcactttgaaatttggtgttatgatatgtgtcagtaaagcttatatcgcgtttgtagaaaaccttgtgtgtattttgttcgcagtaataaaataagatttaggtgtaaaataatgcagcactgcaactgaagattgatacttccatgttatatatctcaaaaatgcat

SEQ ID NO: 33711 - DNA, 192 bp, Oryza sativa
ttttttgttagaataagttcaccgtaggtccctcaacttaacagcgagatttttttaaggtccctaaaccataaaaccagaaatgttcacccctaaactcactcaaaccattcacctgaggtccctcggcagtatttttgtccggttttactgatgtggcatcctagtcaacaaaaaataaaaaaataaata

SEQ ID NO: 33712 - DNA, 390 bp, Oryza sativa
aaaagaatgaaaagatgacagagctagctaatgccaatattattattattattatatattgtgccagaagaaatatatctttcaaaatccttttatctccttgcaaaaagaaaattcctcttagctagaagaattttacaactttctttttttggaaaaagatcatttttacaacgattttcgatcaatcaatcacgaaatgatgagaagctttcgttttctttcgcttaatttgttttgtttcagacgagggattaagctgtcgtccaaccaattaattaatttgctgttcccccgtttccctgctacttacatgatacactacgactaagccagtactaacatttggtgagaaattaagtgcatacaagaattaattaattgacgaaa

SEQ ID NO: 33713 - DNA, 1501 bp, Oryza sativa
ttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatggacgccggcggcgaggaggcgaagcaggagcgccacctggtgctggctcacgagctcttcctcctctcccgccccgacctcgacgacctcgccaatgtcgccctccgctccgatgccctcgacgccgtcaagtccgatggcatggcgccgctgttcgagtcgctggccaccgcgggcgtgctgctcaagccggacgacgcagctgctcgccgagatgcgcgcgcggatcgacgaggaggtccgcaagctcgacgagaagtgagtggattcttcctctcttcgattttatttctagccccacaaaaaagaggtcgcccgttgctgtgttgcgtatgcctgcagtagtactatgtggggataggttttgtgataaataactctggtgttgatatgatccgtttgcctaaactaacctagcttgctctcggtgcggaacatggatgctaaagctggtagacagtggcgaagctagagcaaaatggaggggggttcgagattttgccacaagtatatcaatatatataacttcaagctacattttcgatagaaccgttgattaataattttttacatcaacagtagagacacacatgcatcaataaaataaaaaaagtgacaaacattgtttttcaaaattaagaaatccactaataacattgataattgagaattggttactaacccatgagcaaaagatgatctgcatatgcaaacataagcaaacaccattctatttcattatctcaacatcctcgacgatgatttgataacctaaaacaagttaacatcaaaatcagttctcatttttcaaataaaaagtagaatccagcgcacttagatacaatcattacc

SEQ ID NO: 33714 - DNA, 256 bp, Oryza sativa
gatcctgccactcgctgcaacatctacatctctgcttctctgtctctccaagtttcgcaccacaaatcaggtgacagtgcgtggccttcgtcagaaacaccatcagtttcagaagcacaacaaggtcatggatacggcactagtcaccattgctctccgctggacctggagctgggcatgtccctgtccaccacgccatccatcggaacctagcaccatcagttgccgtggtcatccatcgactggattcccaaga

SEQ ID NO: 33715 - DNA, 1501 bp, Oryza sativa
ctataatctactctctccgatccccaaaactctcttgcttcgtgctgcccaaactcgcaggaccaaatatttatgtccgaggtgatctcccttgtggcagacgaactgtatgacttgggaacaaatgctatttcgctgtcacgtataacaaggtcgacatggatggtctcgggccagtcgtacagcctcgggaggaacaccttgttgtgcatcaacctaagcttagtcttcctcaacatcgtcgtgtatgtcccggtgaacaacgcatgtccttccaatgaccgcatcttctcccactccatcgtctcttcattgagcttgacgacatggacaggcgcaccactgtagccaacgaggacagccatgagcgcgccagcttggtcggactcaaacaggtggctatcgacttggtgttcgattccaaagctcccaggcttatcaagaaccttaaaactatcgccatggttgcacggatcgtacaccgcgagctccccgtcttcgccaagaacgtacagcaagccaccgtggagcaccgggttgctggtcggtgccgccagaatttgcggtccgaagcccgtcaattcccagggcccccattggccatcgtcttgttggatcgcacgggcgagccgtagcgcggacgtcgtgttgacgcaatacatccttcgcgcgcggtcgtcgtagacgatgaaatcgggcgacgagtcgaaaggcggtgtcggcttcggcagctcatggatggtgctgccggcgagtagtacgagatcggcttggaggatcgatttaggtgagcacagcgtgaggcgtcgtccggtggagcagcagatcctagcgttaggcaccttgacgagcgtgtcggcgatctggaaacacttgtggtagtaggggctgtagtacctggcgctcgtgacgccgacgtcggcggcgctcaggaggagaggcgtgatccacgccgggtagaagggcgacacggcggagcgccagtgccggcacgtcgacgcgaagctggggtgggtcgaccacccgagccgatattccaggacgagcacgagcatgtccaacgggagagacgaccagtcccgtcgtccttgcgccgccgtcgcggcggccgcctccatctgtcgatctctgcttgcgcttctttttgcggtgctcctcacgcgagtcgcgagagttcgtgcctgcatggcgagctgcgttttgtgctgctacggagctctactttcatggcgtgtttcctccggactcgtattataggtcggcttcagctcggagattgtataccgccccagcgccccggttggtttttgttggtttgctacccactctccatatatgcaaagtatttagattttgcttttgaattgggttgatagtttgaattttgatatcgtgtaggaactcatgtttccttttcctgatctacgggcggtgcagatgataattggtaggagtactaattgtaggtagtggacgtgcatacctctttcctatgccaata

SEQ ID NO: 33716 - DNA, 1086 bp, Oryza sativa
ccccacattttttgtgtcacttacatgtgggctccacatatttatttttttattttttgttgactaggatgccacatcagtaaaaccggacaaaaatactgccgagggacctcaggtgaatggtttgagtgagtttaggggtgaacatttctggttttatggtttagggaccttaaaaaaatctcgctgttaagttgagggacctacggtgaacttattctaacaaaaaaaatcccagcgtattaactggcctccgactcttgcctcggcctcgaccgactctcccgtctcctcgcgagttcacccgcccgccgcctgcggcgatctccatccagcgagcagcggcgccggcgccggcgtaccgctgcttccgccgcatcctctatctctggtgagcgtccatcctcttcgccatccctccctgccaacacctttttctttttctcgaattcgcgttaaccctagcttctctgctagatctggaggcgtttctctttgccttaaccttgttatcactagtactaataacagtttgtttgttcctgaagaggatttggggtttcaactgaactcccccatgtcgcactttagatccgcccctgcgtgattgtatagtcacatggtgcttgggctccggtttttaatatctgctatatgttgatgctcatgcaacctataggattctataattgcattattttgattctttgaagttatatagaattgtatgtagatacgacgagtcagttctaagattactggctagacttggctgaactggttctttgtgaactttagtggttgcatatatgcttgttgatattgtctatgctgctatgagtgacaaggcctatccaatcatgtcttacctcatcctctaatctgattacccctaaatttgggtctatactgtatgtgtgcgttgtacttaccaagaacttttgttttgtaagtttttcctgcatgaaaaaaatattccctaactgtacaatgcatttctgcgcaagtattcatgctcttttcagtcattcatattcattagattttgaaaagtactgatgtttctttgcttttgttttcaggaga

SEQ ID NO: 33717 - DNA, 328 bp, Oryza sativa
agttttttaaaaaaaaatgtttcagaggatatcttcaaatcagtatcagtgaacatactggaagctcagaagacacttattaattggatttaggaagtgtggcaacataattttcattttacctctcaatacagatagttatatcaagtgatacaacacgagactacatatttgtatttattacatggaaatgcagtgagagcaaaagaactctagaatttagattgatatgaaattaaacatgaagggtaagaaatttacaggagaatcaactaataattatccttaatgttttcctacactaaggcaaaagaaaatgtgtaaatta

SEQ ID NO: 33718 - DNA, 1501 bp, Oryza sativa
ctggacggggattttaatgcacattctgcttggaattctattcgggaatttctaggcgtgacagtgacgagctcagaacaaccggatccgatggcaaactcgctcatttgtgtgatttttttcctctctttttttccttttttctagggttctcaatctgtgtaactatccgattggatgattcttttagattctccgtgtagttctgtttgataggatgacttttttcaggttctctcagtccgtgtagatctttgatttgattttgtgctttatccatcgtacatgattggtatatagagtgattaataagaacaaaaaaaattctaccttttttatcacggacggtgggtcttcttttctccgtgtcattgatgaatcggacttttcttttttttttctttttatatgatgagggcatcatcaccatggataaaccataatgatgttttacctaatcgaacataaggtgcaagcttcttatgaatcggagaggtgtatcgatcgctaagggcgcaacgcaatgccttgtacggttgtagtcggatcatcaacgtttcttccaaatcgtagttatctcaactcaccgaaagatcggtccaaacaacagctttgagcatcttgagtggagctcagggtttatcattatatatttgttcgcctttttttttatcacgatgacgaaaacaccttcaattttttaagtatttttttaagtagtagagatagagataatagaaagattaaacaagattcgatagacgcatgtgatgatatctctaatctaaaaaatataccaacttagtcttggagattctcatagagatatgttgtgcgtgtgtgctttcatatggatcaatgtgcacgtgtttatatgaatgcatgtatctatactgtgtttcgaaaaaaaatacaacctgttctcaacgctatattgacgtgaaagtaaagtgaaagtcttttttactttcacgtagaataattgattttgtatttttcttatttacttaaagttgtctttataaattttagcaaatgagatattttcaatagactttcatgtctaaccggaggaccgtagcgtttaaaaaggaaagaaaataaataaagaaaatgggaaccgttttctcgctccccttcccaggcgctatctcctcccaccactcgaaccttatcccctccaggcgcctcactcgaaccttaatttcgtgttctagttagaaatttggaatttagaaacacagctggattggggttctcctatggatcatgcttcagattttatttaggtggattagagtcttattcctttcgattttggaacgacctgggctacggactacacacgttaggatttttatcgatctctttttctttctttggccgctgtaaaatagcgaagatagagggccactcagtcggaatcgacggacgaatcggtcggaattgacgcacgaaaattttgtgacgaaaggaaaattttgccaaaggaaaattacga

SEQ ID NO: 33719 - DNA, 393 bp, Oryza sativa
ctagttttcatctgtaatgtcatgatttatttatggaataaattaaatcattatatgcccataatatcaacagtggtatggtatgacagtacggttaacgataaattaaaacccaaattgattacaaatatagggctaaacacaaaaacgacgggtgcaataattgtcgtgtcctcactagtagcaagtcgacgtccctctcgatcaatcggtactagcagcagcgagattagcatcactcttttctccatatattaccatatttgtatcccattcgattgtgcaatgcaatgcaaatgcgcaggtcattctccctcccttaactagcctgctaatctgcagccgcgacacacacaacacacacacaaacgcattgacgcatgcacgccatca

SEQ ID NO: 33720 - DNA, 1501 bp, Oryza sativa
cattcaaaatatgcactaatgttagctcggctatgtcacgtctattaatttcattaagttttggtctctactatgtgattgggagctctttttctctgaaattttatgaaaccatcttcttttttcttttaggtgtttaacagctccccaatctgctttcttcctgagaaagcctcgttgtgtagtgcccgttccgtcgtagcgcctagctaacatcgtcagatcccaatcccccaatccatcgtcaagttcgaattccaacttcaagtcccctccaaatcaaatctctcgacagaagtctatttcgcctccctaaagttttgtgggccgagctccctccctcggcacatcttctccctcagcccatcccctcctctcgcacatgccgtgcgagtgcgctgagccgagccgagagagagccctctctctcattttcttgctctctctttgttctctctctccccgatttcccgccaacgacacccaagttgccgcgccgcctgttgccgcgcgtgcactgtggtggccgaccggccggtcgccgccgccgtcagccctgcctgttagagtatatggtagttagagtcatattaggatagaattggtttgtttggattccttccatatctgtaatccttccttatcttctccccatgtactcctgtatatattggctccctgagactcaatacaatatgtccaatattcacagtatcctctctccctatattatctaacatggtatcagagcagacgatctagtcgcctctctctcacgcttccgctcgtcgccctcgggagggtttcaatctcctggggcggccaccgtttttttttccttcgcgtcgtcaagtcgatgtcccgagagagatcgatctctcggacgcttgcgtcgtcatcaagcggcagtagcagagtctccggtcatcatcagtctgcacttcgtcctccacctccggtccgccgcctccaccgcccctacctccgatggccaccgtcggcttatcgacctccgccgggctccgcggccgacggacgaccttgtctccgcctcgaccgctgtcttcatcaagctccgccggggggatggaccgacgtcttcaccgcctctccgcctgccttctgcctcgtcgccggcaagacgctgctggtccggcgtctctggcacgggcgcgcggcccgacacctcgccgccaggatctgcaccattgtcgccgcttgcggcctcgacgcctccggactcagctccctcgtcgttgccgccggtcagcccctacgcgtccgcgtctatcttgcctctcgctccctgtattgtttggttgtccgtcactttgctgtgatcttacacgtgattagcaagggagaggagagagagagaagatggttgcagagagcttgttggctggctggctggctgtggagggaaccgattgtgcatgtgtcgctgctgctggtacagttgaggcagagaggttgctggacgtggacttggtctacggac

SEQ ID NO: 33721 - DNA, 1501 bp, Oryza sativa
gtccccgccgcccacttcttcccgccggtctcggccgcagccgtcaccaccgtgcccgccatcatctccaagcccaccgtcatggcccctcccaaaggtaaaacatgctactgattcacgagcactacaagttcttaattccatggacagactcctgtttaggaacattgcgatgaacaattgcactagaggatcaatgtagctgcattttttagtcggtagttgcattgcaaaggaaggagttaaacccgttacctatgtcgacaaacttttctgaatctgaacttgaacttcaatcaaagagagacagctacgaagatactactaatcaccttaactaccatcagttagtacagctttcgcatgtgcactgtcttttgctgcccaaagctttgcagatctccagctagctacacatgatgtaaccagttcgcaggatctaccgagtacaccgatctaactctggtgcctgcatgtttgtgatgtacatgtactgcagtggagcaggtgacgggatgcagttgaaggggcacggcgacagtgcgaggaattaagaggaggccaaaggtgctctggcgattaacaagctgcacatgaagggttcgtccggttgtcggactaggctgcctattcgattcgtttaattcgctctaactcgtgcgtccatgggggcgcacgcccatcaaaaatctgtaacaagaaagattcaattcgtctctcgtttaccagcgtatttttcaatggtaaaccccttctttttccaagtgtctgtagtccagtcgctgcaggggacagtgaacctgaataaatcgtcataatctctcgtcatatattctctgaaaattctgtctggaaccatatgatgaatctgatgaaatatgatactcctactacagtatcactcgctatgactcttgtttggttcccacttcaaccagctctgcaaactattatgccccttgttttactgcagtagtaactcaggtttttcttttagatgaaaaaaacaactaagtttggtgcacatatgtgagctcaattattggttcccacgttgcggttattttcacggactgaattatcagttctacattgctaaactgtccattgttcagctcggtacttagtgcctatcgtcagagaaaacagagcttttgatggattccgcgagagtctaaatgcgcaagtttgctggacttcaaatgaatagacgctggaaaccacacgtctaattactcccgtttaattggcaaaatctcgaattatcgacacttcgcctacttccacacgttgtttacctcaatccacaagaacataatacgatagcgctactgctcattctcttctgcaatttgacgcgcatttagccactatcgtacatagctaccaatacagtagacacggagttttcattagcttaccttaccttatcagcattttgtaaacctggcctactctgcgatgaaaatcacatgtttgagaggatgacgttatgtgttca

SEQ ID NO: 33722 - DNA, 579 bp, Oryza sativa
  unsure (1)..(579): unsure at all n locations
ccgtcaggttgatctaactcattcngcactgccgcggccgactctagtggatccccatgattgaagggctcatcatttcacttggcaattagtttatggtcaaacatgttttcttaggagacagatggtccatggccagcctgttgcatgtcaagggaaataagtgtttaatgcacgcttcaaggaaaggccgttgtttttgcaattgattttagttgaactcttttctgaaaacaactaagtgagtgcttctcaaacgacacggttgagacagtgcgtctcgttcggtcggagtatgtgcaatgtatcaggctttagacttgattcaaagttggcacccggccaacagcttttcaaacggccacccgggcctacaactttcaaacggtcacccgggcctagctgatcccatcagctgcagatttttcaaacatcgaaccccttttcacaacagcaattttacaagcagtagtcaaacaaaactacgctaggaatcacctcacatccgcccatgaccgggggcacggctgttcgaacagtttgttaacctttgcagagggggggtacactttacccaca

SEQ ID NO: 33723 - DNA, 1501 bp, Oryza sativa
cctcagtcgatcgatctgcttcatcttaggttagaagcagattttacgtgagacaacaactggataaggggcggcagggacgttgtttttgttacgatgagtagcagttaggagtactagtaatataggaatagtatactctgcatctagtgtatatatacttttggggtctgagtcttatgttttcctgccagcaaaatgacgatccctaccggataccctcacgtgctagctagctagctttagatgtgttttcaggtgtaccgtatgactgtattttctgtcaacttaaaaatacactcacatgcagcaactgtatgcattccccagtgcctgatttgcaaccctaaacagcactactatacaatacgaggaaaggaaacaggaaaagcttcttttctgagaatcacaatcgccctgatcaatcgtcaagattaacatggttcttaattaaaaacagctaaagactacagtaatatatagggcaacatgatcacgcagctgagagcgagcgagcgagctagctaagcaaatcaaaggcgcgagcacgttgtgtggtaaaggcgaaactgcaaagccagctggttccatcttctcgtacagctccccatatggccactcgtccatctctcgttttctccagccaggtaaataaacttgtaatcgaatcatctcacagcctaatacattgtacggacacacgcgagttactaccaatatgaactgtcaaattaattaaaccaccccaaagacaactcttcttcaggaagattaattttggttactaaggcggggtttagttcctaattttattttccaaaaacatcacatcaaatcttttgacacatgtataaaatattaaaaatagataaaataaaaactaattgcacagtttacatgaaaatcgcgagacgaatcttttgagcttaattagttcataattaaccataaatgctaccatgctaatgacggtttaattaggcttaaaagattcgtctcgcaagtttttagtcgagttataaaattggttatttcatttgtgtccgaaacctgactacgcagaataatcagagtggtgtgtagagatcttagccggagagtgaatgtgtgttgcagcctgcaggaattttctgttagttacactagtcggagaggagagagagagagaggccaagtgaggcacaggacagagttgccaggctagaggagcagtgcgacaggctagtagtagcagctctcctgtttccgttatccagcccacccaaccaccactctccctccttccccccaagaatttataaactccggtctatataagcagccgcagtagcgcaccacatagctcgctctcgctcgcctcccccttcgcatatcaccgcgcacgaacgcacgtcgcagctagcgggtcgtctcagctcggcgtggtgtcgttgaggtggtcggtagctaggtagctaggcgcgcgcggccccggccacgaagagagatgacgatgatgggc

SEQ ID NO: 33724 - DNA, 434 bp, Oryza sativa
ccgcgcttgaattgcaactcggactccaacctatactagactcttgtatttatctagatttgtagcactaagaatacgtcatttggtcctaaattcttatattttgtgacaggggagaagcaaccagctacactagattgtacaccatctagcactatgaatgaagtaatgctaggttatctaatacttaatactttaatactaagttgttatatattaggacaaataaaatagcaattcagtcattttggttaaccaaggtatggccgaataagaccctgtttagatgggactaaaacttttaagtctttatcacatcgaatatttagacactaattattaatattaaacgtaaactattaataaaactcatctataattttggactaatttacgagacgaatctattgagcctaattaatccataattagca

SEQ ID NO: 33725 - DNA, 1501 bp, Oryza sativa
acaaacctgaccatcagcagcaacagttacaatggcgctatcatctgtaaatggcattacacgagcatggaaaacattttcttgatggccagaagggtaaatgagcctttgtgttttagcaagccaatcccataatatgatgtccatgtcgtccgaaccagacacaaggaggttaccagcaggattgaagctgacagtattaacacaaccatcatggcctcgcaactttccatactgatgcatccgcatcactaggccctaaacaattggaggaaagaagaattgtaactagtccaacatgacaatgagatattcggtgttatagaaagaagcaattacaaaaaaaaaaaaatcagaaaggttgtcacatgactttagtaatttatctcaggaagtactccaatcatacatatacacattcttgaacaacaataacaatcacaataaactagtatgatcagacttcaatgaaacatccagaaaatgttctacaagttacaaacaaatgaaacggtagtataatcaaaatttatccaaacaatattatcaatttaagtgtgcctaatccatggaccctgacagtactcaattcgtatcggcggactcataaagtcgtaagatatgaattttacagcattaactccataatgcctatgcaaactgaactgttacgaacaagaacaagtagtatcaaatagtacttcacgattcacgaatacggccatcatgatccatcctcccttacgggcaaaaatacgcggccttattacttccttagtgacttgcgaactctacaagatcaacacctagaaggttccaagaaatcagacaccaggatcatatgggattaaaaaccgagaaaggggcacctcggagccgctgattcggcgcgaggaggcgcgcggggtggaggagccgatctcttgcctgccgacctcaaagaagcagctagccgcccgacgacaagcggcctcgctggcgacggccatggtggaagctgcggcggtgcagtgccgagggggcaggaggaggaaacgagacaaagcggaaggggatttccgcgggtttagccggcgtcgagcttgtgctttctcgaagatgttcctgggatttggacccctcgtctcatcgagtcacatacttttgctttgtttttttttttcactttagttattgcctgttttgtttttctttttcctttttcatctactgaggattgggttgcctgaaacgcatctgcggttgggagtaaaggtactccctccgtcccataatacaagcgattttgagtttttatttgaactgttttgagtttttatttgaactgtttgaccactcgtcttatttaaaaaatttatgcaaatataggaaaataaaaagtactttagataataaattaagtcataaaaaataaataataattccaaaattttttaataagacgagtcgttaaacagttcaagcaaaagctcaaaatcccttgtattatggggacggaggg

SEQ ID NO: 33726 - DNA, 497 bp, Oryza sativa
tgctctattgtatatatatccataggattatctctactaatgattttttcgtcattgcattgctctcatgtgatctgcatgctgttttgttacttgggaataatctgttagtactataaagaaatattatatctattcttgtggatagctctgaaacagttcgcatttgattctacaacatccatttctatttgcaatatctttgcacatttcatcctttttaagttataccaaatgaaaaccagaagtttgcatcgactgctgttggcagctgtctctgtaggactatgttacatggaaggacacatgttttaaatccaattcatgatttaatggtgtttcttctgaacattgaaatttgatcattactacagtaataccaggagagagtgtgtgctttattggatattataacaaattggagtgcaagctcattctagagatggtttggttccatgaaagcttcaggtttgactagtgctgttttgtgttacaga

SEQ ID NO: 33727 - DNA, 436 bp, Oryza sativa
ggccacagtaccgccgtgcccgggccggcccacgtgcctccggcccatttggttgtctatagttctggaggaggacactcagggtgtggggcccaccagttgctacctgctttgctgcaatacctcctcctccagtggccacctaagcagagagcactggactgtggaaactgaaagtagaaactgaaagccacaggttttgcatcttcagacctcgatacgcatggttgtttggatggtacttctccgtagggaaactggggatgcgtttctcgtcaatttcaatctagtatatttgtttgtgaaatgacaaagtatagtgattggaattcaagtacgtgttcagaaaaaaagacacgttctaatacatcttatacatagtgctcggagatctcaaattctcaaaagacgtctgatgaccattccgtttcccaga

SEQ ID NO: 33728 - DNA, 217 bp, Oryza sativa
gacttctccccatcatctcgtccctacatctcttcttgcctctctccaccatcgacacctcatccacttctcctcctctgtgcacagggcgaaggtggctatcgcccacctaagcagaacctagtgactagggggaggagcacaacaatgatagctcatctcggatgtcgtggcatgacaatgatagttcatctcggacgcctcctcccacgacagc

SEQ ID NO: 33729 - DNA, 1501 bp, Oryza sativa
catttgatgctgcattgtacggagtactacacagtggcagccattgaatttgaaatcaagtccattattacctcctgtggctatttttaattacacgcatattactcctgtcggccaaaatagccatgattagcactaacccagtactgaaactacaaagaagaaatcgccatcaccatgatcatcatcatgcacatcaactatgtgcaggcctaccatcgctaaaaagcaagccaccaaactgcacaggacagtacaaccctttttgcatcattttgccaacccaaaccctaaaaccaatccaaatcaaaccaaccaccttcctgcgttgatgaccactgctgatcctggtgcaatggctatcactctctctctctctctctgtctgcctggcgtgcgtgtccccctcatcaatgacactgtttcgtttcacctttaattaaagattcctatcctctccaatgattctttgctctttttttttctctcattctgatcatgcaaaaatttccattgaattctctgtctccctgctttcagtgaaaactgaatactgaagaagagagataatgcatccatccatgtgtgtgtgtgctgtgttgtgttaagctttcctttacaaagaggaggaccacggtgctttgtcagtgtcactgcctcactgtttgtggtctcaccttttccctatcacgtcctcaacttacactagtctacatgccacctttatcactgtgcttgaaatccatggctattttagtggcctaatgcaagagtactcttcttgaccctggtggtgagtggtgactggtgagctgagctgagcttgcagttttggttcttggggtcttgaggagttgagctgtggtgcttaacacaggcatagctgcttgcttctttctttcacaaggtattctttgtcttcagatttgcttcattgcttggtcatgttgtatgtcttattatgtgttcctatgttcttggcttttcctgtcaatgtgtactagactactagtgctgttctgctctgcaatatctagtgttcttgctatttgtagaacagaatgtgaaaagaacagcacatttgtttaattttagagtttcagagcagtatgttcttcacctatgaaaaaaaaaactacaatctcctttcttggcagaaaagcagtggcaacaaattggttaattctattcttctgatctccattctgcatatggcctctccccttacagcttgcaaatgctttcatcctactagcagtgcaatagtgcaatccaaccacgagcaataaataattgtgtttttttcttattcttttctattaatgtagtcagctcacatggtgccatcttcttcttccactttggtgcagttgttggcattggctccatgtgatcgatgagctgagagagctcagctcagctcagctcactttcgccactgcagcatcggcgagctagagctgtagatcttgggaagatccagcaatggagaagccggcgt

SEQ ID NO: 33730 - DNA, 342 bp, Oryza sativa
caaaacatgctctaggtcaacatgaaatacaagtacaaaaccaaccaaccatctctagtgctagcaaacaaagtttgacatctcccaccaaactcaagaaaacattacttgtatcagagtacactaagaccatgaaattgttctgctcggcgtgttccacataactacaagtaatgtaggcaagagcatacatcaaatttacgcccaattcaacaaaaggacgaaagaaatttgcacaaactcgcggccaggccatttggttgagtgctgacaaacctaacagtcagatgtcaccgaaagctacccataattggcgcccaaattgaaatcccaaactgcagc

SEQ ID NO: 33731 - DNA, 1501 bp, Oryza sativa
tagaatcttcagttgtcagaagctttgtcaaatagttcatattttcacttaaattctataaaattgtagttgtgtaatttagaaaacaaactagaagacaaaaactggattttccagcttttccatatatattctcaccagctgtttctcgaaaccttaatctctcaaaaaaaaaaaaaagatcttagtcacgacatagatggtcgtgactcagcaagggtgagattaatacgcatatatcttggccgatatatggttttaggccccgttcgatctctctttgggagatagtttttttttcacgcaaaacaagaaatatcattagcatatgattaattaaatattaactattataaatttaaaaaatggatttatttgctttcttaaaacaactttctatatcgaattttttttaaaaacacaccatttaacatattaaaaaaacgtgcaaatgaaaaaacgagaaagttagaatttggagttgaagaatataactgagcctaagtaccattcaactcaagtacggatgcaggctgcttgtagatacacatatagatatagtgcgtgtctctgcttccttgttaaaatcgtggtgtatggtatcgtcacatatgctaccacgttttaaaatataatatttttaacgctcaaaattaattttaagtatggggttgatcggaagtgctggctgtcagtcagccccaatccaaaccaaagagtatttgctgcagctgtgaatgggcagccaacacaaccgatcaagcactatagctatatctccatctagtctttccaaatttatttaagataataataacaattacatctcggtcactgttaaacagcacacattcaacgagccaaagaaaaaaaaacaaaaatatttgagattatatgacaaatccctgtccccctcccaatgacatccaactaaaataccgaatagaggacatgtaacatttataacaatgctggagattattactccctccgtccccataatacaagggattttgagcttttgcttgaactgtttaacgactcgtcttattaaaaaattttggaattattatttattttttatgacttaatttattatctaaagtactttttattttcctatatttgcataaattttttaaataagacgagtggtcaaacagttcaaataaaaactcaaaacagttcaaataaaaactcaaaatcgcttgtattatgggacggagggagtacctttactcccaaccgcagatgcgtttcaggcaacccaatcctcagtagatgaaaaaggaaaaagaaaaacaaaacaggcaataactaaagtgaaaaaaaaaaacaaagcaaaagtatgtgactcgatgagacgaggggtccaaatcccaggaacatcttcgagaaagcacaagctcgacgccggctaaacccgcggaaatccccttccgctttgtctcgtttcctcctcctgccccctcggcactgcaccgccgcagcttccaccatg

SEQ ID NO: 33732 - DNA, 1501 bp, Oryza sativa
gatgaatcaggattttgggcaatccataatttcttgtatctccttgtgtccatgcctgcaagtacagctgtgtgttatcctgcagaacctttcgttcttttgttattctttttcaagtagaatcatgttgaagaattgcttgcatttgataaaataatattgagtctggattctgcaactggaaactcattgtagactggtagaaacaaggaaaactgtgcttttgtaattcatttccacaaatcatttactcttactcctacctttttcctttatgttttagtaagatgcagactgaccaagaacaacgttgaggcgcaggacttgtcatggttgtccagtattttcgaaggttgattctatcaattccgcctgccttttatatatatttacaattacccacattccttgccagttgacaccatgatcctactttttatcttctgctttacaatctttcagtgctgctttgctaattttctactgtgctactatcaaattgcatgctttactggcactattttcactaattatttctcttgcgcacctgtgaaaagtttgatgcccctgtggctaataacttttttagtgtcatgggttacttgttttaaacttataagtaaatattctattgagtgaaaggcttgaaaattttgtcaccaagatgcgaacgaccattaaatactcagcacagttaaggcttggaaaataaggttacatgtttagcatgacagtgcgtgaagtagagaaaaaagcgctgtcagcaattatgctttcctgaagcaaatcgatgtttctggtattcgaacttttagggcatacaaaacagtctttatagcaggctcttgggggtaccacctaagctcagttaatatcaactctctgtagactcttagcgccagataatagggaatttcctcgcatgaggctagataaaggaaagaagaataatgataaaaatattttggtggattcatggttagagcctctgttgtctcaattgttataagaggatagtctctaagatgatgtgtattaccaaggaacccatactaggctcaactgttgtacttgccatactacctccgttgtaaataagtgcatttctggtttcctaagtcaaactatcctaattttaaccaaattcatagaaaaaacaatactccaataattactattcaaatgagcatcattagttccattgtgaaatatattcatagttttacttatttgacatggtagacattattactcttatctataaacttatgcatttgatttagtagaaaactacaaacgcacttattttaggatggaggtagtagtagtttgtctaaatgagaaacgtatccatgacagtcacactcacacactttactccatttccttaatacaaagaacaatcttaccaaccatgcttggttctaccagtatcaacactctattcttcttgtcgtgtcatggatctgcactgcatcttttctaatgtctttgcatttac

SEQ ID NO: 33733 - DNA, 1501 bp, Oryza sativa
tcctgccgccgccgttttatctccccgtcggtgacctcgattatcctgccatcctccacccctggtattcccgccgtcgatgtcgctgatccctgtctagccaccacggccgtgccaacctccgttgctggcgaccacgcgcatctgcactgcaccgatctcctccctatcgaccacggccatgccgatttcttcggccctgacgaccgcgttcacatccgcgttgatctcctcctcccactgaacaagctaacagctagtatttattttcgattatcatggtacttgtgcgtttgctctcaatcgaatttgatttcttcgttgttgataagaagaggaacctgcttttttgaaacgaaccgcacaagaagaggaacatgctaatgctattgctactagattgcatgtatagcgttgtatacaagttccaattcgatttatcggatgtgactttgatatggatggatgctgaattttgattcgggctggatgcaatatattggagtatatattaattctgaagatgtaatgtgctagctattataatattatttgaataaaatacaattcaactgaatctctgaacttgagtatgtataaaatactattttgactgttaatttctgttatggtatatttctaaaaatctaaaagtattgtttgaaaagaaaatactcacaattttaggatcgttgacacagttcctgagtttttatctgagggaacatttctgaattagaaactcagttcctgagttgtttttttagggagcagttccatatagttactaacttatagtgttaattactaatttgtccatgtatgtccacaagcattctcataaatcatcatgatatatattctttaactgctagaatattttcattatgagatgagattttaaagcagccgcgactgtcagattcacttgtatcacagaattgttcactttcctgaacatgtttgcaacttgtgaagtaatcctcaagccggagctatgagagggagcatgtaagaagcatcaacacaattgaaggttggggatggaccactgacgtttcttcagccttttattttgttgtatcagagactttgttcagatgattatatacttcttaagtgatatgcatgtaaatgtggaggtcaggggtgtaattagcaaaaaataaagctctatcaagccaagtttcaggatatattaaccgtggtgattgcagattaatttctgttaggtgaagataaaaaagatagttgcagttatgttagatgattgaaaaaaagaagtggtgtggtactgggattgacccctcgcgacatggacaaaattaaagcatcttgcagtaaccatccacggcaactcccaagtgcaaatatatatcatctttgcctattcatttgttttaaaacacgaacactgtctaccaaagaaaaccacgtgggatatatcgcaagggagtatattactgcttctgtgatagacattaaattatggcgagtacaa

SEQ ID NO: 33734 - DNA, 385 bp, Oryza sativa
aataatatattggaaattagtggcttgtattgaaatataagaatgtggggcctctattttctttttttttttttgggaggggaaagttgtgcggttgatcaggtggcacatggccatggatagccctggcactctgcgtacgggctgaaggagaaaaaagaatataagttcttcttctcattatttatggatacactcagagtactatacggccaaaatttataaagaacaatatttgatctgagtagagtcatacacctacaactttatcataacaccatcgcaattaaaacccatcctcgcttgttaatcaaatcaaacgttctccactaatattcactcaattcacgtagaaatcaaccatatgcacgtttgctcatgcagg

SEQ ID NO: 33735 - DNA, 1501 bp, Oryza sativa
aaatgattcataataaaagatttgatctcaccctggtctaaaacgacaagtattatcaatccgaagggagtaaatatagagcttgaacctgacttggttctaccacagcgttacgcttcacggttcacattttttatatacttcctccgtttcacaatgtaagtcattctagcactctccacattgtgaaacggatggattatattagtagttcaatcaatcggattgacgctattttttttaaaaaaaataacttataagattggtgatttatactatgttggtagggtaacagtaagcgagcagggttggtgggtgtgggcgtgtggcaaagcagagaggcggctaagcgcgggtcaaagctgagaacaacgccgacgagagacgagtcgtccgcgagtataaaagcggcgggggaggagagtggaggggtggatggaaagcgggtgtgagtgaggaagatccccctataaatcgcacccggaaaagatcaccatccattgcccaattcgccgtcgtcgtcttcttcttccacctcgggaagtcaaatctcgtcgccactgctggttagtctccctcctcctcctcatccacactgcttagattcctctttggtggttgatcggttccgtagcagagttctgcgcgatcggtttttccattgctgatttcatttgccgtggaagggattgtgctacgctgcggccttaggatctcatcgcagccttcgcaggcaaattcctctgttctgtgcgccgtgtttgtgttcatgatctctgtgtttattctgcgtgtgctcctcgatttcctggcgccctgatgcgcttgctgtataggttcgttttaatcatttgaagctctcggaacagaatttgctttgcaagttgcagttctagtttatttcgggattattgggtggttgggctgttgtgtgttctagacttctagtgagtgcagtggttcagttgttgcatgtgttccagtttacccgtacaaaatgtaggggcaccgagttcaattgatttacatttgtagtcttgtagatacttttttttttctgtattagaatctcatagaagcatttgactagcataactacagtacctgtttgtgttttatgagaactttgactataagttggcaaacaatgggagtagttcgctgatgtaagttcagggtagctatattagtagtttagtactgatttcatgaaaccaactttaatcccattcattttgattttttttttctgaagcaaacattcattttgatttacactctgttgcaaattggctgttaggtactgacaggtgattcagttcaagaatccatcattcaaccaatagacctttttgttcatattagcatagattaaagttttggatagattataagttatttgtgaatacctcatattgagactaacagtacttttttttacattcttaggttttgtctccaaaggaagagaccatacagttcatcatgtcaggaggatctg

SEQ ID NO: 33736 - DNA, 1501 bp, Oryza sativa
cctcgccgcgttcatcgcctccagcgccctcgcggccctctgccccatccaccttctctacctccagcgacctgtggcggctgcggcgtacgtgctcggcgcctcggcaagggcggcggatccacgatgtgctgcttgtatggcagtccggcggaggagaggctgatgatgcaacgtcgccctcatcttgatgttgccgttgattgttcatcccatctcttcggctgctactggttcgagaacaggtaacgtcctgtcccattttctcccatcacttcctgataaatgatacagtaatgttgtaggatcactattagatcctccaaaagtagcagcctgacgcgagcaaaattcagttttaacaccaagtagtacttcataagcacaacctgctagatttctactgaggttgttgtcccaactatacaaatttgaaatgtgtctgacaaatgttatcaaatcaccacatagataattcttctgtgaccattagcgagagatgatttccgcttgtgcttcattctattttagttgatgagcagccgacaacggtttaaatggttatgattttgcttcagtaaaattctagtactaattctggagttctctatacttcgtaaattacacacagatcgatttttatttgattcgttgcttgtagaaatagttccactccctgtgctacatcacataagtcaaatttcagaagatactactagtttatagtggttacggccagcatggaacagttaaggtccataattttgtaaggctctgcagatcattttattttggaggctttccaatgtgtataattttcttttcattttttcagccatgcagtggagctccaatggtgagtttgcctttcattgtcttgttggagattgcacgttggaattactggcaaaagtcatgcttcttgcattcaagagttgtatcctgttctgcgagtatgatctagcagcatggtatggggctgatattttataaaggacaacgaccaatgtctgaattgatatatatatatatatatatatatatatatatatatatatatatatatatatatatatatatatatatatatatatatatatatatatatatatatattgtactcgccataatttaatgtctatcacagaagcagtaatatactcccttgcgatatatcccacgtggttttctttggtagacagtgttcgtgttttaaaacaaatgaataggcaaagatgatatatatttgcacttgggagttgccgtggatggttactgcaagatgctttaattttgtccatgtcgcgaggggtcaatcccagtaccacaccacttctttttttcaatcatctaacataactgcaactatcttttttatcttcacctaacagaaattaatctgcaatcaccacggttaatatatcctgaaacttggcttgatagagctttattttttgctaattacacccctgacctccacatttacatgcatatcacttaa

SEQ ID NO: 33737 - DNA, 1501 bp, Oryza sativa
ctttttagataatggaaatggattgcatctccggcttctgtcataagacacacagccataaatttaatagtaataaaaatgtaagataaaagtaaatcaaaatgagaaataaggtgatgggacaaatccccaactcccctttattattgactaatgttaaaccacataaaatattttagctagcaattcttatgaaactacgccacccatagtggaataagagacccttggctaccgattccaagagtgtagcaccattgcgcatagtatcctgctcctcttgtggtagcattgtagaccataagtggagccagtaggaagacatgaagataacctgcatagggttagataattgtttaccattaaaaactttatcattgcgacaacgccaaattgaccaacatacagcgctagctccaattagaatcatcttcttaatggacctagatacccctctaagccaattatcgaaaatgtttttggcgttacggggtggggggatattaaaaacaaaaaacacacatctccaaaaacaaactgagcaacatgacactcaaagaaaagatgttggattgtctcttgtgtatagcagaaagaacaatgtttgtctccgccccctccaattttcttttacccaggttatctttcgttagaaatactttcttgtgaagaaactacataaagaccttgatctccagtggaattttcaagtcccacagaattctctttttgatccgaacattacagttcatgatcgcgacatacatagatttgacggaaaattgaccattcttatagagcgaccatacaaagcagtccttttcatttgacagagttatattagctagcctgaggatcaaatcgttccactcgattagctagcctctcctttctatgtggaaaaagtacattgaaggtccctcgacttgtcatcgagttacaaaatcatccctcacccgtaaaatcagatatatgacatccttcaacttacaaaatcgttcattttagatcctttagtagttttgttctggttttatttgacatggcggctgagtcagcgtgggacccacgtgagccccacatttctggatgccacgtctcttcctcaccagtcaacgaggttttttcctatatgccattaagaaagatggtgcctgcttctgtgccactaaaaagtttaagcctccctctctgccatcgttaaactttatcgtgccctccacactattccgtctgtttttgttgtaacggtgggtaatggcgcagtaaaatgacttagttgccctttggtccaatatgctctctcctagcactctcctctctcccctcagatgcagcagcagcagccaaggagcggaggggagaagacggcggcactgcgacagcgacggggcgctgcgacgacgacgatgacgacgggggcagcgctgcgacggcggcggcggcggcattgctgcgacgacgacggtggcggcatcgctgcgcgacgaagacggcggca

SEQ ID NO: 33738 - DNA, 426 bp, Oryza sativa
acaaagtcttgacacgaaccttttgtacacatcaattcaaaatattgcatcatcaaaacaatcgaactctaattgaaaccaaccaaatgaaccatcaaacaaatcactaagccaaaactaacattccgatcaacttacagtatccaactgccgacgacgacgataacaagctctattaattatttgccactcttacggatggtgatagatgatttgtcactaaacccacatgtcatagatagtgagtgacaaaataattaattgtcacatcttaaaagtggcccaaagttaaatgtcccctaatatttgctccgtgatttggatcttggtggcgccggtggcggagttgcttgctcgtgctcgttccttctccatgatgatgatgcagaggcggagtggcacttgttgcggagtgagacggcagga

SEQ ID NO: 33739 - DNA, 1501 bp, Oryza sativa
ttcctgatgcaatacgttatacgcccgtcttccttacgactgatcaagtagcaccgcgccttgttctcttctcgtctcgaatcttaaggcgtttcggaatccgaattttctacgatttttcttggccgtgtttggtatcgcggttctctggttcgatcatgtcttcgctgtgtggcatttgatcgagcagcaaccgcgtctcgacctctctttgaatcttgaggcgtttcggcacccgaaacttggggcaaggttcacagcggtttgatcttttttttttccctcttgttcttggtttcccgtacccgtgcttttgttgctttgatggttttgaagtttgaggttgggtgtggttttcttcgagttggaggagaaggttgatgagcgccgaagcttcatggtgatctccgttcgcttctctccttggaacacgttggtcttgatcttgctgtgtgtgtctcaaagactacaccagtgcgtgcgcgaagaattcgtttgtcttctctgcttgtatttttcagtttgttctgttaattttggtgtgttgcgggagttcagtttctgagaatttattaaccagatgccgccatcggccttcttgttcttttggctgttcctgatgcaggatgctttttctctatgtgtctctctgacgtgttctcttggtttagtttctgtttggaaagaactccatgttctgttcatacaatgatttctgcatgtgtagcttggttaaactgcttgttgtttttttcccttttcgatgagaaatcttctgactctttgcatatcaaagaagctttcatctcttgaatcttagatttgggatccttctaagcccaacggttttggttctgcgagattgtacaatttcttcatgtttgttacctatattttacttctcggtgacgctgtcatgttgtattctccttgctgaattctactataagtgcacgctgctgtctctgtttttcttcttctgttcacttcatactctgtttcgaattattgaagttttaatacaccaaagaggtggccatatcgggaggaaatttattgtccttgtacaatacgccttttctgtttgtttcctcttcatttcactttggaatttggtgttatgatttgtgtcagaaaagcttatatggcgttcttacaaaaccttgtatgcattttgttcacagtaatattttattttaattcttccttgcttgattcttgtataagatataagattaatgtgtataattactgcagcattgcaactgaagattgatgatctcatgttatatgtctcaaaaatgcatttaggggccctgataaatagtgtcatatcatgttatgtctagttgactccttttcgtgtttttacgaaagctcttatgtatttaattgatctgtagtgttttgtaattgtattcactttactctttctccatatttgtcaataaagttattgtatatttgtattcatgttataaattttcagcaaaacaaaggt

SEQ ID NO: 33740 - DNA, 327 bp, Oryza sativa
gggtacgttgaaatttcagcacgaatggtacgtataaatgatgatgatagggcgcgctgacagatgttttgaaaaccaccgtggtatgtacgttaggccttgtttagtgccaaaaattttttttcccaaaaacatcacatcgaattttggacacatgcattgagcattaaatatagataaaatgaaaaactaattgcaagggggggaaatttagagacgaatcttttgaacctaattagtccatgattagccataagtgctacagtaacccacatatactaatgacagattaattaggctcaaaagattcgtctcgccgtttctagg

SEQ ID NO: 33741 - DNA, 1501 bp, Oryza sativa
tctctccctcggattcgtttggaaaccctcccgcaaacctcgccggcgtcattgatggagcccgagatcgccgcgccggtttccttcccctccggccgccctctccccctcccaacgctatataaacgctccccgtgcttccctcctccgtttccgccgctcgccgctctctctccccgtcggaatcgagctcgcgccgtcgctctctatctccgccgtcgccgccgagctccggtccgctgccgtcgtcgccccggacctcctcccgcttcggcatcgcctccttcggcttcgccgtgtcctcgccgacctcgtccacccctccgtttcggtcgccgatcgccggaacgccgccgtcctcgtctacccgagccgcgccgccgccttcctccactccggtcgccgtttccgtcgtcgtcgtcgacccggggtgagccgtggaccgcccatttcgtttcccccttcactcccctctctcgggcgccgctccgtcgcgccggaggtcgccgccggcgaccatcggggcgcgggtgcgccgcctcccgtcggctgtgccggcgaggccgccttcgggcgcgccccgcggctgccatgtggggcccggccgtcagccgcccgcgtcctcgggtgcggctgacgcgtgggacccacggcgccagccggcgtaagccgtgtgcacccggtccaccgtggaccgtgaggctgccgcgtgggccccactcccgtggacccggtccgcgcgcccctcccctcggctgacgcaataaatccgattttaaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgcttgttatatggagtttagtagagtaaaagccttttccttttcgttggtcgtgtagacgctgcagctccggaagatccgctcttcgtggaagttgaagccggcgtttgggaaagcgagcaaggcaagtcacatcatctttgaacatattgaatcccagtttgtaaaattatgatttaaattattgcattatcgctttatttaaattcccgcattatcactgttttatttagccatgcctatttacctttgttatgaccttattattgttattgttattattaccttgttcaccctagaataaacaaaaccccaactagtggacactctactcatggtaccactagtatgattttaggtagatgcttcgctatttaattaggtaacattaggcggttttacaactctagactttgggatattcatatcacctggacactttggaattgttggtctattgtggaattggcttcacaccgctccttctattcaaaatccccaaaaatggtttcggctgggctcggggtgcatggttttgatagtagcacctcggccatataaggaccggt

SEQ ID NO: 33742 - DNA, 1501 bp, Oryza sativa
ctcaaccctcagccaacccagtggcgacaaccgacaaaacgttgaaaaccacattgagataataccgtgacggcaggaaaacaagatctcaaagatgatgcacccaagatggttatgacgttgaagacgccaccatcatccgtgaaatgactaggctttcacccggagaatcttgttaggagggagagagcatgagctcgacaacacccaaaagggaggaaacaacgcgacacgttatcattgctggcccgaagaactccgatcaaggcttttgcctatggttcccttcccctaacctgttgttagcaaccttgtgtatccaccacccaaaaagcctatgtcaacatgcagtcctgccacgccggccttgtcagccgaacactttcacgttgccggttgtgcctgttggccctggcgaccacgtcctctcagcatcggcttcatgtgctgcgggccttcagctcgtgccgccaacgaccgcctcgctcttctagcctcccggccggtcacattaaccgttctacatgccgctaacctcctcctcgtgtgccacctgtcacggcctcgtgcgcaaccaacctcccttcgcgcttgccgcgccagccacccacatgtgtcattgcctaggacggcgtcctcgcatgtggacctccgtcgatgcttacacgctgccccgtcgccccgggcgttacgtgaccccaacttctccactccttgctgggccaccgtgcatcctccccatcaccaccgcttggtttcactcgctgagccaccagatctgaccatgtgagaactggatccaacgctaacatgcatatctgatcaccgacgaccaccactcaaaacccttcctccgatatttggtagcactcggaccgctgccaccagaaaaggaggtacggtagagagctctgggacccccgcccttcgcccgccgggctttcggtcgggtggcagtgaggcgaaaaggaggagggaagagggtggcagcccgtgccgccctagggccgaacaacacgagggctctccctagcctcaaaggaatggaacaaccaaaccctcatggcgcacatttgcacgcgcttcaccagctgaccctttagcccatatgcttgtagagtagagcgtcataaattctcacctagctagacttggtcctcccactcccactagcgtgctgactacatatatatgatcggtcaatcggtggatgaaatcaaacatgcaacatgtcttcaccgatgctcggcgatcctatatatcgatcctatagacagacatcgatccaaccggtctcgctagccatcctcagcactgtaccatggaatcgtccggtaatactccctccttctaacttttttaaatatgtttgaccgttcgttttattaaaaacttttatgaatattatttaaaaatttgagtagtagtagtatatttaacaatgaatcaaatgatagaaaaataattaattattacttaaattttttaataagacgaacat

SEQ ID NO: 33743 - DNA, 1501 bp, Oryza sativa
cgccgctacgatgttggtgaaggtggtggtgcagcggggcgacgagccgacgaggaggaaggagaggccgaaaggacgccggcgacaaagaggatggagaggccggcgcggcgacggcgttccggcgaaaccgaggagcagccggggtggagggcgacgctgcgacgtcaacggaggagacggcgacgtcggtcggcgtaccggcgacgaacagcagccggccggagacggagaggtggtggcgacgccactggacaccggcgaggacgcgtctccggtgctttccccgcgaaacggagggctgaccgagggagaggaggtggctgcgaggccgagggagaagacggcgcgaccggacggcgcacgggcgaggcgggagaggcgactggagccggccggcgcggagaaacgagaagggcgacggcggggaggcagctccgggggtctccgcgggaaacggagggcaagccggggtggaggaggtggcggcgacgctggaggaggcgacggcgcggccggccggcgcacggtcgaggcggcacaggcggctggaggcggccggcagcgtgggagagagaggagggcgacggggaggtggatagggaccacggggaggctcgggagggggctaaaacgagagaacgggggatgaggatcccattttataggatgggggagagagccggccacgggaggagcgggaacggcggcgggaaccacggccggcggcaatggagggcggccgaggaagacgcgggcgttcccggcgattgggggcgccattcaagggggaaattgggggggattgaagaggattcaatggggattaatttcccctatttaattttggaatcccaagagcgaatcacacggatttgagggagggaaggattagggttcacgggagagagagaagccgggcggcggctggaggaagaaggcgacggcggcctgacgcgtgggccccacgcggtcgggcgcgcgtcgtcagcgcgcgcacgtgcgcagcacgggcgggggcgcggatcggcctggaggggggggtgcggcttgggccgggacacggcccaggaggagaggaggggggaggaaacggcccgggagagagaggagggggaggcagtgggccgggaggggaagaggggcccaagagaaggagggagagaaggagagggagagaaagagagggaggaaagggagacttcgggctgggcttggcccaaaggaggaagagagattatttttaggtttttctttttaataaactttgataattgtttttgttgcttaataaatatttccggcgctctgaaaattcaagtaaaatttgagggctccttttagaccaaggagaatttaacaaaaattctccgggccacatttgaatttttcttgtgcgtattttagtgtttgccaatttcttttagaattttaattaattctattattccttttagaaaatgaattttatttcgggatgaatttatcaggacgtgacagt

SEQ ID NO: 33744 - DNA, 1501 bp, Oryza sativa
cattgtcaaatcatggagcaattaggcttaaaagattcgtctcacaatttacacgcaatctgtataattagttattttttcgtttattttttcacgaacgcgcaaaaggattgcacgtcaatatattagaataaaaagagttttagttacacaccacagttagaagaaaaggattgcacgttattttttcatttatatttaatactccatgcatgtgctcaaatatttgatgtgacatggtgaaaaattttgccaggggatctagacaggcccttatttaatattgtcatcaacatttaccgttcatgataagatatcatcaaacttttgtaaatgttaaataccaataactaactcacatgattatatttttttaaaaaaaatcaacggttggtttgtctccgaagagtattgggaggtgaacccatctcccatgcacggaaaacggagcagtttattagcgcgtaattaattaagtattagccttttttttcaaaaatagatcaatatgatttttttaaaacaacttttgtatagaaactttttataaaaaaaagtaccgtttagcagtttgaaaagcgtgcgcgcggaaaacgagagaatagtgttgggaacttgctcttgcaaacacacccctcacgatattacaaacttgttctaatataaaatcaattactaaaactttaaaagttaatcaagcctggtttcgaacgtcaaatagtacttcttcacggtggaagtatgtacttgcttggtttggcaggaacaaaaggacgtgacaattgcacaaaaccaacaccaaaacccacaaatccacagcgcatcataggtacgaaaatctaatctgatggatccatccgaatatctgacgcacaggcgaggctgaccgaccagcttgtttgatgaggaaatgaaacggtcgcccgactagtgaccgagctttctttcctaggtcaccgcactgcaatgcacatggtgtggagcagtgattttattgttccgaccaaccgttcgtccgttcgccattgctggtccaatccaagaaggcaaaatttgctacaagacattcaaaaaatgtgtaattagctgaagtacactataaaaacgtgtatttactgtagggcatcgtaaaaaagtggtaattggctgctggacacccatagcattattttattatttttggaggaaaaggagagagaaacaacgattaaagacaagtttgcccttggctcaaatgaccccaacgtgggccccacatggaagtcccctctccctctccctctccttcttcccagacaagccaggtggcagagcggcaatccgcggcggcggtggcggcggtgccgaccacgttcgccatcgggaggggggctacgtgcagccacgccgccgtggcctcggccgcgtcgccgcgcgctgccggctgccggcgctcatctacgtgctcgactcggcgatgagcggtgccgtcgcgctcatggcggagcgccgcgacatgagt

SEQ ID NO: 33745 - DNA, 337 bp, Oryza sativa
tcctgctactaagtttgagctttgctcaagcttggttggcgttacagtatagtcctagagactatttggcgcgcggtgattttacctacatgaggtatttttttggtgattgatgttttcatgctacaagaggaaattcgtctcaaggtggagattgttaaatatgtgatccgaattttgggcccacaatatattcggattagttttctagtaggacttcatgtctatcctattaggtgtctttctatttcccctatatataatcttgtaagccgtacgggaagaggtgacgttcccattgtgattcccctacgtttgtaatcatctcctctatagt

SEQ ID NO: 33746 - DNA, 1501 bp, Oryza sativa
caggacgtgacactgtacgatgaagaagacattactacgtcgttccgggacgagagctaagaagagagggggtggtgggggaagtcactgctagcgggtttgactgacgtggggtacctttgactagcctttgactaaggtgggaggtgggttttgggcccttagaaggagaggaggtgggttggagagagaggggtatagaatagtttttctatatatatatacatatatacacacacacacacagatatatatatatatatatatatatatatatatatatatatatacacacacacacatacatattgtcgggtcccaaaactaatgattcggaaaccgacatgtttaactgtatcaagccctggatcagtagattgatacaggttcaacaatctggatcttcattgcatacatttgagcaaggcttccaaggggattctcttacaaaaaataatagggtatttacaagattgtggctaactattacagcagaagctatagaatgactaaattctagtgttttgttatagacttaaaccatttatctaatttatacttgagaattaagttagaatgagactaacttatatgattaaactcccggcttcgataagaactccaaattgactctgaaaaagggggttgaagcaagggtgagtacaacgtactcagcaagctattatattgatcaacaataaatacatgaaatggtaatatttttgtagagctaggtttacttgcagaaagcaaagaatataaaggaagaaagcctataatgttttaaatgcaacagtgtcacgaccggaattaacccaacgggcgttccttacgtgcgtgtattattccttgtcccaggaggcaaggtacaccaagagttgatacatttcagagtttatcaagcggaagcgtaaatagttaatttattacatgggcgacgaaggcccagcacacacaaagacaaacgggaaacagcggaagactagggcgacgaccacaggcgcttgacggcaggcacgagctagacaccaaagccttcaacttccaggggctcctcttctgggtttgggaaaaattgagcaagactgagtacaaccaccgtactcaacaagacacacccacaagtgcagaataaatgcaagggagtacaagggaatcataatataaaggattagggtttgcagtaaacagcatttaaagacatttagttgctcaaagctattttgtaaacacgattctagaactatacattattatttatcaaggccgtgaacccacacgaacctgccttaacccaaggcctacgatgattcagaccgaactggcaacccgaccctgggtcccagctcgtcccaagccaacccaggccaaccgttccatgttttagttgttaagcaggttttaagactgaaaacactaacttgggtacattgctcggcttgcccataaccgagggcgcggctattcgaataggttatactctgatcagaggtgtacatct

SEQ ID NO: 33747 - DNA, 1501 bp, Oryza sativa
gaaaaagttggaaactagaccaggccaaactagctggtggtctctttgtggccttgtatatgcacgatcagttgagcatctcagtacagcggaaaacaacaaattatcgtaagattgatacgcggcgtgcatgctttgagtgcgtcctgcagcgtacattacccctttaaaaatgacgtgtgtgtccgtgtgttcgccctccttaatttgaacacgcctgggatagattagtgaagtttcattataagagcaaccacaatgttacaagaagtaaccttaaaaagcaaagcagtatttttgctttgtttttgtcttgagagataagtaaataaaagaatattgctatggccaatcttatacttaaggctagaccagaaaaaaaaaacattttatccctatgcaatatacatgttgttctctgaatcctaattgagtagggtctttttttttctcttagtgagtctcggcttatacattgtagtatgtgttatagaccaaaggatataagagtgcgaatttcatcttatatctctattgaacttaaacacgttaaggatatcctaagtgtattttgtgggctgtaaacatgtattctccctctaagtcttaaacataagctttgatatatacattggtcgatcaattgattgatccatggaatcagacaacttgtcgacgacatcgctggccaaccacagcattgtacgtacgtcaagccttgcatcacccggggtccgggcctaggactaggctttgttcttcttccaactttgccaatctctttctctttttttcgaatatgtttcacaagctactaaatagtaagtttttttaaatttttctattgaaaagttgcttttaaaaaaatattaatcaaatttctaaaaaaataaactaatacctaattaataattaattatatactaattctttgttgggttttccgtgtcgaaaccttgactcccgaactcagcccggaggtcgacaagaccagccgggcatacagtctttctccccttggtgtgtacggcgacgccggaggacgaacaaccctaccgtcccagccggcggtggtagctactccctccgtccctaaaaaaacaacctaataccgatatgacacatcttagtactacgaatctggacatatatatatatatatatatatatatttgtattattagaaaatatcatatccaactctagattcgtttttttgggacggagggagagagtaggtgacaagcttgctagtgccaacacgccatgacgcgcggcaggcaaccgtatcgtggtggtggccggccggtcggtgaggtcgatctcggtggcagcggcagcgcaggttggccggccggccgggctctccgccgatgttggggccggccgtgccggccaggccggggttcagcttgcttggcgtcttgcccgtcaaaggctcaaagctttagctagctttgaataggtccatgtactatgtagtagtacgatgcagcagaga

SEQ ID NO: 33748 - DNA, 1501 bp, Oryza sativa
taagtgtttaatgcaggcttcaaagaaaggctggtatttttgcaattgattttatttgaactcttttctgaaacaactaagtgggtgcttctcaaacgacacggttgagacagtgtgtcccgtccggtcggagtatgtgcaatgtatcagtctttaaatcttaaaacaaggttggcacccggccaacagcttttcaacggccacccgggccaacaacttttcaaacggccacccgggccaacaacttttcaaacggccacccgggcctagctgatcccgtcagctacagatttttcaaacatcaaaccccttttcacaacagcaatttcacaagcagtagtcaaacaaaactacgctaggaatcacctcacatccgcccatgaccgtgggcacggctgttcgaacagttagttaacctctgcagagggggtacactttacccacacgacattactaacccggatcacccagcccgtggggatcaaccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcatggctcccctgataagctagttactcagccaggggtgtcccattccacccatgtggtcgtacttgtcttatgttcggatgaaattccaaggaatcggtccttaagtgcgggagcgggaaaaccgtacacccggtacgttccccggtccgcggttttagaaattcatttagttcgcaagcaccgacccaggcgtcgggttttccaagtcttttgtaaaacccaagttttacccaagttgtttttcagattttaagtttgaaggcgaccgtcgatactcgcacagagtgcacgaatatcgaggcgcaactgggtggttacaaggggacatggtataacaattaacaaaggaaggatcaaattcaacaaattaggcaggtccgccaatctgccttgcagacgggacaaccgattaagtgcgatcctatcaatgcataatattttgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttggggaattttggaagttgaacggagtcaatcggatttacggttgggaagatattgaatttttaatattattggatttttggtctgaaggaaaaaggatttatttaaacccttttggaaaaagaaaaggatgagggagggaagatagacttttcctcgggcggctagggcgcggcccaagggaaa

SEQ ID NO: 33749 - DNA, 1501 bp, Oryza sativa
tattttatttggatttgatttcgaagttcattaatcgtgagtaaagaatagttaattaggaataaaccctaaaaataaattggtaaaataaatataatttaaaataaagattaggtgtggatagaaataaataaaatattatcgcgaccatatttggatcaattgaatttaaatgcgatgggataagaattaatcctaattaaaaattcaaataaattatacaaataaaatatgagtaatattaatctagggtgaattcattagttaagataacacaaatattgagtaaacttcatttatgcaagatttagaaattatagaatcaaatttatattggaaataaactaaaatcgggataaataggaaaatacactgttcattatggcgtaggtgattgacgtggtcccctaacccagccccctcctctttcccctctctctgtcgccaccgtcaccacgtgccgccgcccgtcgcgcctggccgcctcgcgccccacgcgcccgcgccacaccgcccgcctgtcgccatcgccgcctgccgccgcgccaacatcgccgagccgccccgagctcgagccaacgtcgccacccccgtgccgcgcgtgctgccgtctcgtcgccgcgtcgcctcgagcctcgcgcagccgtcccgtcgccgtcaagcccgcgccgcgccgtcccatcgtcgctgttgcgccatgccgttgtgtcgccgcccatcgcgtccctccccgagccgcgcgccaccgttgtcgccgtcgccatcgacgtcccaacgccgcgcgcgtctgtcacgcccggaatttctatccaaaattccaaacgcttacatgtgtgtgaaccctcatccaggaatcagccgaggcacacaataacaaattgataatagagtacaattattactctaattaataagcgaataaaatgtcattacagaggtagatagttcctctcaatcaataaagatctaagcagcggaaaataaaagataaacggcgcagacggctccactccacaagcagcttgaccaaggctacacctaatcctccacaccatcagcaccactgtagaactcttcctctgatgaatgattgcaaggtgagtatatgacatactcagcaagtcacgcagcaaatatgcaagtgcacaggataacaaaggatggcatagtatagggctcatttgcaaaagcagcatttagcaaacatttgagaattataaaacagttcagtgataattaaacaatattaatccaacactatacaacataccctattgcataggcccaaccattctgaacaaccatcccggctgcacagttctatccccaaaccaggaatataccattccaaaccaggagctaatcaaattattaccaattatagcattatttattatggtgagaagtgtgagactaatcacgaaagacattattaggcccgcccataaccgcgggcatggctattcgaatagttttactctgatcagaggtgtatcactgt

SEQ ID NO: 33750 - DNA, 1501 bp, Oryza sativa
aacgcgctctcgtggaagtagccgatcggctcatccatcagcgacacccaccacaccgccggcccatcatcctgcatcatccactcttatatataattaatcaatttaatttctgaatactaaaacaagttctgttgctaaaacaaaattaatggtacgtcctgcgatacggattgagaagcctcctagctatccctttcccaatatatagcatagattactcatgctagctctatgtcttcctacacaagtgttagtcatttgtgatttctatagttgattttattgaataaaatgtgtggaacatgtaatttattgttatgtttgctggttgaaaattgagatgtgatttctaaattgtgatttttgggattatatatatagacttacagtttaacaagataatatcgcatgtgtttcatatggagataagcatcaaagtatataattatttaggacattataatatgacaaataattttcttataaagaaaattttattcaaaatgcattaaggtatattgtcaaatatcgtcgtagcgttagcatggatatattaattactagtatataattaatcaatctccttttattacatatatgtatcccataatcattgcaatacatatatacgtgccgcgtaccattctcttcttcatccttaaaaatatataagtatatttctagatacttaaaaaaagtatttctaactagctagcagctgagtgatgtttatacgcaatgcaacaagaaaatattatatactccctatgtattttaatgtacgacgcgccgttgaatttttaaacaacgtttaaccatttgtcttattcaaaatttttgtacaaatataaaaatatttatgtcattcttaaagaacatttaatgataaatcaggttataataaaataaatgataaattacataattttttaaataaaatgaatgatcaaacgataataaaaagtcaatgacgtcatacattataatacgttataatacggagggagtatgttttaggacagatgacctatgcaccctgtatattacgacgtgggtgaagtaggtggttccaccaaccgtggaaaacttgtcgtatttagcaccaatggcgtgctttttgctggtctggacgaaagaacactcaaggttgaagcactttaatttcacgccaccatcgttctgcatatatatatcccatgcattaattacaccagtgagtagctatagagcactgtagactgtgctgtacataccagctgacatcaccaactttaactagcatgcaccaaattaatttgtgtcatcttcttaaagaaaaaaaagagttttaagaaaattagctagctgttttaaatctagctagtgctctatctaactatcttaccactatgcaggtaagaggagtagaggactcctactgatcctgacagttgattatccatcatgtgcaatattgaataaaagaattatgtgatccttctattaatacatcacagga

SEQ ID NO: 33751 - DNA, 1501 bp, Oryza sativa
atacactttgtggagaaggtgctctatgccgcttggagtatttggaagcaaaggaatggtttaatttttaataatgttgtaccttccattgcctcctggagagctttctttaagaatgaactctcccttttagtccataggcttaatttgtttgagagagatatacttgtaaattggattaatctgttgtaaatatcttggttttattttataaaatttaaactgtgggggcttcccctacagtgctttctttcaaaaaaaaagaaatttgttagaccatatgagaagaagtctaatgttaatttgattgattaccctgaggctagtgatagtgatggtgagggtgatcatgatatgtatgttgccgagtggtcatggactaacaaaaataagcctattgtgtgttctaatttaatgccgactcctcgtaaagatcggcaaagtgagcttaagtatagttttgatgtggccaagtgtgataagatctttgattatcttttgcatgaaaaacaaattagattacctaaaggccatgtcataccatctcaagaagaattgaagcgtcgagcttattgtaaatggcatgattctcattctcattctactaatgattgcaatgtgtttcgacgacaggttcaatcggccatagatgaaggacgattgaaatttaccgatggttccaagatgaagcttaatcattattctttttccggtgaacacaattaattttgatgataagaaggtgttgattcggctggagcaagccgaatctactaaggggaaaggagtggtcattggagaacctaggccaaagatgatggtgccaaagaatccggaggttggtgtgtggaaggagaatcggagtgaagcttcaagttctaaagctcctagtaagactaaggtgaccttcgatatgcttttggataagtatgagaagcaaagtggtgagaaggctcgcaacaaaggaaaaagaccaagatcgcctcctggggagcgatttggtcattcaccaagtgtggagattgtggataccccatacccacacggcatgtatatccgactgggaataggggtaccatattcggatagaatatctttaagggactcgggttaaattcctaacttgtttatcaaggaaatacccagggtcctagtcggttacgattgtattttatctttatttgcctattccgttaggaatatgggctatatcttgtaatacggactcctcccactatataaggaggggtccgggtgcctgttggggcataacttttctcccagatcatacgatcaataacatactcggcggatcaatcccctgacaggagtagggtattacttctcattgagagggcctgaacctgtataaaattccttgcctccaaacccatccacttttcctgcttgatagccacccctttttgtattgccgaaatcttgtttcaacagttggcgcgccaggcaggggttgcatcaagcttttcgccgatcagtgcga

SEQ ID NO: 33752 - DNA, 1501 bp, Oryza sativa
aaccaaagtgagacttaattagcacatgaaacttttttggggggtaaggccaatgatcactggaaaaattactgcctggaccaaaatgacctcagttgttcagctatatataaattcatgaattcaaccagatcgagtatatatgaagatgaggaatattagatttgagaattcatcttgtgattaacaaattaaacatatttatactatgatatatagctaatgcatggatatctgccaagtagtaaccttaccaatcctaaataaagaagattaacataatgtagaaattcttacctctatggtcttgataatgtcattgggatcgatatgtacaccatgaacagtagttgtcgttgaagccaacaatatgcttgctgcaaagaatgcaagaagagacctcattctctaggagtcgatcttcaggacagtcgaggatcataccgttagcaaacaagataatatggaggctttatatagaggtgtttgtggtgcatcgataagataattatgtattaatccattgctatcatttttacattactacacggaaataaggaaaggaggaataatgcttccttgtattctgtaaaattcatgattgattaattaataccataagtaagtctgctggtaaaattcaaatttcgaatgcaagtgtactaaccatattttggtggagtgtcacgccccgaactagtaccgaccggaactagcccgtgacgctccaatttaacctgttaatcgataccagtcccaggacacagtgctggtatcacaggaagacagattatcacagcaacagaggtctctttattatagagtagatgtacagtcatgttgggctgcggacagatcccgagctcacaactgcattacaaaaggaaaacggaagccgggacttggaccaaacaacacaggcgcgacttgggaaccaggccgaaaccctaaaactcatcgtagccggcttgctcctggaagaactcatcagcaggatccgcttcgtcttcttcagtgactgggggggattatttatatagagcaagggtgagtatggggagtactcagcaagccaagggaaataagtgtttaatgcaggcttcaaggaaaggccgttgtttttgcaattgattttagttgaactcttttctgaaaacaactaagtgagtgcttctcaaacgacacggttgagacagtgcgtctcgtccggtcggagtatgtgcaatgtatcagcctttagacttgattcaaggttggcacccggccaacagcttttcaaacggccacccgggcctacaactttcaaacggccacccgggcctagctgatcccatcagctgcagatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggggtacactttacccaca

SEQ ID NO: 33753 - DNA, 153 bp, Oryza sativa
gaggtgataagaaattagtgggggagcgtcagaaaaagagtttgggggcggcggaatagaatagggaaggttgagtatagaataaggaaggaaacatcaaagagcaaaagcgacttagatgttaatgaggcgagagatctataacggtcgaca

SEQ ID NO: 33754 - DNA, 1501 bp, Oryza sativa
taagagaaactactcagttttctgatcatgttttaaaagaaaaactaagttttacagtttattcaaagtttatctgaatttcattggtttttacgggtttactaattgttttcagggttgttcagattgatgatatttcaaaccataccaatttttgataaagttactaaagatgtgcatctattttttttcaccaaaatttgttaaatacataagaaatcctggcaaaaattagcagtattgccaaattgataaaattttggtattgtcaaaattttggtaagatttattttggttacaatctaaacaaccccttcgttaaaaccggagataccgcttgtgcggttatcggtccggtaatgggattgtgaacctattcagaagtcgagtctccttttgtatgcggcttttcatatttgatccttcaggaaatgaagtggcacagtacatacaaaaaacatgtaaattttctccaaaattcatatgttccgaagatcattggtacaccaacaattgttacacgtactactcaaagtggcctgctagctagctaggcctctatatgcgtatagtagtaagactatacaaagtgcatgcctcttttcaccaggtgaatccatcaaataaatgtactgcttcatcccgtgatgctatagcccggtgaatattccttcactgtatatgaatacctaacagcttccatttactaaaaagttgaaacctaacagctgagttaaaaggaagatggagatgtacttcacagtgcagtggtaagaagtgtgtgctttcaatccaagattccgtatgtaatctctaacatgctcataattttttttaaaaaaaaatatttggagggacgcccctctttccaaatatccttttttttaagttgaaaagaggatagatattttagcagtcctaattgcggcggctagcagctgcaaatgttaacaaggcgaaccacaactaaaacacacacaagtacacaacatcaggtcaatgcatgcaatgaagaaagctgaaagctgctaggagaagaaaaaataaacatctgctgcgaagaaaagaatataaagtttgtggcactaatactcaattatattattatatataccaaattaaagcacgccccctgcaagtggtgataagagaatgtcagcaactgatcaaacgcaattagaaaaccaaactgatcaacaagcgagtaaaaagtggctaaagttcgttgcagagtatatcgtaacgtgcctactttgctttgcattagccagctcgaaaacaacatctcctaaagccactttattaccgctaaaacgccggtgcgaaattaccaccgggatgatacggcaaattaatttcagttcccacacatggcacgcatggcagatcgaaatcaaatcaaatttataatcgacaagaccatgtcttggtcaggattcaggaaacaatatgcatcatacggatgcgtaaagtataaatatactatgtacacatgtgagtt

SEQ ID NO: 33755 - DNA, 204 bp, Oryza sativa
atctatttctttttattcgatttcttcggtctacgttgtattgcactgaacaatgcttttttttatattcatcttgcgcacttattcttagcatatcaaattctgagacatcattcatcatgctgaaatcatacaagtattatgttcagactatttaatgacttctgcttttgctactgccagaatttctccaagagttcacca

SEQ ID NO: 33756 - DNA, 204 bp, Oryza sativa
agccatcaagctcagctacttgatcgatctcctttaaaacggtagctgagagccttcctaacctgcttcccttcatcaattctgatagctcctctgccactcaagtacaattattcccattaattcgctccattgctgcacaattaaagttagcagaagctgctaggagaaatggagaggccgggtgatgaacatgatgactgc

SEQ ID NO: 33757 - DNA, 1501 bp, Oryza sativa
gcttgtcaacttgtcaaaaaagttgcgaacacgattttttgcgactccactggggaagagatccgttcatcatcaactcgacttcgactttgccatgacgaagccgccatccaagacggaggtggagccatccaatgtgataccggtcacattggatgacttcgaaggaaaagatcgtcaagctatggaggagtacatcaacgagctcacacgtgaggcgttgatgagagcaagtactaggactcgtcaaggcgtgatcatcaagcccgggccacgtcccaagctcactcctgacgtggtaagcaatgatgaggtatcacaatctatccaacaacaaattgcatctacaatagattcatctatggttgcttttaaagatcggttagatgtaatgtttaagggtaaatttgatgagtttttaaggatgaagttcgattctcttatggacgattacacattaaaggataaagcctctaccactgctaaccaacctcctatagatcaaacgggtagtaaaaccgacggaacggcgttcacggccggtcagaccgggtattaccccggtggtcagaccgggtctcaagctggtccgaccgcacatcttgacactggtcagaccgggccctgggccggtcagaccggcgcaattgttccaatacagggaatagatccgatgactaatgctagttatttatatcactttagaacatttaatcctcctgtatctattgctacaagtagtccccaagttcccccacatgttcctaatgcttataatgatgtttctagggggtatcctcccgatactagacaaggccaatataatcatattgcgccacaaacacaacctattaggccaccaaatccaccaccaaatcaacatgggcctaataatatggaggatataattagtgatattattaagaatagattcgggattgaaactaggaatcgtgctagaacttacaaaaagccatatcctgattattatgataatgtgccgtttcctcgcaattatagagttcccgaatttgccaagtttagtggtgaggatggtaagaccacatgggagcatgtaggtcaatttttggcgcaatgtggtgaggctaatagtgatacttttaaattgcgcttgttttctctatctttatccggtaatgctttcacatggtttacttctttaccggcaaattctattcatacttgggttcaattagaagaacaatttcatgattatttctatactggagaaactgagcttaggttatgtgatttgacatcggttaagcaaaagtataatgaatttgtcattgattatattaagagatttagagatgttagaaaccgatgttatactttgaatatagctgatagagatttggctggtcttgcttttaatggtttagttgctcctcttagagaaagactagatggccaacaatttcttgatgttagtcaactcatgcaaagggctctggctcaagaaagccgggttaaggat

SEQ ID NO: 33758 - DNA, 190 bp, Oryza sativa
ggtcacacaccgcgaccggtcacggaccggataagcgtgcgctgcgccgcattaaatgcggcctggcgcgctcgtccaacccgctataaatgcggttaggtgagtcccgctgtgctcacctaacccacacacgtggtgccaaaaccacagggggtcggggcgccccagccctcggggccgaaacgggagc

SEQ ID NO: 33759 - DNA, 1501 bp, Oryza sativa
ggctcctaactgaagagaaggaggaggtgatgggaggaagaagaagaggaggagagagaaagaaaagaaaggctgacaggtgggccccactacagtactatttcacattttctagatttaattcaaattccaatttttagaagcccatatctcctaaaccgtagatccgattccaatgaaacttggacctaaatttatataaattcaaatcctaccttttggcactaaatttgctattgtaatatttatttgaattttcttaatttattcaaatgccgtttgaatttatgtttgccttttcaaatatttctttttaacccaaaataccctttagccactaaaaagccgccggttggaactttacgcctttcatgggaacgttcgtgcggtctaccgaccccgacgtcggaccgtcggttgtaaagcccggcaaaaccaaacctaaggtcgaagtgctgctcctggcaccccacgcctcgatgcgtatagtggtcggagcttcactattccatcgacctccatagcacaccgcacagttagctctcgggctctgtgtgatcctagccgttccgtggccactcacggttatcggagtaacacttccaccccgctaaagcttcacaatcttcttatccctctagccattgtattgtctatcaatatcggctagacacctaacctagtcgtcatactatccaattctaatgacgactagcaaacacccaaatcccagtcgatattcatcctacctcgatatcggcttaatcaaatgaaaccccagccagcctgctatccaaaatccataccagccatttactctccaactacctagaacctacacataaaatatagagcctggccgatatattgccctactcctcaatcagcctaaatataaccaaaccctaggtataatcctaccttaaatcctagtcattcttctacctgtggtatttcgaggatcggataatcaggttgcctatctcggatttatttgtgttggagcaaggcaagttattattcctcccctttgatcataataatcctatattctatatctccagtatcttgtgcattagccatacataatttttaatgcataacctgaatatatagcaaaccagatatatgctagattttgcttagccatgcctagttagacggcataaaatataatgaacttagattggaacagtacggaagaaatggttgatttccgggtggctagtactgttccaaccgacataagactgccaagtacatgtgaagaacatacgagtacgaccgcaattctcgtatgggcatagacctagctgactacgttatctagcaaaggtggtacttctgtatagtggttcttcttaagtcctcgcgtaggaggcaaatttatgccgcgaagggcaattatgatatttaccgaggcgcaggtaaatatacttatattgatagtccaggggactatattatggccatgtgattttattaaccctgattgcgatga

SEQ ID NO: 33760 - DNA, 834 bp, Oryza sativa
ggtcacacaccgcgaccggtcacggaccggataagcgtgcgctgcgccgcattaaatgcggcctggcgcgctcgtccaacccgctataaatgcggttaggtgagtcccgctgtgctcacctaacccacacacgtggtgccaaaaccacagggggtcggggcgccccagccctcggggccgaaacgggagcgcctgagccctcggggccgacacgggagcggcccaacccctcggggagacagagggaggggtggccacgtcaccctcgggcccgatcccccccccccccgagagggtcaggccacgtgggtgaccgcggctacccaagcctctagtcacgatacccccggccccatgtcaccgacacgtacgaaaccatataaaatttatcaaaatttcaaatttcgaatttaaaagactaccatggtttttcttttaccgtaccccgtggtaagcacgattatcggcgattttgggaaccttggatgttacatatcctaatacaaagaatttgtatacattccgttcgaggtttagtttgttttgggacgaataatagagtatgtctaaattcatagttagaagtaatctttttttttatggatgaagtatataggtcagtgtcacgcccagaaattcccggatagaatttcaagcagaatgtgcattaaaatccccgtccaggaccggccggggtacacaaacgacaatgttgacattcagatccacgtcttacaaacatcataaaagtcttacataaatgcagcggaagaaaagaaagacaacaagagctaagccttgactaaaactgaagcgggaacaccactccacagg

SEQ ID NO: 33761 - DNA, 1501 bp, Oryza sativa
ccatttttgtgctttgtttctgctgattatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgtgattgttattattaccttgttcaccctagaataaacaaaaccccaactagtggacactctactcattgtaccactagtatgattttaggtagatgcttcgctgtttaattaggtaacattaggtggttttacaactctagactttgggaatattctcatcacctggacacattggaattgttggattattgtggaattggattcacacctctccctctattcaaaatccccaaaatggttttaggctgggctcggggtgcatggttttgatagtagcacctcggccatataaggaccggtcttcgggcctctgttgcaaatcactaccgtacttccacatgtctaatgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacactgtcacgtcctgataaattcatcccgaaataaaattcattttctaaaaggaataatagaattaattaaaattctaaaagaaattggcaaacactaaaatacgcacaagaaaaattcaaatgtggcccggagaatttttgttaaattctccttggtctaaaaggagccctcaaattttacttgaattttcagagcgccggaaatatttattaagcaacaaaaacaattatcaaagtttattaaaaagaaaaacctaaaaataatctctcttcctcctttgggccaagcccagcccgaagtctccctttcctccctctctttctctccctctccttctctccctccttctcttgggcccctcttcccctcccggcccactgcctccccctcctctctctcccgggccgtttcctcccccctcctctcctcctgggccgtgtcccggcccaagccgcacccccccctccaggccgatccgcgcccccgcccgtgctgcgcacgtgcgcgcgctgacgacgcgcgcccgaccgcgtggggcccacgcgtcaggccgccgtcgccttcttcctccagccgccgcccggcttctctctctcccgtgaaccctaatccttccctccctcaaatccgtgtgattcgctcttgggattccaaaattaaataggggaaattaatccccattgaatcctcttcaatcccccccaatttcccccttgaa

SEQ ID NO: 33762 - DNA, 1501 bp, Oryza sativa
ctttctttttcagttacagagataataagaggtatacacataattgtgaatgtgtctctttaaatacacgttcaaataaatgaagactattaatatatctcattgttaacgaccaaatttggtaatatcggcatcggaaaggaagattagatcgaagcggaatcagagataaggattatcgcggaaacagagtaaaaatcggctggagtccggatcagctacgattggatcggctaagttcgagtcagacttggtttggtgatgcagccgattccgacaatacgacttggtgtacgatattgggttgggtcgatatgcttcaagatgattgccacgcgtggatagagtcctgagaaggcaactgtatctattaattagtatattttatgtaatttccttagagatatgtttgggcaaaagtctgccgcaaagacttatggtatcttagagtttgttagagataagagtcatgtccgatatggacatagtttgtaattctcgggtataaatagaccccgaaccctatgtaatcaattaacacacacgtttaatacaatcttggtgcatcgccacccttttttgctttcgttttatttcgacaagttattgctttcgggttgagctgcatcggtttcgatcttcaacaagaggtaaaacttgttatggcggcttgcgttctcgggattagtgcttccatctctatgatactctaatcttgtttatgtaatccgtcgagttatcatatatcttatataatatatagcaatatcatcatctaacctacaatcagctaacatctactagtagaggtcagccgattaggttaaatatcgatgttggtttagattgtacatgatatctaccactctatgaaaattccaatggcttgattgtctagatattgtccttcttttcatacttatagctgcatcagttgtttgatcttatgagtcgtgattagaatctcaacctctagcttgcttcttggttgccgattagggtagtatcggggttttagccgatcttagctgatttaactatacttgttatatatgctttactgacatgttaaatctgccctttatattaagattttgtggcatttaagtgtattaagcttttgtttgatatattctgcttgctttaatatcttaatatagagtagtatcggagtattagcccatacatgctagatctatctgatcgactatgctatgaacatatatagtcccattattaatatatatttcgatctaagtgatttatattgtctcggcatggcgactgatctatcccaatcacttgatttaagtatatatcgatataaggagtatatattgttaatatctacagccgatcaaatagatttagttccttcttatttactcatggctgccgatcgatacatatatgacaccggctcaaagataaatgatatgtcatcggcacctagccaatcggctatcatttatagatttaaccgcggtttctttgcctttat

SEQ ID NO: 33763 - DNA, 1501 bp, Oryza sativa
gatatatactcaatttcaatcatggtgccgggcaccatggagtcccatatgggtaccctatatatatatatatatatatatatatatatatatatatatatatatatatatatataaatatatggattgtggttcatatgcacctcaatccgcttgttgacacgtgtacacatggctccggtgcaaccgtgtgttggaaactttttgtgacaagttgacaagcacaatcgcagcacataaacaccttgcggtgatcctagagtcgccaaccacctcgatctagcaaaagctaaactaagattggtttttataactaaaccggctagcggagcctattatagataactacccgtctcgtgggcaaaacggaaggttttcaggacaaacctaaaaagaggtgtcacactctcgcagtggcggcggacgatttacggcgcaaatcgacaaagatggacaaactaagagaaaactaaaagcaatatgaaaaatgattcgattgattgattgtagattggttgttacaataaaccggccttacccccttatataggggttggtcttgccctctacagaccctcctccacgtccaactcgggatagaatccaaaaaaaacccaaaacatgccttcccgagcaagtaaactttgagacccggcgaaactgacccggactcggactctgccggtcagaccggccacacaccgccggtttgacaggccctcaccaggcggtctgaccggccaacacacggcggtcagaccggcctaatcagaggaaaccggcagacttccaaactttggcgatataaatcttcatgcacttctcccatagccactttagattgatcattatctaaacacttcaatagaactccatctatattttggcgatataaatcttcatcaagcaatgtatatttgaatgcttgccgccgaattttccgatcaaccttaagtttaggatctttcaaatatctaatcaaaggaattctccaatccacttctgtttcctgggcacaaatgtccgaatttacaattaattcggtctttgaatcaattgcggcgtgccaccagcgctctgtccagagccggtcagacccgccgtgcaaggccagtcagaccacccggggtggccggtcagaccagcggtatgtggccggtcagaccgcccctggtcaccgatcagactggccgtgcaacgccggtcagaccgcccctggtcagaccgcttagcaagtgtgagttctggttgtccgaagtcaaattcttagggcacgtgatatctgctaaaggagttgctgtggaccccgaaacagtgaccgccgtcactgattggaagcaacccaagacagttactcaggttcgcagctttttgggtttggcaggatactaccggaggttcatcgagaacttctccaaaatcgctcgacccatgacacagttgttgaagaaagaagaaaaatttgtgtggagcccgcaatgcgagaaggcgttccaaactc

SEQ ID NO: 33764 - DNA, 1501 bp, Oryza sativa
tatctaaggggtctaatccctttgttaagcattctttatatgtcaattttctggatgacccttcttcctttatatttgtataatgtgggggctctggatttttcttgtttctagcctcttgcacttttgaatatattcctttgccgctggctctagataataatttattcccaatattttcctagcttgtcctaatggttcttcaatgtctttatatttcttccatgatattcctactgttagctttgcgtctattttttgagatattatctcttcaaaggatatatagacgcctggtactcttccttcaaaaaccacataaatgggcttttgctgtatggcttcaatattttttgcaactggcattaattcatttatcaaatgaaaatattcagcaagactatttaatattgataggatatagcccttcatattattatattgataccaaaaattgtccagaatacattcttgcacttcatatatgattatatggtcctttggtttaaatttataagagtttggtgggaatattctgagtttattatcttccccaaaagtgaagaattcaactccattataattcatagatttcttcatacctgcaaaataggtaaacgagaaagtagatcaggcaaattgttatctttccccttaatatgctcaaatacaactttatagtcatttccagtaatgatttgttcaaataagatccacctcctagtagaattcttcttgctattaagctgattataatatctacgtatcacctcacagtccgttctaaccgtaaactctttaaaccctagatataacctaaaagcatttatcgcgttgattatttctaggatttctcgatctgtattgtcttccagaggcatacctatatatcttttcctctgatttagatgagtatttagcaggtctttgttttaatacaggaaccaaccctgctgcgatgcatctgtttcaataataaaatagttttcttctaaaggtaattctagaggttttagttctttcaccttttcttttattaaccttactaatttaatgtctttagaattaaaatatctctgaccattttttcttaatatagcatataatggtcctgctaactttgctaaattttgaatgtggtttctagcataatttacaattcctaagaattgttgtaattcctttttatcattcatagcatcaggaaattgtaaaaatttcttagcaatatgttcttgtaggtgtattttgccttctcctatttcatgaccaaggaaactgattttctcctggcatatttccattttctttttggataagattaacccattttgttccacctttctaaaaaaatatttctagatgagcaatatgctatttgtaagtttttgaaaagactaataagtcatctatgtagactaatataaattcttggttgtcattaaatatattttgcatttttctttggaatatggcaggtgcattttttaggcctagtggc

SEQ ID NO: 33765 - DNA, 384 bp, Oryza sativa
agaaacatgctactttgtcgttgattcattggaccttacaaattaaacaatttgttcttgtctgaatgtgctgatatataattggtcttgtactatgcaaaggactagttggtgggctagctagcatttgcatcttcaaagtttcaatccttatccattttgaaaggattagataaactttacagttgaggtcggaatatacctttgcctgctcaagattcctttcgagtagattgagatggctctgatcatcggcgccaaacgagtgccctgcagctaggagtagcttgcataacaccacttgtacatatagtacgctgatcaattgtactttcaaacaacaatactgactaaattcttgctcaatttgtcaaatacttcagg

SEQ ID NO: 33766 - DNA, 268 bp, Oryza sativa
atgatagataacaaaacttgttattgatccaacatgcattcttaaatcaggagcttttagcgttgttgttcttgttactgagagtagtttttaacgaggttgcttcttgctagtcaaaagtgactaatgttacttatgttactgttctctacattgtgcaggatccagagttcacatattgaggtactctcctttgtcctttccttcaccacaacattttacaccccttttacaaattcaccgttccattcatgcccctgcttttagt

SEQ ID NO: 33767 - DNA, 1501 bp, Oryza sativa
ccgtggaccgctgccgtgcgcccggtctaccgcaaaccctagccgctgacgcaataaatctctttttccttttcaaaaataattcattattgcgtcataattcaattaaaatctatataagtgttttaatccgattaaatcttcaaaaattcataactaattcatcttagctcggatttagttggttcaagtctctaaatttttttaaaattgagatctacatgttaaaaatatccacatgtactgttcatgcttgtttatgtgctgttttggtgtttttgctcttttctgtttagattccgacgtttccggagagtccgttttcgcaggagaagattttgaagagttccaaggccagcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggtgattataattggactagttgagctttatatatattggttcaactagatattagatataattgcttagccatgcttagaaacattagcacactattgggataacttatgactcactattatttaatgatggcttaatggtagttcacgatggtcaatcgtgatttgttaattaattacttgccaactaaaattttataatggtgggttgtgagcacatggttttgatggtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatctaggaaaggtgcgctgtagtggattgtgttgtgcgaggggtattgccacagctcctttccgaggtaccgtggtggtattgaggcacatggtgacatgatgtggggctgtgtcttgtgggtacagtgatacacctctgatcagagtaaaactattcgaatagccatgcccgcggttatgggcgggcctaataatgtctttcgtgattagtctcacacttctcaccataataaataatgctataattggtaataatttgattagctcctggtttggaatggtatattcctggtttggggatagaactgtgcagccgggatggttgttcagaatggttgggcctatgcaatagggtatgttgtatagtgttggattaatattgtttaattatcactgaactgttttataattctcaaatgtttgctaaatgctgcttttgcaaatgagccctatactatgccatcctttgttatcctgtgcacttgcatatttgctgcgtgacttgctgagtatgtcatatactcaccttgcaatcattcatca

SEQ ID NO: 33768 - DNA, 1501 bp, Oryza sativa
acactgcatcacctagcataacacgaacaatgtcatgacttaaataagttgggcccaattcctttatagggatgaaactgacctaatgacaaaaacatttgaggacataaatgaataaaattaatattagaaagcagtaaagttaattttaatagatttctaaagaaaatgttggtgatttgtttttcaaaagttacatcttgcctcttcgaaattctggatgaaaacaagataatgctaacatggtcggaaaaagggaaaagaaagcaggtatgatcagaatattctgtagcattttcaccactatctgtgagagtccataatctgtaagttgaatagaccattaagagtatattttaaaagtatgcggttatttaagttaaaatcgtcattttctgtaattttagctatacattttaaaggatgcaaccagaacaagcaaatttattagaaagctatatattttttactaacaaaaactacaatttttaactccctgttgtagcataaccgtgcgttgcatgttgatttgatcatatgaagattaaatttttctctttgcccctatgactggaaatgggttggtagtaggacttttctgaaaaacaaagcacgaggtcattttgtgaatttcttttttctgattttcttgggtgggggcttgcgttgcgggcacaaggaggcaagtaggattagataatctagtaagtacatgtctgacacatgggcccaaactataatgatatgtcttctctgttttaaaattaaatacataacctaaaataacgaatttgaataacgaaaaaaggtccgaaggactcgtaatatagaacaagggagtaaaggaactgtcgccgttacgtatttctcaaatttcaactcctgaagattcatggatgcgatcgtgtatacgtacgaacgttgctgaggatttttacagtggtgtagaattcctttaccagtctgacatcacggtcctttacttttcagagtataatatttgtgtctgctaattatggctgacgatgcacgtcatcgtacgacaactaattataatagtcagcttgcacgcttgattcttaatgttgacctgaaatcactaacttcagaagtgccatgtttattagccctccatcattatcggtcatcatgcagacttttccgcggctcgcaggatagtcagcagagcagagtgaattaattaactgaagtgtcaagactaattaatcaagctgtcaagaacagtgcatgtccacatatgccagctgaatcaattgctactagtatgaaatatgtgtaaggttttccattatcttaagagagaaaaatgtacaatcatgctgtcaacaatgtgcttgcatgcatgcatgctattttgcactgatggcacctccctttttcttcttttttttttctgatcactgagatgtgagacagatttttcctttaacttctttagtagaatgcttttttattaattaattacaccttgagctgtaat

SEQ ID NO: 33769 - DNA, 1501 bp, Oryza sativa
tcggcaatacaaaaagggggtggctatcaagcaggaaaagtggatgggtttggaggcaatgaattttatacaggttcatgtcctctcaatgagaagtaataccctactcctatccgggtattgatccgccgagtgtgttattgatcgtatgatctgggagaaaagttatgccccaaaaggcacccggacccttccttatattgtgggaggagtctgtattacaagatacagcccatattcctaacggaataggcaaataaagataaaatacaatcgtaaccgactaggaccccgggtatttcctcgatacacaagttaggaatttaacccaagtcccttaaagatattttatccgcatatggtatccctattcccagtcagatacacaagccgtgtgggtatggggtatccataatctccacagtagcccctgagacctttacagtcgacgaaataatcttctctttgagtcttcaacatgatgatcccgagtgcttcaattattcctgccttggtgtcccgagtgcttgaatcaaagactgtgaagggctaaaaaataaaaagttaggtgcatcgactagatgcacctaattagatgtagctcccgactatgtgattagttgaataaaactaaacatatagtcaaggtacattaaaacatccatccgagtggttttatgaataaattaccgaagtaatcatatagctaagcatatgcgacctttaattaaacattaagcctactgctttagcttgattattatacccaaaaggtatataaaggtccaagtaaaaacactctaaagatctgtcaatcaatatatgcgataaaaaattcgagtaaaaactcttaaaggatttataaaatgtcgcataaatgataaatgacaagtctagatagtctaatctatgacttatgccattatcgaattaagcatataacaagccaagagaatgacaattttaaattggtcatctcaatataatccgaacagctttgcagcctaaaaagggcagcaaaattagtatgacacttttctgctgggcacctttttatttgcattgtagcaattccaaagaattatctaactgcttcaaaaagtattttaacggtatttggctattttgttgtgagcattatttgccaaagcaaaaaatatgcctaagtccctaaggatcacaaacaaccacaccgaaagtgaagttgggctgaaaatactgttaaggcccaggccgataagtatttcccgataccctagcgaaataatcgcaaaaatataacgccgcttcgtcttcctcattgcgatctccttcgttttccccatttttcgctacagtgccaaagctgcgccagcgaaagctagggttcgcaaacacacaccaatccacctcttccgaagcttcatgcctctgcgaaaaatcctccgcacaaccacttcatcaatctcccctccaatctccgccacccttgctcccaatttcatcatccatctcgcatcca

SEQ ID NO: 33770 - DNA, 189 bp, Oryza sativa
tgtcatggccatctcggttgctaagacaaaaccttgtgcaaggaatcaaataagagagaaacacccaatagtcatcagattcaaaatcgaggccaggagatgctgggtggaggtggatgggttggatttccttaagacagtagggtctggatttcctagagaatgctattggctctggtgctggcagca

SEQ ID NO: 33771 - DNA, 1501 bp, Oryza sativa
agcgcccgtgattagaagaagacatatgactctctgaaaaacccgtgatgctacagtgtgataaaaaatatgagtgaagattgagctccctcttcggcttctataaaaggggaagctagcgaagccagaaggataccaagaagcagcaaccctcagccagagtctcatgagccactctctaagctttagtggtagaaatctgttaagagttcacattgatagtatattgaagcaaggagtgtaatataaattgtgtaaggtaagcaacccttgtgtgtacaatccctcggggttccctaaagggaaaaccatatgtattctattttgtggtaatgtagtagttttattaagctttccttgctcgaccttgttatgtttatgttagtttaaattctacgctaatgaccctataggagagatgcccttcagtaagttctcatagttcaccttgcatgcagcaggtaaagagaaccttttatctgttgaagaagtgttcccttcgggtggaactgcctggggagacggtagaatttttatctcacatgaatagacccaaggacgggattagggtaaaagcttaagctactccttcagcaaaatagttagacatatggtgagtaccgagtaggattacacatctatcgttgcacgctcggctgtcccagtggtttcgccaacccattaagatcttgaaaatttaaaaaatatatacataaatatccatggagaaatatacattaaggtaaatgcagtccactatatggattcttctgccatctttacttgccaaaatcctacttttaagtcagatttcgagaaatatcccttggatattcaactgtaagtaccgagtggactgcatagatgcaggataatactagtatgatcatccaaactagcatgaatgcagaagacaacaagtcacaatatgctgaaggtaaaaatccaacttctcgggaataaacagagcgcccgtgatcagaagaagacatttaactctctgaagaacccgtgatgccacaatataaatgtaattattttcactaagctataccgaagatcatagttggcactctaataatagtcaattaaatttaattgttgatttgatatataacttctatataaattggggaaaaagaaaagacgatttggagcaaaaggttgaagagttatataaagaacgaaaacaaatagtagagcaatattctgtttttagtactaagctaaatactgctttaaaattactacaagaatataaggcaaagcaaaataaaatttcacaaaacagtgattacatcaaggaaccaaaccatggctctgataccagcttatttctccacggataattttgctgccatgttccaaagaaaaatgcaaaatatatttaatggaacaaaatgggttaatgcataacgtataaaaaattcaattatatgtaaaatcaacataataaatcctaactacataattaaaacacgtccaatagaggcgaccccaa

SEQ ID NO: 33772 - DNA, 330 bp, Oryza sativa
aggggcatgggtttggaggggaggattatataataatggaatggaattggcaagtgcaaagtacacgaggaggaaggggtagtaatactccagtatagtataggagtataggagcagtggtggatcagaaaattggtttgttggtgtcataacgtgtttataggtgtcataatatgctaattatgcttagaacatgatgttatagtatatagataaacaattttgctataggttttaccgaaagttaaacaccgatgattatagtgttgatccgcacctaaataggagtatagtatagtatagtccccacgtctgtgtaatgattgcgta

SEQ ID NO: 33773 - DNA, 1501 bp, Oryza sativa
gtcaatgttatattggttggtgaccatgggatggttgggacttgcgacaagaagctggtgtttctcgacgaattggctccatggattaagttggaggaagattgggttttatcaatgaccccgttgctggccatcaggccgccagatgacatgtcgctgccagatgttgtggccaagatgaatgaagggcttgggtctgggaaggtggagaatggtgaatatctaagaatgtacttaaaggaggatttgccttctcgacttcactacgcagatagttatagaatcccaccgataattgggttgccagaggaagggtataaagtggagatgaagcgatcggacaaaaatgaatgtggaggagcacatggttatgacaatgccttcttctcaatgagaaccatatttatcgcgcatggtcctcgttttgaaggtggtagagtcgtgccatcctttgagaacgtggagatatacaacgttattgcttccattctcaatttggagccagctccaaacaatggttcatcttcttttcctgacacaattcttttgccgagtgaatgatcacatatacatgtgactgctgtggttttggatgagaaaggtcttgctgttggtatcctcctttagtcgtaattgcacttgtacacttatcatattagattcgtgtcactagtggctattcactgcctgaatgcaaatgctgctagtagagagtatctttgtccttatggacaacatttgctgttgttatcatgtcttatccttagcggttttcttatgcttaaattttcatgcaagttcaattaagctcgcattctctgcttaaaatgatgtccatcctgttgataagagattaaccagtcctagttctatatttaatttcagccaaccttttacccactgataataatttgatttatgtatctcctgttaccctgaattattcatagtcactgttagtttcttctgatcttctggtgatctaggtgtactcattccaacatatggaactgttgggaatcataatagacgaagtggtgtttttactttcctggaggatcttttcatggctttatcaataaattgtgtagcaacgtaacaatatgcacatgagcattaacaggcctttatttctctggtattagtattacatctgttatcagttctttgttgctttgttcttccttgttattcacttctgtcaccactttgctccttgccagtaaatcaaagcagttgctatattatgtttgagtattttggaaaaggccaacaattaaacatagatttcactcttccttttttttttggtatgagcaaataggatatctgattgggaagactatttcgttggcccctttttaactcttgaatcagaaaaaaaaaatcaggtctatgaatattccgttccattcccagaagaaaaatatgatgataccaacttcttaaaagcatagtttagagtttggagggctgcaaattgcatagtgtaaatatgtcg

SEQ ID NO: 33774 - DNA, 1501 bp, Oryza sativa
ctcatcgccctcacggacgccggtgacgggagagagagggagagagagaggccagcagcggtagcggcgagggagagggagagaggtgagagtctgcggtgagagggagaggacaatgacctggagacgatgccgacgacgacctgcgtgacctcctccgccggtgccgcgacctcctcctcgatgcggcgtggccggcgtcgctccattcgatctagccgcgagggggccagatccgcacacgacggcgccaaatatgctgcctccgaccgccggcggtgacggaaccgaggtcggcaacggcggcggggcgaggctagcgcgaggcggggaggacaatgacggccaccgcaacccgcgcgccactcttcgtcggcggcggcgacgggcggcggcgagagagaggtggcgaaagggagagagaggatgagggagagagccgcgacgcgtgagagagggagagagaagggagcagcggcggcggatgggcgggaggcggcggtgacgggagagtgcgggaggaggcgatgagcgatggtgagagagagggagggagaaagcgtcggaggaggtgccgaggaggggtagttgaggaaatttaataccgtgactttcgtagggatacccactgtgagctagagtatcttcatccagttttttcggattttgaggaacccatctagttgtggcctttattgagagacgagtgtccatatgagtgtcttcagtcagagaggacaccctgtgtcttccattgtacatgccctgaaggaactacaatgcaaattttctaaagttggcggggcggtgaccaatgttagcctctactccatgaaggagggcagggtagggtgggtttcgtgtcccttgtctttcatcgctgcacaaagaggagggcaaagttgtttgtcaaacttgatggccttcttcatccaactcttgttggagaaaagaacgggaactatatttcaactattgcataaaaaaaatctagtacggaatgtgatacagtctagacatggttctttttatgtgacgaagaaagtacattgaccaggttgccaccgttgcagatagagtaaagcatcgtgctagtgcatacacgcgcaagattataactattcacttcggtggttcatcatcgcgtgcatcgtgatgtcttaaaaaaaggggtaaggctagtgcaaacataagggttatcatacttttaacttgttatcacatagatgaaccatcctcacacacacaagattataactatggcaaaattggttatatagcatcgaacttcggtgagaggatttttcccctccatttttaaaaatttgtcgctgagagtttatatctcaagtttggccaatactattttaattgtgagtttgcatatacttagtagttatgcattacatcctaaataaaaccatatagtttttatttggaaaaaagtacgaattacccccctagctatcgcggtcgtctgaattacccccctgaaccacaa

SEQ ID NO: 33775 - DNA, 1501 bp, Oryza sativa
cgccattctgggcctcccgttcacctctatcgtcgcctccgtcgcccgtccatctccctcgccgcgttcatcgcctccagcgccctcgcggccctctgccccatccaccttctctacctccagcgacctgtggcggctgcggcgtacgtgctcggcgcctcggcaagggcggcggatccacgatgtgctgcttgtatggcagtccggcggaggagaggctgatgatgcaacgtcgccctcatcttgatgttgccgttgattgttcatcccatctcttcggctgctactggttcgagaacaggtaacgtcctgtcccattttctcccatcacttcctgataaatgatacagtaatgttgtaggatcactattagatcctccaaaagtagcagcctgacgcgagcaaaattcagttttaacaccaagtagtacttcataagcacaacctgctagatttctactgaggttgttgtcccaactatacaaatttgaaatgtgtctgacaaatgttatcaaatcaccacatagataattcttctgtgaccattagcgagagatgatttccgcttgtgcttcattctattttagttgatgagcagccgacaacggtttaaatggttatgattttgcttcagtaaaattctagtactaattctggagttctctatacttcgtaaattacacacagatcgatttttatttgattcgttgcttgtagaaatagttccactccctgtgctacatcacataagtcaaatttcagaagatactactagtttatagtggttacggccagcatggaacagttaaggtccataattttgtaaggctctgcagatcattttattttggaggctttccaatgtgtataattttcttttcattttttcagccatgcagtggagctccaatggtgagtttgcctttcattgtcttgttggagattgcacgttggaattactggcaaaagtcatgcttcttgcattcaagagttgtatcctgttctgcgagtatgatctagcagcatggtatggggctgatattttataaaggacaacgaccaatgtctgaattgatatatatatatatatatatatatatatatatatatatatattgtactcgccataatttaatgtctatcacagaagcagtaatatactcccttgcgatatatcccacgtggttttctttggtagacagtgttcgtgttttaaaacaaatgaataggcaaagatgatatatatttgcacttgggagttgccgtggatggttactgcaagatgctttaattttgtccatgtcgcgaggggtcaatcccagtaccacaccacttctttttttcaatcatctaacataactgcaactatcttttttatcttcacctaacagaaattaatctgcaatcaccacggttaatatatcctgaaacttggcttgatagagctttattttttgctaattacacccctgacctccacatttacatgcatatcacttaa

SEQ ID NO: 33776 - DNA, 1501 bp, Oryza sativa
aattgaaagagttgatgaaagggctgggttatcttgtttgctatcactcttatctctcatactggtgagcagcgcatgtgaaaggtaatagtgccccagcacctatagcgtgttccattgttgatgtcagtatatcagataataaaatgagtcctcttgctctgttctcgatgatttcagggttcttgatgatatgcggttatgggtagttttgaattccgctccttgcattgcaattcctgcaatgctattcttgtttcctccaaaatatacacactcaagattttggtttcttgccacaggtaaccgttaacatcttatgtagtaaggttatgttagcagaaactctttctacaaaaaaaagcttgaacgaaaactgttgtttgattggcatcttggtgcaggtttttaccttcttgcaagatttgaaggccttgctgacagaaaggtatacagtgtgaaccggtacttcatcagcggccattccttggagcacctttgcttcgcgatggttaccttgattcttactgtgatgctgtccttcagaaatgttaagatcgtcaggtacattttttgaacggctgttccatagaatagttctgctcaacctttttccatattatgataggtctagcaactcaaggacatgatcgctctacacttccagtaaatagtatgcatatcctgaagcatctctttagtacactatgcctgtgaaatcgtttgtgcaaaatgcaagttatatgcctcatgctaatcttggttctattctacatctccgcagagactcatgacatcctctgctggtcagggatcatctcaaagttctgaatgttcagaagacggccaccgatgcagctgacaaaaactttcttcacagctaactcatctaccttatccttgtttttttttttcccttggtttccattctctcctacaccctgatgtgttccagattgatgtgcccctccctgactttgtatgttcatgttgtaatttgtgaagcaacccagaattgtacgtgttttgttaacttttgagggtaaaaaaaaaggtacttaacggcgagattgcagtgctaatttttgccctgaattcaattcagccatccattcctcagtttatattagaagtcgtttgattttttttccgttgttaaagtttctcatgtttgatcaagtttgtagaaaaaaatagcaacatctataaaattaaattagtttcattaaatttaatattaaatatattttgatatatttgtattgattaatatattttttttacaaatttgattaaacttaaaaaaaagtttgataaataaaaaagtcaatcgatttataatataatccggagttcataacttttgcttttactggcaagtgggacccactcccagatgcgctgtctccttcgcgctcgcggctctacctctcgtcccagccatcggcctcgcggcgcgcgccatctctccaccgccgccggcgaccaaccgatccaccat

SEQ ID NO: 33777 - DNA, 160 bp, Oryza sativa
cccgataaaaaggaggcccaggcctaggagaggaaaaaaggagaaaagagggagaaaaaagaggagaaaaagaggaagaggggttgggactctggggaatgggttctagagcctgaactctctctcgctctccggctctctgtattccttcacacacaga

SEQ ID NO: 33778 - DNA, 1501 bp, Oryza sativa
cgcggaaaacgagtgagaggggttgagaaaaagggcatccgaacacaccctaaggtagccccactctctcctaaacaccccctaaataaggtagcatgtgcttttacatcgaggcctcatagcggtccacccctgagactgagtctcaatctacccccggtcgtgggtacacgatgatcccatctgctagggtataaatttggtgctcatagacaatgtactattgatgtttttagataatagaagcattgttgtgctcagttaattaggaaaaaaagattcatacctggaatactcttagcctctgtataacttggacgcatgtaaccaagcatacacccacatgctagcttttataacaaaggaaagtatagaaaaaaatactaagtaccatcaatccacgtaatatactctcacctagcgaaagtgaacataattcaaatggttagtttttttaacctgttcatgagtatatctaggttttaagttctagaattagcacgtgtactcgtatttacgtctaattatttaatactgatgacatatctgttgacagtgaaacgcgtatattgaccaattcaacctcaagacatgcttataaagataggatgtgtcaaacgctgaaatgaacccaaccaaagtggatgaacgttcactaaacaaaacacatcacacgtcacgttcaatcaaactcatctacaggctgcaaccaacgaagaccgagtttagttctaaactttttcttcaaactttcaagttttacatcatatcaaaacttttctacacataaacttttaacttttccgtcacatcatttcaattttaaccaaattttcaattttagcgtgaactaaacacacccaaagtaaagccctatatcggtctcttcattctccacctcgatagccgccgagatcgatactttgggtctatttggagagctaaaatcacgagaagcggctggttggttgtcagctttataaaaatctagaaaactagaatttttagtttttaacttccaattcattctatagtctgtacaactataacttttattaagatttaaaaatctggataaaaaattagactgtttaagatatattgattcaagagactaggatgtatttagttcatactaaaattggaagtttgattgaaattgtgacgatgtgacggaaaagttggaaatttgtgtgtatagagttttgatgtgaaaagttttctttaaactaccaactttttcatcatttcaatcaaacttctaaattttagcgtgaactaaaagacatctcagacctagtagctaacagaaacgaaacagatcctttgatgtttcatccttatccgtagaataccttccattgcagctccaccactagaaagtctagactctagagtagctcgaaacaccgaagcaagcgaaagagcatcgccgtgccgcgcggagcttttaaaacgccgcaacttccttccttccttcctctcctcccacgcttcccac

SEQ ID NO: 33779 - DNA, 695 bp, Oryza sativa
tggagacattcgacaaagtggttttggagatgtgtggtttttagatgatggacaagatgttgctaactgtgtggtctggctagaccgggcaggtgcagccggtcagaccggctggcccgacggtttgactgaccaacactgtgtcggtttcggtttctggttgtttctttggatatttgtgattaattcatatttatggcttctcgtaatactgttgtgtgctaatgttgagtcaagttggagagaacttttgctcggatataatttcttggttgattcatgtgtatgtgagtcttgatgtctcgggagagtgttgccggtgatggattgggagtcaacttaggagaagatgacgtttggacgatcaggatatcatgcgggatgcttatgctaaagatcaatgcagtgttggtgaagattccatatgccatacaatggagatgtcgtgtgtatgagatacggagtcgaatttgaaaggagtccaaattttttatgattgaagtttgtaaagtttatttcttgtacgggaaggtttcctaggggattagaactttttgtacaagttgggttcatggatttagactccctacctcgggtataaatagagagggtgaggcctcccggtatcgattgtgtgagagttgagtttagagaaaagttagggcttcgagtttagtcgagattttcgagtggag

SEQ ID NO: 33780 - DNA, 245 bp, Oryza sativa
tctttgcagaaaaggttggttatctaactctttattgtatttttctgtgcaaaggaaatattttatcttccatttcaattttatgtgaaggatataatgcaaaactgatatctactgaaaattaatgtaagttccacaaggcatgacacttgcctccttttctatctgtgaactaaaatttaatatcttgatagtgtgaagcatttaattgcaacacattgcttttcgtcattttcatcactagg

SEQ ID NO: 33781 - DNA, 1188 bp, Oryza sativa
cggaccttaatcataaacaactcggtcaaagtttttgaaataattaacactcaaaatctttttactttttggacggaatttatccaaatttcagacaggactatccggactgggtctaaatcataaacaactcgattaaagttttcgaaataattaccattcaaaatcgttttaatttttagacagaatttatccgcatttcaaattggattgtccggactaggtcttaatcataaacaacttggttaaaattttcaaaataattaacattcaaaatcggtttaatttttagacagaatctattcaaattttaaacaggactgttcggactaggtctaaatcataaacatcacgattaaagtttttgaaataattaacattcagaatcattttaattcgagtaaatttcacattgcaccatgtattttgaccaaagtttcacaatgggtaaggtccacaccaaccttttcacttaacaccatatacgtttgcactagttggcactttgaattgggattgagcacatcaaaagaagttgtcagagaaaagatagttaaaatcatcaattttagtgccacagtattaagatacatatctttagaaaaaaaaatagcaaatcagaaaacaatttttttcagcaaatcacactaaaataatgatgtgaacatgtttaaaagtggcacaaaatgatcaatacattggggcaaatgaataaaaataaaatagaaaatagaactagttaagtaccacacactaaaaagaaggaagaaaacataaaatgttatgccttttataattatccatgtgtaaatcatattttagacatgaagctctctcacatattctcttgtgttgatcacccctagtctaaactgaaaacttttataattatccatgtgtaaatcatattttagacatgaaactctctcacatattctcttgtgttgatcacccctagtctaagctgaaaacttatgtaaagatgtacggtgttaagtgaaaacattgatttaaccctagtccattatgaaaccttggtcaaaatatgtggcccattgtaaaatttactcctttaattcctagacggaatttatctgaaattcaaatgggactgtccgccttaatcataaacaactcggttaaagtttttgaaataatttaacatccaaaatcgtttttatttttaga

SEQ ID NO: 33782 - DNA, 1501 bp, Oryza sativa
ttttcatataagaattgtgtttttggcactaaactactcacataagtatagagagaggtaatatagtcaattttaaaaatattttaacggtaactcatggtcaactaatggaatagcacagaggagatcaaaataaaaacttaggggtatataagggatgaggcaaaatttaggagcggatcgaacaaaggccccgttcgaatccaaataaaaggatggatgaaattttggattaaagtggcacgcttttcaaactgctaaacggtgcgttttgtgcgaaactttctatatgaaagttgttttaaaatatcagattaatccatttttcaagtttgtaataattaaaacttaattaatcacacgttattatcacctcattaatttacgtgaaacacttaatatttatcttcacaagattcaaacaccaccaaactcccatggtatagaggggagcaatggcattgtagaattacataacttaataacaaaagagtgagaaactttcacgcagagaagcgcccatggcctaatggataaggcgtctgacttctaatcaggcgattgtgggttcgagtcccactgggcgtgacttttaattgattttacttgcttttctttttttcccccattttttcgattctgccttttttttttgcgggatactactaattatttgctctaagaagtaaatttcctctataattatacatgtctctttccttattcttacttttggctaacctggcctatgtatattgtatccaaatgactcgtgtcatcgggcgtatggttagctgatgctgttcgggccattgatatatgggcccatacagacgatactgatcggtatcgaaatgaaccatcgttaaatgaaagagccatatgatagtcatgatacctaaggtttaattaaaatttacacaattcattctatctatatagatatagatagttgatgtgtactaacttctaaagctcaacgtgtaagtgtgcacatcaacacctactagtaattattatctacagtattttaaatatcatacaagcataatatatcattttacaattttattgtatttttagaactcaatatacaaacaatctcaaatcattatcttcataccatttttatattatgtaaacatatatatctattatttttataatgtattatatatatatatatatatatatatatatatatatatatatatatatatatatatatatatatatatatatatacacggggtatttttagaatgccacgtagatcatttttttagaaaaaaattatttgaaatcgaatcaactcaatttacgcgaaatttaataaagggaaaagtctattttacaccctccaaattttgtgtttgtctaaaatacactcccgaattacaaaatcggatataatacccctctaactattaaaaccagacactttaaccccttgagttgtttttatggtggttttggtacacgtatatgctaggtgtataaa

SEQ ID NO: 33783 - DNA, 1501 bp, Oryza sativa
atatgagattctacgcgcgcatgcccgctgggattgtgctttagagaaaaagaaacaatatgaccatcaaatttactataaatgattgtttatttaagcgtacattgataccgtgttttgaaaaaaaccaatataagtaggggtgtagtggctaccccgaaacttacttataggctaaaataagccgtgaacccgcttattttaatatataagtgggttcgcggctcacccacttacacccctataaccaccaatctatcttgtgacttctcatactagcggttgcaccttccagctcacatgatgtgcatgcgaatagaatgtgccatgagttggacattttcccatcatggatcaacttctgaggtttataacgtgtgcaatgacgacgacatggacgcagaaaacgcatattttctctgttttttcaaaggggaaaagaaaatcatggatgatgaagacttgcaatgttgcgtgcatgcgcgaatgcagagaggcactactatagttcattgttgtggctatctacatagtactccctccgtattttaatgtatgacgctgttgactttcgacctacgtttgaccattcgttttattcaattttttttagtaaatataaaaatacttatgtcatgcttaaagaatatttgatgatgaatcaagtcacattaaaataaataataattacataaattttttgaataaaacgaatgatcaaacgttggaaaaaagtcaacgacttcgtacattaaaatatggaggtagtagcaaagtccactcttttgttagctacaacacgtggccagcatcgacgtagatggtgaatcctcggcctaggatcacggaccaaatttaatggtgtatctggactttgagtgattccatttgcacctgtatatttatttgttttagaacgttgtgcagtgcggtcaaaacctaaaaatgctttggtatagcacagtaaaaaatatattattatttataaataaaagacaaaggtcaaatggattgaaaaatactccctccattccataatataaggcacaaccatttttcttagatgttttataatataaggcatgcatgcaagtatgcaattaaccatgacatcttctgcattaaattattatttttaaaatcatccacttccaattattatatttattatgatgatccaaactataagatgataataattattttttagtattttagttaaagtggttgtgccttatattttggaacggagagaggatcagataataaagtagaagtacacagtaaaagaagagacaaaggtgaaaggtggatcgagagcactcgaagcgcgcgagacaattaaacgggtcgaatttgtcaccatatagtacacgtctcttctcccatcataaatactccacacagtccactacttctcctcgtcgtctccctcgccgccggccgccggcgaacccaagatttcagttcagacgagcaccagccgccgccgccgtgatga

SEQ ID NO: 33784 - DNA, 1501 bp, Oryza sativa
actaaacacacctcactaccatgcagcaattatatagtagtactactcttaaagaaatgaagggagagaaaataataccttttgtttttctggatgatgtatcctccggcatctttttttatttttttgaaaactattctccagcctcctgaatctcgtatgacattaatgatacccttctcaccttctgtactctgcaaatgatgctgaatgctagcctgcagtaatgtgaattcttcagaaatttaatttacatctagattatcgagtcaattatatagacctgtttggcatagctgctctagctccagcttctagccaaacagtttcagcttcacctaaaatgagagcggagctgggtggactggtggagtgctatcacaaaatgaactagagaggtggagctgtaactccactccaaactcaactcttggagttaaattttagagttaattggagctctaccaaatagacgcatagttattgaattcaaaatgcgcaaaaattaggataaacctgttcagttccaggcttccagcgttgcgtgatgtacatcatttgtggacctctgcagctgccattgtgcaacatgacttgcaaagtgtattacactcacaagtttgtgtgtgagtaccgaactccatcgacaaaacacaaaacatgtcaataaattgccgtgtttccttatgaacaacacatgtacggtggggaaaaaaatttaaggtgatctacatcgattggcaagttaacatggtacaaaattactggagtgctaactgatacattataataccttaattttttaagttatataaataaattgaagtggcagaactaatttgtatacgtgggcaactaattactctattccgaaatatagcatgcatatacgtacctgaatccctttctacccatccttttagaatctttcggtagatgcagagtgtggtagacgctacccacatggcgtctaacagtcgatctgaaatagccaattaatcttttgaccaaggatcacgaaccaaacaagtgatgataccaaaagaacatctcatcagagatagagaattaaagcgagagcaaacttgcatcgctctggtttgttcacagggcgcggccgtttagagtgctccttttgcgaaaataatatcagcagagatcatcagtatgacatttaaaaacttcattcattcggcgttgtaataatttcaatcatctttagttatattagttagctaggatatctggatatgtattgaatatgatcagaaaagcaactcaagcactagcacgatacccaaacaaaccatcgattagatcttgcaagaaccacagcaccatcaattcatcatccaattcgagaaataagccagacggcatattcataaacgaaaaataatttatgaataaaactttgatatactccctccgtactcgtaaaggaagtcgttttggacagcggcacggtctccaaaacataactttgacttcttgtttctat

SEQ ID NO: 33785 - DNA, 1501 bp, Oryza sativa
ctttactaatacagagggagtacatgtttttaatgatctaaaattaaaagctgaaaaataaactataataaaaaaaactttaaaatcaacttcaaatttaagattgataattcaaattttagccgataagtataagcatatgaaaaaagatgacaccataatagagatgtacagtttattacagcacatcgatctcacaaccgctaacttggcatgtctctgtatgtgtactctatatattgtttttttagaactactctatatattggttagctagctagcgagtaccatatctcagctgccattgccacccacttaatttgcatgcctatggagtgacagataacattacaatctgcattgtggaactttccacttttcagaattttgcatgaccgttcaaatggcatatgtaagatgatgaatctacacgcatgcaattggattctcgaatacttaactactccatttgtctcattttaagtacacttgtgagtttccgtgtccaatatatccgttatatttgaaatttatttatgattaacatttttgttattattagataataaaacataaatagtacactttatgtgtgacttatttttttaattttctttatgtttttattaaataaaacgaacggtcaaacgttggatacgaaaatccagaactgcacttaaataaaattgtgacaaagggagtacttcccaacttaactcaaattggagaataacgtgtgtaatgacgacagcaacaacattcgcgtttataaatctaattaaacagcgggctagctagccagcacaaacccctgcgcatgtggccagcaccaacgtacaaggtactttgagttttcaaacgtgggaagcacttgatcgaaagaattaatttaattaagcacgatacatatgatggtcgatcgagttctgtcaccatgtatctagacatgttttacgaccacgtacacgcttagccagggttcacactttagaatcacaccgaaatttcggtagtttcggtgtgaccgaaatttcatgatttccaaactcttttgcacgaaattatttgaaatattaacagattgtaactctggatttgaatatattttaaccaaatttaacaaaaaaattgaaaaaaaaaaccccaaatattgacagagttgctcgctggtgggcagggttagaaattccggaatggaatttccggaatttcagtcatttcggactccttatacgatattattttagccaaaatttttatcttttttactttttcgtgaagttggtaatattttgtttaaatttgaccaatatttatttaaaaaccgaaaaattaaaccctgccagtgagtcccaaattaccgaaaattcaatctggcgatcagctccccctgcatataaatactacccagtccaacgttgtccggccactaccgttgtgcatgcttgtgtcgtcaacgacggcgactagcagtagcagtagagagtggcagtgagatcag

SEQ ID NO: 33786 - DNA, 1501 bp, Oryza sativa
agcaaaatgttaagaaatgatgtgtcggtaaacttattcaagaaataggtacaactactctcatctgcatggatacaaagtcaggacaaacatgcactatgaggagagtactctggcagacaatataatcctcaaaaacttccaaaatgtaagactgaactcaaaatttttaaacagtagtttgaaccagtcatccctgtgtcccacaagacatctgaaattccggatattccctcctgatcccatcagtgaaaatgacatggatgatgcggtcataacttgcatttctctaacagcatgaatgttgctaatgagcacaacagcagaaagacgaaaactgaagtagcatatgcatacgctggtgcttcaatcaagaaaacgttttctttgtagcttccagttgactggcctcccgagcctggataataatccaaatttcttccaaactgcaaatataggagctttttgcacaaaattctgggaataaaccaaattggctcttcttttggagactacctttgcagcatcaacgaagattgtcaaaaaccacctggagaaccaaccagctacccgtgtgcctcccaattgcaaacggcaacatgcacaatgtgatcgatgcagctgttatttttcatcaggttgtatgactaacaggcaaaatgttcagtatgctggcaatgatcagaaatgatacactatttccccttggatactccctcctggacaacatacataaacaaacttcctcaggtgcaaacaagcattccgggttggttgcaatggcatgcgacatgacgacatcgacagccttgtgtatgatatgcagtattgcagtctaaaacagaatatgctcagattatgccacagttattcccagaaacccaccttggtcatgtaagcacagcttaacataatctgcagatcaaatcttttttatcttaattaacaagtcatcatccaaggaggtgagaaatgcatttgattggtcaaggttaaggatcattaaagtgagatccccagacattgatttggcttccagatgaattttttagatcaagataaaaggaacaaatcaagtggcatcatgtgataatccagtttcttgatggtccacacaaaaaaaatgtaaaatataatgtgaagtgtgcagactctcctatcatttctcagttttctcttagcttcactgattcagtcaagcagctaggcagctttcacatgttttgtttaatcaaacagctaagtttgtcaaagacaactaacagtgtcaaagcttaggcaaacaccaccactaatattgacaatttgacataatatgctgatccctttaccagttcagaaatattttgtttccaaccttgagagtacctattgtgtttgtctcactccattttggaagacatgtttgtcagtatctacacgtaaacatgcaccagtatgaaatgtgcatacctctaatactaatgccatctatgaatctcctttcagtgccactctactg

SEQ ID NO: 33787 - DNA, 1501 bp, Oryza sativa
gtggttgtgtacatgtgggtgcaacgaccagggataacatgaccatattatcctgtccgagtgtccggtcggggtgaacatagcaaccctggcctgttggctacgttcttccccttctttttcaacttatctctcgttattctcgtatgtacattttccaaactattctacggtgtgtattttaaaaaaaagttctatagaaaagttgctttaaaaatcatatgaatcaatttttcaacttttaaactaatacttaattaattatatgctaagaagtgtagttatatgtggcggagaggagggttccctaaccaacccctccttccaaacacagcttaacaacgccctgcgttcgagagtctaggttgggaactctcttgtctcgattttcacgcgcacgcttttcaaactgctatttcggtgtgtttttgtaaaaagtttctatactaaagttgtttaaaaaaatcatattgttccatttttgaaaaaaatagctaatacttaattaatcacacgctaatggatcgctccgttttccatgctggaggcaagctttccgaacccggacactggcaagcagcctaagagcttaacgaggtaaagtgctcccatgggactctgctgatgaccggtttgaccgtgtcaactaagagagactagtaatatgcccgtactaacgctacggttatattttgtaatgaaaatcaagatatactaaggtaatatgaaaaagaattattatattgttgctaattagataccaatgagaaaactcaaattgcaacttttttttgaatgtttgaaaacaatctaattccttatgcgcttaggaatacaaactaaacttattgcgtagaagtaatacaaaccaaacttcatattacaagcaaaagcatttttattattttataaactatattaatcacaggagacaaatcatacctacataccgaaagagccaaatcagtccatggtgaattaaaggcttgttcactttgatgctcaaattaaccataccaaatttgataatgctaaatttttttgcgcattttggtattaccaaattttacgtagtgttttaagagagaaagcttctagaaataccaaaatttggtaagtagcaatgtttgaagccctcagtatgtctagtttgttgttagtatttgcaacaaatcatcttacatgaggaatgtactcattataacattttagaggttttgtagtttattttttttatttaaggagacctcattcagctgtgcgaaagcaaattttttaacatgggcttgttgggcttttgacatgggctgggaaagaaaaaaaaaagaagagacagcccattaattctcacatacttattgggccttttgcgtgcgtggttgcctcactgacatgtggggcctcgtcgacgccaagctaatccgcgtctccaccgcgatgcaccgcttcgcctccgcctcctccctcccgccgccggcgccggcgacggcggcggccgcgg

SEQ ID NO: 33788 - DNA, 1501 bp, Oryza sativa
aaacgaatctatacatgcctatgtccagatttgctatactacactatgtcatatctctagattcctttttttacagagggagtaaattacagtccatactatgtattcttaaatattcttaaaagttttcatattatgtcatcatttaaccattcttttcttttacacaatagctaactttacatttcaatttggaccaccctattatatccatctccaagtctgatgactcagcaatcactccgcacactatctctctctctccattttctttttccctccgtttgataactgctaggtatagcaagaaggagcacggatatagcgtcttcgctttttgttaggtcaactcctgcctcccagtcccttcacgcccgacatccccgacctcaatgcaaccataacaatagtgtgcataacgatagtggaggagaaaaagaaatgtcggtgatgacggtaaaggcaaagaggaggaacgatggtggctcaggagaaagagcggtgatgacggtgcatggagtatcagttagtggttgctagtggtctgagaaatttgttgtcgacacaatcgctaactgtgtttgttaatttttgatgatatgtgggtcaccagtcatcataaagaaatactattaactagttttaaaatagtaaaaatattaagataaagttggagtagactatagatggccataaggccgaggcccgacagcccgaccatttggcctggtccaagcatggaacgacacaattattgtcgggctcgtgccagcttggcccaataattgggccgtgcttgggccaatgccttggcatggtggggctgcccagcacggcatggtcaaagaaaaatagttggggttaattctgccttataaggcactgtccaaagagaaggacataaatagacttattccatcatatatgacacaacccaaagagataagagacggaaaaagacttattttgtagaaaagcacgatggactatcgtgcctttggatcggctggcatagccagagtcttattgtgcatagactggcccgtgaatgcagcctgtgggcacggcacagcgggccccccccacctcggatagggcctgggccctggcgtctcgtatcgcgtaaaagaaaagagaactcggccgtctctctctctcgttgtctcctcctccgctcctttgcgccgccgccaacacacagggcagggcgcgccgatctccatctgccgagcacaaaaggggagggcaggggaggggatcctggtgagccctctttccgattcatctctcaccgggacctggaatttgcttgcgttcgttaaccctactagcttctcttctagatctggaagaagctcttctcctcctccttattaatttgagagccttaaacctctcttaatacaactagctagtaacattttgtttgtttgtttgtttgttcaccgaatagtttgggggttcaactgaaccaccatgtcccaagttggatccgcccctg

SEQ ID NO: 33789 - DNA, 263 bp, Oryza sativa
tttaatattatctttttttaaaaaaatagattaatatattttctaaagcaacttttgtatatatatatatatttttttgtaaaaaccataccgtttaacagtttgaaaagcgcgcagctggaagaaagaagggatgacttcacaactgttgatgtgaaaaacacacactggcctagaagatctacttaacttcagtgcaggtccaaaatcttgcttttaggttcgtgagcgtgctagttgatttgatcctgtaatcaacaaga

SEQ ID NO: 33790 - DNA, 621 bp, Oryza sativa
taattatagtgaaatttggtcttcaaccgtgaatttggtcataaacaatctaaagacatccatggattaaaaaaacaattatatgatttagatgtcgtagttacttgattttttaacaaataaagtatgaaaataggataaagaattaatggaaaatagaacagggaatcgaaggaagggagggagtaagtacataatgctcggtggggccgggtttaggagatgatttttaaaaaaaaaaattataatagttgtaaataatgggtccaccgaattgaatgaaaatcgacggttattttttaaagtgcaatgtgacggcttagaagcgtttataggatgccacgtgatgacttacgagcgtttgtagaaagtttaatggacttttagtatagatatatgatttttcaataaactacctcttattctaaactgctcatttcaattttattttattttcttattacacaacaaatgcacacgcaaactacatcactacacatagtcacatacttaggcaaatgtgcccctaacacatgcttaaaaagacataaacagaaatcagcagcatatctctgatcttattaaaaagacattagatttgaactctgatgggtaaaatca

SEQ ID NO: 33791 - DNA, 212 bp, Oryza sativa
cgagcgacgacgacggctccagatccgcgcgccgccggcttccctcctcgccgcttccgccggccacttcctctcctcccctccgtccgctgccgtcggcgcccgtggtgaggccggcggcggcgccccatggttttttttattttcctgagatgattttcacagccgggctgtggcccgcctgcgaaaatggtctattttcccagtcgaga

SEQ ID NO: 33792 - DNA, 1420 bp, Oryza sativa
ttttaagtattttaattccttctcagcctatacacttagctcttatatggattactaataaagtctagggctccaaggttcaaatatcgatcctttttttccttttacttctattccttcattgttgttgtcctgacgtttcatggtcttatattttgggaagatttgcctgtggctctgaatgactgccctgttggaatgagctaaccggggcaaattatcaatacatcattattggtcccatgcttcaaagtacaatactccggaaaaataattattcattagccttgcttggtaactttttgaagctgtttgttaactctataatgtaatatttaattcattgttataagtaaattatcttatattatcagaatatgctgcgtcatctaaaaataataggccctagcttagctagggcattggaaaaacactgctccttgcatcataaaatagttcaaactttatcccaaataaagcaacccagtattataaaatgtgacttttaccactaaatcaaccatattaattatcccaagaagaggcaaccatgcattattcttttacctctctccctaatagccacttattatattttgggacagagggagtataaaataaccttacattattattatttttgaacatttgtttactaactaattaatcccaaagtccatacaaacaatatatgtttctaataggctttaataatccttaatttgtgagaacagtggtggactagatgacgataagataggtggctcgtaataaagagtaagaaaaaaagtaactatttcatcatagcacttaaccacctaaacttttttttttctcattttacacctcgaaccccctagcagtattttttattctctctatctaagtcaattttgctctggaaatttggtagaacatagatgcgttcacaatttaggtttcaacatttttttttaaaaaagaattatcactgtttacttaggttgaaagcacataaaacagattcaaacatcaaaattaagttcaagcaaaaatcggttgaaaaaaatttgaaaatacttttgaacttcgttaatggtgccatctatggcttctaacaaatttcagcttaaaatactgcttgtaaattttagcttaaaatacaacttgtatgacgggtaagaaaatgtatatgttattaagcactaaagtgaaacatttttaacggtttaggggtaaactaccaatctaacttcactttttcaagtttgcatttgatcctatttttcaaaattgacgttgttgtttggccgtgtttccattacacattaaggttttgtcttaaaaaaaagcatgcatttattagccaaaagtaccaaaatgcccatgagtacacaacaatcctatctctaactttcttctcatcccctttcatatcagg

SEQ ID NO: 33793 - DNA, 412 bp, Oryza sativa
ttgactagcatggaccttatatattggattggttcagctagatgttatttatacccgcttagccgtgcttagaaacattagctcattaatgggataaatcatgcttcactatcacttatggatatttaatggaagctcacgatggtcaatcgtgattggttaattaattaaattgtcaactaaaacttgataatggtgggttgtgagcacatggttttgatggtcgtgctcatgacaattaaggaccggttcatgagtttcggttgtgaaacattaaccgtgccaaccacaagccagtatgggcaacggctttaccttttatatagcatggttcattgcggagcactagactgagaagtggcggagataagcccacgggggtcgctggggagtccataccttgtttataagg

SEQ ID NO: 33794 - DNA, 1220 bp, Oryza sativa
tgacatgatgttgaggttgtgtcttgtgggtacagtggtacacctctgatcagagtaaaactattcgaatagccgagcccgcggttatgggcgggtctaacaatgtctttcgtgattagtttcacacttctcaccataataaaagatgctataactggcaataatttgtttagctcctggtttggaatggtgtattcctggtttggagatagaactgtgcagccgggatggttgttcagaacgattgggcctatgcaacagggtatgttgtatagcgttggattaatattgtttaattactacttaactattttattaaattctgaaatgtttgtaaatgccatttatgcaaatgaaaccatactatgccatcctttgttatcctgtgcacttgcatatttgctgcgtggcttgctgagtatgtcatatactcaccttgcaatcattcatcagaggaggagttctacagtgatgctgagggtgtggaggattaggtgtagccctggtcaagctgcctgtggagtggagtcgtttgcgccgtttattttaattttccgctgcttagatttttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacctatagaagccctctaaaaatattggaaaagtagaacttatctcctctctttctcttttaattaaaccaaactaatggcacatgcagtttatatttgtttttattgttctcacttaaaatttatttactattcctgtgctgttagtactgtacatctattaccgtgctaatggcccatttaccatcaagagttttataacaatgcttgatttaattttgctgcaatgagctaagcttagtataatgattttataacctgttattcaaaagtgcaaagtttgtgaacatgtttctgactgcttcatcttatcatgcaagcttggtttatttaccttttactttgattttctaactctattcaaattaatccaaaaacttgtgctattaattggataattgacttaactccctcctgtcacttgtctttaga

SEQ ID NO: 33795 - DNA, 152 bp, Oryza sativa
aggaatcggccgcggagatctcggctccattgaagaagcctgcgaaactcgcgggattcaaatcggacgaatccgagggagagagagagggaaaagagggggaaacgggagagggaatcacggggagtgatttccccctctttaatgcgtgc

SEQ ID NO: 33796 - DNA, 323 bp, Oryza sativa
tgttaaggcccttataattgttgctattgttattattaccttgttcaccctaggataaacaaaacccccccaactagtgggtactctattcatggttccactagtatgaatttaggtagatgcttcgctgattaattaggcaacattaggtggttttataattttagactttgggaattctcatatcatttggacactatggaattgttggtttatggtggaattggacatacacctctcttcctctttcaaaacccctaaaacatgtttgttgggtgcatgccagttgtgggaagtagcaccccggccactctaaggattaa

SEQ ID NO: 33797 - DNA, 596 bp, Oryza sativa
ccttgattaataatattgtttagttctaggatcgcgtttacaaaatagccctgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagtccagaagaggagctccttgaagatgaaggttttggtgtctagctcgtgcctgccgtcaagcgcctgtggtcgtcgccctagtcttccgctgcttcttcgtttgtctttgtgtgttgggccttcgctgcccatgtaataattctatttacgcttccgcttgttaaactctgaattgtatcaacttttggtgtaccttgcctcctgggacaaggattaatgcacgcacgtcaggaacgcccgttgggttatttccggtcgtgacaagttggtatcagagccacccttgaccctaggacgagccgtagatcccaagccttagcgatattttcaaaataaaaatctttggttatttgtgaaaattgtctagtctctctctgtcttgctgcttcattta

SEQ ID NO: 33798 - DNA, 1501 bp, Oryza sativa
gatgctgctgtagtatctctataagcaatttgttctggttaatcaggtgttggaccactgccacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaaacaaggaaacacacgactaacgactctaccctagagggtggcttaggttctgcgacgggttctccaagatcttcactcctgcttcacagctggcttcactgcttcctccacttcactagcagatcctgcagtcttctggagcttcggcaaacaactgacgatgtcctcttcttcactgacctgaccatctagtactagttgaaaatccgaagaaggaagaacggagtaaacattttgcaaatagcattaggggaaggagaaaaaaggaactttcacaaatagttttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaaacaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggtacaaggagataataatataggggttaggttttgcagtaaacagcatttaaaagtcacttagttgcccaaagttattttataaagacgatcctagagctacacaatattattaaacaaggccgtgaaccctcacgaacctgccttaacccaaggcctacgatgattcggaccgaactggcaacccgacctgggttccaactcgtcccaagccaacccaggccaaccattccatattttagttgttgagcaaattttaagaattataacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagc

SEQ ID NO: 33799 - DNA, 1501 bp, Oryza sativa
tcggattcgtccggattcatcccgcgaagttcgccggcgtcttcaatggcgcccgagatctccgcgcgcggtttcctctctccccggccgcgctctccccctcccgttgctataaaatcgtccctcgtgcttcgctcttccgtttccgccgctcgccgctcgctctcgccgtcggtttcgtgcccgcgccgtgctcctctctctccgccgtcgccgccgagctccgtttcgccgccgtcgtcgctccggtcctcctcccgactcggcgccacctccatcggcttcgccgagtggttgccgaccccgtccgccgctccgcttcgcccgccgaccgccggagcaccgtcgacatcggcatcccgaaccgcgccgccgcttttctccactccggccgtcgtttccgccgtcctcgttgtcccggggtgagccgtggaccgtccctctcgcttccctctcctctccgctctctcgggcgccgctccgccgcgccggtggtcgccggcggtgaccatcggggcgcgggcgcgccgctcccgtcggccgtgccggcgaggccgccttcgggcgcgccccgcggctgccaggtgggcccggccgtcagccgcccgcgcccgcgggtgcggctgacgcgtgggacccacggcgccgaccgccgccagccgcgtgctcccggtccaccgtggaccgagaggctgacgcgtgggccccacttcccgtggacccggtccgcgcgccccctctcccggctgacgcaataaatggaatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgctgttatgtggagtttagtagtgtaaaaagccttttcttttccgttggtcgtgtagacgctgcagcttcggaagatccgctcttcgtggaagttgaagccggcgtttgggaaagcgagcaaggcaagtcacatcacccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaa

SEQ ID NO: 33800 - DNA, 216 bp, Oryza sativa
cacatgacatcggcttgaaataaatgatatgtcatcagcacctagccgatcggctatcatttataggattaattgcggtttctttgttctatctcttgttgattgcaggatcaaatcaactggcacactcatacatccgaaggcgagctttggacctgcactggagttaagcagatctcccaggcctcgtgttttatatcaacagttgtctgcagg

SEQ ID NO: 33801 - DNA, 393 bp, Oryza sativa
gggcgtgtcacatcctcgcgtgtgtaaggttgtcgcgccctgaactcgatctgcgtgatatcttggatcagggggcggcaagcgacacgcgtaaggaggtgatgaaaaaagtcagtgacctgggggagtctgtcctccccctttttaaagagtaggacttcttgtattttttataatttgcaaatcttgaactctggttgctttcgggcgtatgattaccatccttgttcagtgttgatttcgaaagtttttcttgtcgattgtagagatgctggtacgaggatgttcagcagcgcgggtagcccgagtcactagcgataattccggtacttgagtttgaaccacgcgtctcacatgacgtcgaggaccaaactcttgatgtggaggtcgaga

SEQ ID NO: 33802 - DNA, 245 bp, Oryza sativa
gctaaaattgacaaaaatggttcctaaacttcctatcgtccgttcgacaagaagcccaaatcccaaacgctttaactaggcgggtctcaccgaatctttatctactcaccaaacaccatcaacacatatatttctccaccacacactccaatcttatcccatctctcccttatctctctccactacaacactacctcatcacgagcagcgacagggctcttgtcctcgacggctatctccttagc

SEQ ID NO: 33803 - DNA, 772 bp, Oryza sativa
caatatgattgccgcgcatggattgagttctgagaaggcaattgtatctattaattaggatattttatgtaaattctttagagataaatgtgggtaaaagtctgtcgtaaagacttatggtatcttagagattgttagagataatagtcgtgtccgatttggacatatcttgtaattcttgggtataaatagaccccgagccctatgtaattattaacacacactatcaatacaatctcggcgcatcgccacccttttacttttgttttgtttcgatgagttcttgcttttgggttgagctgcatcggtttcgatcttcaacaagaggtaagacttgttatggcggcttgcgttctcgggattagtgcttgcatctttattatactctaatcttgtttatgtaattcatcgagttatcatatatcttatataatctttgataatatcgtcatctaacctacaatcggctaacatctgttaacacaaggcggccgattaggttaaatagcgacgttggcttagattatatcgatctaagtgatttatactgtctccccatggcgaccgatctatcccaatcacttgatttaagtatatatcgacataaggattatatattgttaatatctacagccgattgagtagatttagttcctttttattcatttatggctatcgatcgatgtacatatgacatcggcccaaaggtaaatgatatgtcatcggcacttagccgatcgactatcatttatggatttaaccacggtttctt

SEQ ID NO: 33804 - DNA, 948 bp, Oryza sativa
acgagtgatctaaaagtttaaggatcgggatgacacagttgaacaagtttgaggacctgaacagtcgatttgcgagtttcgggaccgggatgacacagcggtacaagtttagggaccggtgatggactttactcttattattttgtgatgaacaattatcatttgagattattgttttgatatttttagattattggtgaagtggttttggagaaggttgattttcagatgataaatagggactgctgtcagtttggaccagttagagcgaactgtggttgccgatcagaccggcgtgtgttgcgcggtcagaccggtcagcccgcggtctgatcggccgaatatgtgtcgatttcggtttcaggttgttttctgtagatatttgtggataaatcatgtttatgatttctagatgaatactaagcgttgttgacagaaaacacgaggcctgggagatctggttaactccagtgcaggtccaaaactcgccttcagatgtatgagcgtgccagttgatttgatcctgcaatcaacaagaaacaaagacaaagaaaccgtggttaaatccataaatgatagccgatcggctaagtgccgatgacatatcatttacctttgggccgatgtcatatatacatcgatcgacaaccataaatgaataaaaaggaactaaatctactcgatcggctgtagatattaataatatataatccttatgtcgatatatacttaaatcaagtgattgggatagatcggtcgccatgccgagacagtataaatcacttagatcgaaatatatattaacaacaagattatatatgttcatagcatagccgatcagatagatctagcatgtatcggctaatactccgataccactctgtattaagatattaaagcaaataggatataccaaacagaagcctaatatacttaaatgcagcaaga

SEQ ID NO: 33805 - DNA, 1501 bp, Oryza sativa
gaacaaaattggcttcggtggtgaaaacggaagtaatggggtaaagattttccagggcggcggttagtatttaaagcactgaggataacggtcagaaaatggcagagtgcgaaacttactcgaagtcgatacgcggcaaatccgaaacattaccaaatatcccggacttggggggcatgtgttaacgaccaaatttggtaatatcaatatcggatatgaagattaaatcgaagcggaaccgaagataaggattgtcgcggaaacagagtaagaatcggctggagtccggatcggctacgactgggatcggctaagtccgagtctgactgggttaagtgatacagccgattccgacaatacgacttgtgtacgacatcgggtttgagttgataagcttcaagatgattgccgcgcatggatagagtcctaagaaggcaattgtatctattaattaggatattttatgtaaattctttagagataaatgtgggcaaaagtctgccgcaaagacttatggtatcttagagtttgttagagataatagtcgtgtccgatatggacatatcttgtaattcttgggtataaatagaccccgagccctatgtaattattaacacacacgttcaatacaatctcggcgcatcgccacccttttacttttgttttgtttcgacgagttcttgctttcgggttgagctgcatcggtttcgatcttcaacaacaggtaagacttgttatggcggttttatgatactctaatcttgtttatgtaattcgtcgagttatcatatatcttatataatctttgataatatcgtcatctaacctacaatcggctaacatctgttaacacaaggcggccgattagattaaatagcgacgttggcttagattatataagatatctatcactttatgaaacatccagtggcttgattgtctagatattgttcttcttttcatactcaatgctgcatcagttgagtttgatctattaagtcgtgcttagaatttcaatctctagcctgccttctggttgccgattagggtagtatcggagtttcagtcgaccttacctgatttaactaccttatcttatatgcttgattgatatgttgaatctgccctttatattaagatcttgctgcatttaagtatattaggcttctgtttggtatatcctatttgctttaatatcttaatacagagtggtatcggagtattagccgatacatgctagatctatctgatcggctatgctatgaacatatataatcttgttgttaatatatatttcgatctaagtgatttatactgtctcggcatggcgaccgatctatcccaatcacttgatttaagtatatatcgacataaggattatatattattaatatctacagccgatcgagtagatttagttcctttttattcatttatggttgtcgatcgatgtatatatgacatcggcccaaaggtaaatgatatgtcatcggcacttagc

SEQ ID NO: 33806 - DNA, 1501 bp, Oryza sativa
ttcgaatagccgagccctcggatatgggcaagccgagcaatgtacccaagtcagtgttataattcttaaaatttgctcaacaactaaaatatggaatggttggcctgggttggcttgggacgagttggaacccaggtcgggttgccagttcggtccgaatcatcgtaggccttgggttaaggcaggttcgtgagggttcacggccttgtttaataatattgtgtagctctaggatcgtctttataaaataactttgggcaactaagtgacttttaaatgctgtttactgcaaaacctaacccctatattattatctccttgtacccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaactatttgtgaaagttccttttttctccttcccctaatgctatttgcaaaatgtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatg

SEQ ID NO: 33807 - DNA, 630 bp, Oryza sativa
tacccccctggcattaatcatgcatctgccggtggggcttgctgagtactggggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagtccctttttcctcctttcccctgtgctatttgcaaaatgtttattctcttttcttcctccttcggattttccactagtactagatggttagttttgcaaagaagaagatgtcgtcaattgtctgtcgaagctccagaagactgttggatccgtcagcgcagcaaaggaagcagtgaagccaga

SEQ ID NO: 33808 - DNA, 1501 bp, Oryza sativa
aaggtggcttgattcattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagcttggtacccgactaaatttcagcaccgcctatcacccgcagacagatggacagaccgagcgtctaaaccagatcctagaagatatgcttcgcgcatgtgtactagatttcgggaagacttgggataagagtctcccctatgccgagttctcctacaataacagctatcaagccagcatacaaatggcaccttatgaagcgttgtacgggcgcaaatgccggacaccgctattgtgggatcaagtcggagaaagccaagtgttcgggactgatatcctgagagaagctgaagctaaagtcagaatcattcgggataatttaaaggtggcacagtctcggcagaaaagttatgcagataaccgtcgccgtgatctggagttcgcagtggatgactttgtgtatctgcgggtcacgccattgcgaggtgtgcacaggtttcagacaaaagggaagcttgcacctcggtatgtgggtcctttccgtatcaatgctcggcgcggagaagtcgcttaccagttggagctgcccgcctccttgggcaacgtgcatgatgtgttccatgtgtcgcaactcaagaaatgtcttcgagtgccatccgaacaggccgactcagagcagattgaagttcgcgaagacttgacttatgtggagaggccagtgaaaatcctggacaccatggagcgcaggaccaggaaccgggtaatccgtttttgcaaggtccagtggagcaaccatgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagttaaaagggttttataaaaagaaaaatcctaaaaagtcttctttcccccccttctttcttgggccggctcggcccagtccctccctctctctctctcttcccccgcggcccatcggcctcccccgcgcgcgcgccgctgacaggcgggcccgcccgccactctcgctgacgggtggggcccacctgtcatcgccttcctcccgccgcgcccgccgccgcgcccgtgccctagcgccgccgccgccgcggattccgccgcatcccgccatccccgc

SEQ ID NO: 33809 - DNA, 1501 bp, Oryza sativa
cggattcgtccgatttgaatcccgcgagtttcgccggcttcttcaatggagccgagatctccgcggccgattcctccttctccggccgcgctttccccctctcggcgctataaaatcgtcccccgtgcttcgctcttccgtttccgccgctcgccgctcgctctcgccgtcggattcgtgctcgcgccgtcctcctctctctccaccgtcaccgccaagctccggttcgccgccgtcgtcgctccggacttcctcccgtctcggcgccacctccatcggcttcgccgcgtttccgtcgaccccgtccgcccctccgcttcgctcgccgatcgccggaacgccgtcgtcatcgccgtcccgaaccgcgccgccgccgtcctccgcttcggccgccgtttccgtcgtcgttgtagtcccggggtgagccgaagaccgtcctttcgcttccctctcctctccgctctctcgggcgccgctccgccgcgccggtggtcgacggcggtgaccatcggggcgcggtcgtgccgcctcccgtcggccgtgccggcgaggccgccttcgggcgcgccctcgcggctgccaagtgggcccggccgtcagccgcccgcgcccgcgggcgcggctgacgcgcgggacccacggcgccgaccgccgccagccgcgtgctcccggtccaccgtggaccgagaggctgacgcgtgggccccacttcccgtggacccggtccgcgcgccccctctcccggctgacgcaataaatggaatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagttatttagtgtttaagccttttcttttccgttggtcgtgtagacgctgcagcttcggaagatccgctcttcgtggaagttgaagccgacgtttgggaagacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagagcaaacaaaaccccaactagtggacactctactcatagtaccactagtataattttaggtagatgcttcgcaatctaattaggtaaccttaggtggttttataactatagactttgggaaatattcatatcacctggacactctggaattgttggtttattgtggaattggcttcacaccgctctctctattcaaaagtccccaaaatggttttaggctgggctcggggtgcatggtttggatggtagcacctcggccgtttaaggaccggt

SEQ ID NO: 33810 - DNA, 1501 bp, Oryza sativa
tgggctgactttcggcccaaagccaaaagagaatttaaaaaacctttttcaatttaaattattcattaaatgcaattccatttattaaaaatacttccttagctcaaataaatcccagaaaaatctaggaattatacaattaagcaaagtatttaatgaaattttgtctggcccacttttatattggaatttatttattaaaattagatcttctcttctaggctttttttaaaataaattctaataattccaattaaacaacgatttatatatttaggatttttagggtgtgacattcggcttcccaggccgaagccgccatggatggccgttcccgcccacgtcccgccgagtccggcgccctcccgctcgcaccctcgctctcaaaccaagtaaaatcggttccccactaccttctccaccttttcccccactctccccgcgaaaatcggcgccggttaactcctccaccaccccacgtcagcatcccacttcgccagccgttgccgttccgctcggctacgattctccctccccgagcctataaaaacaaacctagagctctctctctcattttccctcctcccccgagcttcccgttgcctccctcgctctccccaccgctgctcctctcgccgcgactccagctggccgctactactgctcctgccgccgcgactccgcgcgccgccatcagcggcttcccgtgtcgtgccgtacccggcatctcctcatcttccctattttgtcgccggaaccacctcctcacggcgctcccactccccaccactcaccggcgtgctccagtcgctgcctcccgtcgcactagccaccaccgagccgcgccgacaccaccatcggcatcgccatgtcgatctcaccctagcccatactccattttccccttgagcatgttaaaaagcaaggcaagattgtttgatcgcgaggaaaagagttccgtaagattgtttgaagaagcaaggcaagtcacacattccccttgagcatgttgagcctaatttataaatgtttttaccgtttgcaaataaagatgcatgttttgctaattacatgggatcagggtttacctatctgcttgcttgtgccatattatttgatatctgtcctttgtcaaccttgggtaataaatcgactagcttgtgttactttgttgatctagctagaactatcggcttagccatgtttaattaccactagctcagttgatgggataattgcagtattagacctgttagtatcatgatgagctgcggctcgagacatccggccatgtttcatggtcgtaattatccaactaaaactcgactgaatggtgggctgtgggtgcatggttttgctggtcgcacccatggcaattaaggaccggttcgtgggaaaccctggaagacatacagcgcttgccacaagcgggaatgggtaactgcctgacttgaagtatagcttttcgcttgctgacgcatctaggcaaggatgagcgtga

SEQ ID NO: 33811 - DNA, 1501 bp, Oryza sativa
gaccgacgaggacgtcagatcctctagtttagcacaagtggaaccaacttataaggcctcttccctccaaccatgtcactcccgggttaacccttctacacgaagcgagaacaaaagtgtaagtggagtggtatgtgtaagtgggccagcccgtcgaattggttggctatgcggttctggagggaggactgttacaaaggcgccccagggtacccctgtgcccctgcgctagttcaacaccgtcggtgccacacttctccttgaaagggcacagcggcgacggcgtatggtgagaggagcgaggacgacaacctcgacgccgtggtgcaggaggtgtgattgacggtgacaagcgccggcactcccctcgctcccctaccctatgaggtcgacagcgtcgcgggctttgctcattggtgccggttgggaagcgctaaaggtgctggatttccgaaccgacacaacagaggtaacacttatgaggactcgcaggtgccggtttaagaacagctcagctcaattcgagcccagcgatgcttcaaagacaaaaaaaaaacaaaaaatctaacaaaaaagagactagtacaaataagaggaacaagttcatacataagagaatcaaacattcacatcagagaatcaacaagtttgaggaggaggaggagccccagacggtccaccgtggcaacgtcatagaggagcaggagcagctcaatgagcagcggcggcatgggggcgaggacggcgatggcgccgtggcgcaggagacgtggttgacgttgaccgacgccagcattcctcccgctcccctacccgatgaggtcgacggcgccgcagggtgcccctgcgtcggaccaaccttgtcggtgccacgcttctccttccaagagcacggcggcagtggtagagaagcgaggatggcaatgtctccgtggtgcgggaggcgtgattgacagtgacaagcgccggcactccccccgctcccccacccaatgaggatgatgacgtcacgaggtgcccctacgctggctcggccccatcagtgccgcgctaccccttctgactccgttagccctgaaggcagaggggaggtggtggcatggtgagtcacggctggttatttggggaggagacaagatgagaagggaggagaggtaagggaggtggtggcttggggaagaggaaggaaagggagaggagcacgaattggatgagaaaggataagaaggaagcataaagagaataagaaggaagcgaagagaccgaggagataaggatgagaggacgggagataggtgttggttgtattgaaaaccgacacttctacctcgtatgaaagtgccattttttaataggaatcgacacctatttgaatagcaatgtcctagcttttgccgctggcacccccgcgggagcccgtgtgggtgagaaaagcattataaatgtcagttttagctattctaacacctatatatagtgttgtctcctttttttagcagtg

SEQ ID NO: 33812 - DNA, 1501 bp, Oryza sativa
agcatgggctagactaatatatttctgcgatggccttaattacttttgtcgaagcaagatttcgacaataataaaagggggtggctatcaagctaggaaagtggatgggtttggagataagaaattttatacaggttcaggccttcttattcaagaagtaataccctactcctatccggggatgattccgccgagtgtgttattgattgtataaaatggaaaaggaatcgccccccaagaggcacacggaccctcttatatagggaaaggagtccgctttacaaaatacagtccatatcctaatagaatatgggattatagataaaatacaatcgtaaccgactaagatcccgggtatttccttgacatacaagtttagaacctaacccgaatcttcatagagatattccatctatatttagtaccgtatatccgactaaattacaaccgtcatgtagatatggggtatccataatctccacagtagcccccgagaccttcgcagttgacaaaatagccttctcgaaacaaaaaaacagtagtccgagtgcttcaattcaacttgctccagcttgccgagtgctaaaaattaaaaactgtgaagggcgaaaataaaacatggtgcatcgagtagatgcacctaattaggtgtagcccccgagtatgtgattagttgaaaaactaaacatatagtcaagaaccgagtggttttatagcgaagcacgaatggtacttagtaagatacccagccgactgcttctcaacttgaatatatcaaggacaaaaaatacaagaagggccgagtgataaacactcaaaggtccaaaaataaacatgtttgataggaatccgagtaagaatctcataaaatgacccaccaaacaggatagaaaatcatggtaattaatgagtccaatagcctaggctgtgacccttaccataaccaaaataagcatataacatgctaaaagaatgactattaataaaccagtcatctcaaatcaacccaaacagcttttgcagcctaacaaagcttacaaaaacggtataacacctttctgtcgggcacctttttatgtgcatcataataattcccaagaattattgaatcgtgttaaaaaggattttaacagcattgggccacaccattgtgaacacaaatcgccaaagcaaaaagtgcctaagtccctagggatcacaacaggccacgctgattatagtattgggctgaagtactgtacaggcccaggcccattagtactcccgataccctaataataccgaagtgaaactcgtctcttcgtcttccccgccgagactctcgccattttccccatttcctgctacagtgcaaaactgcgccggccaaactagggttcatcaatccgctccaatccctcctcaaaatcttcacgaaatttctccccgtatccaccgctcaaattccccatccctttccagccgtatctcgaactaaatcagaccatccagttcacattca

SEQ ID NO: 33813 - DNA, 1501 bp, Oryza sativa
tagcatcttcggctttggcatactcattggctttttcaaacatatgtttgaccgtcttgggaggtttgcgtccgaacttgccgactaggtcctcgtggcgaatgcctttagtaaaggcggcgatgataacatcgtcggtgatgtcggagatcttgttacgttgctcagagaagcgtcgaatgtaatctcgaagagattctccagacttctgaacgatgttgtagagatcgaagtgtgtaccgggccgttcaaaagtaccttggaagttggcgatgaagtggtcgcgtagctctgcccatgatccgatcgtgccgcggggtagcccatgaagccatgaccgggcagaatccgctagggccacaggtagatagttcgccatggctttgctgtctcctcctgctgcgcagattgcgagactatagacggtaagccaagactcagggttggtggtgccgtcatatttctcgattccagtcggcttaaagctggctggccaatccactcgacacagatcgcttgtgaaggcagcaactccgtccacgtcgtcgtcgtagcgatccggtgaatgatggcctcttgtgcgcggcgctggttgatggtgtcgcgaagatcgatggggcatcttcgatgtggggactgtggtcgttcgacttggcgctccctatatcgctcgggaggcgagcgaacggaccgttcatcatgtcccctgctcctgcgactagatttgacgccggcaatgctgaggcttggctggtgatagtcttgagatcgaagatgagggactcggctaccagttggggtgcgggtgcttgcggagttggctggaaccgaggcagcgatcatggtcttcgtctggttcaagatgttgactacatgataagcttggttgagtgcgtcttccttgaggagggtgtcgaggagagtgattgctgcaaccgcgttctgctggggggtgcgaaagaccgctgtcccatcaacgtcttgttgcccaatgagctctctcgctcgccgcccagattccaaggcgcgttgtcgtcgatcttcagcctcctttgcaatccgttcgtgatcttgttgctcacactgtagtcgttctcgctcctatcgctgtcgctcttcctctagtcgatgacgttcagcttcttgtcgtgcgcgatcttggtccgcttctcgggcttggtgctgttcctccatttcattgttagccttgaatacgccgaagaagaggggcgtgtagttatcctcatagctgtcgtcgaagttgtcgaggtcgccgtggtcgtagtggtagccgaaatcatcgtagtcgaggatctcggttggtcgagaactgacgccggaggagctgaggtagccatccaactcttccgtcgagactgtcccgagaggttggagtataacgccaaccttcctggatctagatcggatcggggccgaagccggagctcgcttagatcttcgagtgggagatgtcttgactgtgaagacagcggccaaatca

SEQ ID NO: 33814 - DNA, 733 bp, Oryza sativa
atcgatggaggctgaggctgagatggataagatcaacgcgagactgagatgggggctgaggctgttaatttaatgaggaagggggaggggataagatcgacgactgaccgagatcaaaatgaggcctgcgttctcggggtgaattttggtcccggctgatataataaacaaccgagactaaagatatttggggccctgactcgacctgataacttgaaccgagactaaaaatgatatttattcttggttggtaacatcaacagggattaaagataacaatgttgttagccaggactaaaaataatatttagttccggttcctattcgaaccaggactattgtggattttggacgaccaaccaaagatggtttctccaatagtttaatgcatgcaagactaattcaccacataatcctgagactagtcccaacatgcacgtacgcactacttggctgccaatctactttaagcattcttccaaattttgtgcttcacatgagattagctcgctatgccataacgactaacgcatgcagctgacaacttatagtctactcctatatatgatgacatgcaacaaaataaacatgatcacctaatacaacaagattatttctaacatctccatcccaaaataaaccaacatcgtatactagaatgtgatacatcgtccagatttatagtgttaggatcgatgtgtcatacctagtatgaggttggcttattttacga

SEQ ID NO: 33815 - DNA, 1501 bp, Oryza sativa
gctcctgggcatccgaaaaacgtgacaaggttcgtggacactctaaaaacctggtaatttattaggggacaccatcatcattattttattattattcggttaaatggagaaaaaagcatttataaaagacaagcttaccctttgggttcgtaacttgggtctgttttcaaactttcaacttttttgtcacaccaaatgttttaacacatatatggagcattaaatatggacgaaaaaaaccaattgcacagtttgtatgtaaattatgagacgaatattttgaacctaattacgccataagttaataatgtggtgctacagttgtcggtgacatgggaccgggagtatcatgacttagagacttgaggcagacacgatcacccacgtggcctaaccctctcgggggggggggggtcgggcccgagggtgatacggccgcccttctctttgtctccccgaggggtcggaccgctcccgtctcagccccgagggccgaggcgccccgaccccttgtgggtgttgcgccgcgtatatggggtaggtgagcatagcggggctcacctaaccacatttattgcggtttggacgagcgcgtcacgccgcatgtaacgcagtgcagcgcgctcgtttatccggtctgtgatcagtcacagaccagtcaaatcgtgggttaggtggcgacaggcggtctgacgcacgcctcgccccatcccgttaggacgagagcctccaagcactcgtccctagccggagccggcgtgttagctcctagagatggcacattggttccggtcagatatatgccaggcttcatcctaaccattacaagcaagacattgtatgaagaggggcgaacatgcagattgataaactaacgcgtttttgacaagaatgaccgatttgtgaccgggctgacactggtcatgtcgtctgcagacagccatgttcccacgttgcgctgcttctggcggaagtggaggtaggtgtgggccgtcccatcagaaggtcattcggacggcaaccatacaagtctccgtctgtttatgaaaagataggataagtccccacaaaagaaagagagggagagatggtgcatgtggtatccccttgagatataaaaggaggaccttgcccacttagaagaggggaggggaaaaaacgatcccagaacgatcgggggctggcccgcactttgtagcttcttcatacacagatccaccaaaacacaggagtagggtattacgcttctcagcggcccgaacctgtatacatcgcccgtgtcttgtgctttttccattctcgcgaaccttccacacacagacaaggagtttagaacctcacccagggcccccggccgaaccggcaaagggggggcctgcgcggtctcccggtgaggagccccaagctccgtcatctggcgcgccaggtaggggactctgcgtgtgttcttctaagctctcacactctttcgtgtgcgccaagctttttctgttcagcccaa

SEQ ID NO: 33816 - DNA, 1501 bp, Oryza sativa
tatacaggttcgggccgctgagaagcgtaataccctacttctgtgttttggtggatctgtgtatgaagaagctacaaagtgcgggccagcccccgatcgttctgggatcgttttttcccctcccctcttctaagtgggcaaggtcctccttttatatctcaaggggataccacatgcaccatctctccctctctttcttttgtggggacttatcctatcttttcataaacagacggagacttgtatggttgccgtccgaatgaccttctgatgggacggcccacacctacctccacttccgccagaagcaggcgcaacgtgggaacatggctgtctgcagacgacatgaccagtgtcagaccggtcacaaatcggtcattcttgtccaccacgcgttagtttatcaatctgcatgttcgcccctcttcatacaatgtcttgcttgtaatggttaggatgaagcctggcatatatctgaccggaaccaatgtgccatctctaggagctaacacgccggctccggctagggacgagtgcttggaggctctcgtcctaacgggatggggcgaggcgtgcgtcagaccgcctgtcgccacctaacccacgatttgactggtctgtgactgatcacagaccggataaacgagcgcgctgcactgcgttacatgcggcgtgacgcgctcgtccaaaccgcaataaatgtggttaggtgagccccgctatgctcacctaccccatatacgcggcgcaacacccacaaggggtcggggcgcctcggccctcggggctgagacgggagcggtccgacccctcggggagacaaagagaagggcggccgtatcaccctcgggcccgaccccccccccccccgagggggttaggccacgtgggtgatcgtatctgcctcaagtctctaagtcatgatactctcggtcccatgtcaccgacagtagcccccggcgttatgccagggcgatcgccctcctcgagggaagcggtcgggcgtgacgccacttcctaaggcctggtgacaggtgggaccggtctccacagttgggcagaaacccaacggtcgcaaatcacgcacatcggcaatggttactcggctgtcaataatgagcggtctcttcaagactgccacattactcgagtaacacgcgaatcgggacgagccggttcgtttttcctggagatatgatgatggcgcttcggtcggcgagcgtaattaacgcgcgcacgagatgttccatctcgactgccacagccgcatatccacctcatgcaccgcaaacgggcgaatgggattagtggaagtgtgggcgcgagaaacgagggggcagatagagggcgcgagaaacgaggagccgggcatagcgttggcaagggtataaagtcaccgaggaagagatttgcttccttcttttcgccattattccccttgtcttcgccgcttgcgccctgactccttgtttcctgtgccctaccttcgccacacgcgctc

SEQ ID NO: 33817 - DNA, 175 bp, Oryza sativa
ccctttctttaaattgtgataatgtctctctgcttgtggagatttgtggttgaaatgttgaactgtgagtttgtgacgggtaaacgggcatgcccgtgggcacatggcgcctgtgggcaacgggcatgggtagtgttccttgctcgtcatatagtaacgggtatacccgcgggca

SEQ ID NO: 33818 - DNA, 626 bp, Oryza sativa
attataatttattttgttatgagttgttttatcactcatggtactttaagtgtgatttatatcttatacatttgcataaaatttttgaataagacgaatggtcaaacatgtgagaaaaagtcaacggcgtcatctattaaaaaacggagggagtagaaaatagtattggcgatttgtttgaaaattaaaattctcatttttttgtctcgccaatgaagttgaatttggacaagactttttatactgctattgaacgtcatcttatctacatgtgggatttttttccatgtagatttagataacctttactccctccgtcccaaaaaaagtcaaactgcgggtttacgtgccaacgtttgaatgtccgtcttatatgaaatttttttataattagtattttcattgttgttagatgataaaacatgatgaatactttatgcgtgacttctctttttaatttttttcataattttttcaaataagacggatggtcaaacattggacacggaaatcagggttcgtctttttttgggacggagggagtatgtcgtggtttattcgagttttcatggtttccacagtatattttcgcactcaactaacaaatgcactattagcaggggcaa

SEQ ID NO: 33819 - DNA, 1476 bp, Oryza sativa
attcgttcggaaacgtttccccctaaacctcgccggcgcatcaatggcggccggatcttccgcggccgattccccctcccccggccgctctctccccctcccaaccttatataaacgctccccgtgcctccctccaccgtttccgccactcgccgctctctctctccgtcggaatcgagcccgcgccgtcgctctctctctccaccgtcgccgccgagctccggtccgccgccgtcgtcgccccggaccttctcccgcttcggcgtcgccttcttcgggttcgccgcaacctcgccgacctcgtccacctatccgtttcggtcgccaaccgccggaacgccgccgtccccgtcaacctgtgccgcgccgccgccttcctccgctccggtcgctgttcccgtcgtcgccgtcgacccggggtgagccgtggaccgcccatttcgtttcccccttccctcccctctctcggccgccgctccgccatgcctatggccggcgccggcgaccataggggcgcgggcgcgccgcctcccgtcggctgtgccggcgaggccgctttcaggcgcgccccgcggctgccatgtggggcccggccgtcagccgcccgcgccctcgggtgcggctgacgcatgggacccacggcgctggccggtgtgagccgggtgcaaccagtccaccgtggaccgtgaggctgccgcgtgggccccactcccgtggacccggtccgcgcgcccctcccctcggctgacgcaataaatccgattttaaattaaaatttaaatgaagaaattcgcaaatattcaattaaagagcatataaacttcaaatggccataacttggccatttgaactcggaattggaccgttcaagtctctaatttttccctgagaagtcaagaacccatttttgtgctttgtttctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatctttgaacatattgaatcccagtttgtaaaattatgttgatttaaattattgcattatcgctttatttaaattcccgcgttatcactgttttatctagccatgcctatttacctttgttatgaccttattattattgttattgttattattaccttgttcaccctagaataaacaaaaccccaactagtggacactctactcatggtatcactagtatgattttaggtagatgcttcgcgttttaattaggtaacattaggtggtttttcaactctagacgttgggaatattcatatcacctggacactatggaatggtttggttattgtggaattggcttcacaccgccccctctattcaaaatccccaaaatggttttaggctgggctcggggtgcatggttttgatagtagcac

SEQ ID NO: 33820 - DNA, 180 bp, Oryza sativa
attcgttcggaaacgtttccccctaaacctcgccggcgcatcaatggcggccggatcttccgcggccgattccccctcccccggccgctctctccccctcccaaccttatataaacgctccccgtgcctccctccaccgtttccgccactcgccgctctctctctccgtcggaatcgagc

SEQ ID NO: 33821 - DNA, 301 bp, Oryza sativa
tgaacaggggaccgaacggggccgaggggggttcggccgaacccttggtttggccgaaccagggagctcgccgacgggctccagattcgcgcacgggagcccgacaccgtagcaaggggctgcgcccacagtgcattcaccccttccattgtatagtgttccactgggatctattgtttcgccggtgttggctctccgtcaagattgtaggtagagttggaggaggagccaatgtatgggatcaaggacttgccagccattggtgaattggaagtgatggagcaagggaattgagatgaga

SEQ ID NO: 33822 - DNA, 1501 bp, Oryza sativa
ctatcatgcaagtgttgttgtcactgtctaactctatgcagatgtttaggaggagttggatagcttatagatgcagttaccattgtgcctacacagctactagatgtaatgcattgtgggaattagattaattctgaacttctgcagtccattcttaagttctatatagtttactgcctgtgcaacgcataatgtggttttaatgatttgttgctagtaaatagtggaacaggacatctttaatatgccttggaagtaatatcttttcgcttttccaaaaatactatggttaattacttgttgtgtcatatctttaatatgttttcctttcatttctaaagatggcttttaaatctaatgtagactgttctaatcagtctgaagaatgggacacagaggaagactgctgtttttgatgcatcagaactagaattttggtgagtcatttttatatttatcatactcatttatatgctaccattaattggtcataattgatttgatactagtcatcttatgccaaaatgaccagctttgtatttaagaaactagaacatactgaaggtacctaatggcttgcaagatttaaggaaattgtctctgtttcttaaagatgtcctgaaacttaacacatacaaatgtgctcccttgttatctgaagctacatggcatgcttgcgttctttgatctagaaattatttttcctagatatctgaagctacatggtatacatgtattcattttatcttagatgctgaaactctgcacagaaatgtgcttatccagttatctgacagctgcctggcgtgtgttctttttatcttggattcattattgaacctaaacatggcaaaaatattggagcatttgctaaaggtccaagaaaactattgtaattttgcatggctctaatgacttcattccagtacagtgttttaatcggtatgcatgataagagcaatttaccgatgattcatctacttgattacctcatgtgattaatctgattcaagctttttataggcttttttacggtgttgactagtgatttcatttgaatttggagctattcagtaataatattagctaataactaaattgtagcttgctgtaatcttcaagtgacattcattgaattttaaggcaacaatttcaagtccagtgatacagttcaactcaatttgatgattcactttgatgtactaatttgttttgaagaaactttcctaatatattatatcatatcttgtagataattgtagaattgttcttttatggaaagctcagaagacttccttttttcacgtggagcttgctttatgagtggccaccgaaggctgcttccctctattctatggcattatattgggcttgtcacttcaagaattgttggactgatacaagacttgtgtagaaatttgtagtgcataattaaatattgtttttctatgaattatgtaaggactcacgatgttcaatgctaatatatgcttttgtgagt

SEQ ID NO: 33823 - DNA, 522 bp, Oryza sativa
cgatggtgagaggtttttaaccattctattccccatggtgagtagatattaaccatccccgtcacctaataggtgaattcaccacggggaaacggtgaacgggtccccattgccatctctaattgcaactccagttcaaaattttggacccccggggggggcaagtgattattttggctaaaattttcggtttttctcgatttttttaatttgatcaaaatttagtcaaattcagtaaaattaggctaaaatttcaaaaaaatctgtccaaaaagtgttgaaaatcctgaaattttcggtagaaacgaaatgagcgaaatttcggacatactagcttgctaagatactatgccacaaaagttataaggtttattatggttgaaacagtggtgttttagcaaactatgaattcatttgtatggaactccagtaacatacataccctcttttgagcattccatagaattcctttcacacacatgtgcagcttgactagtaacgtgtacaactccgtattaattg

SEQ ID NO: 33824 - DNA, 1501 bp, Oryza sativa
aggactttggcccaattagaggagaaaatgaataagacaatttttttttgtggaattcgcaatattcgaaatctctatctctactgttataaaaattaaagatatttttaccggtactttggtacgtcatccgtgtatgagtcggtttttaagttcgttcgcttttgaaaatacatgtccatatttgagtcagtttttaaattcgttcgtttttgaaaatacagaaggagtcgtataagaaatctctttaaaaaaactcgtatgcttatttgtaacgatcagactcctaaccacagctcatgatttaaaaaaaatacatcaaagcgaattgccacaatgaatttcaccttagttaaaccatttaacaataataaaattaaaatagccttcacccgttgcaacgcacgtgcattttttctagtagaaataaaatatttgtgaaatgtgtcaggtttaaacttccatgaaaaattatatttgttttgcagaaaatagaaggaactcttcataaataatgttagcatttcacaaacttaaatttatactatgatacagtggagccgacctaggattttgaggttgcccttcgacaactagatcgcaaaaccgattcaaaatccatagccgtattttttttacaactgaaagtctaatacttggcatgtgcaaattgccaaagtagatcatcaaacttgtgcggattggttaattagagaagagaggatggagcccggccggccggcataagaagatggatttatttgcttctttggttgaataggcttttttttcatacacaaacgaatcacatactccctccgtcttaaaaaaacgaatctataactagatgtgacatattctagttcagtgaatctggacagagatatgttcagattcgtagtactagaatgagtcatatccagtagtagattggttttttatgggacggagggagtatcgcatatactaattttttttataaaaaaccttaggtatacaatgatacctttggatctaattgggcaagcccctatgttacacaacattcatcgttcgttctagcttcaatttgtcggacggctggaacctacgaaatcacatttatctatatactcctatgcatctagttagtgtagtttatcatttcgcctatcttttgtcatgcaatattattagattaattatttatttatcatagcttctatcatttttcttaaccgtgttaataaagtggctgacctggcactactggaaaatcatttttttgtgactgccccacagatttcgtgatggcgatgtaaacacagtcaccaagaagacatatcatgacaggcattagaacaccatcacgaaattgggtgtttcgtgactaggaagagcagccagtcaccgagttatagagttggtgacggtgcagtaatataaagccctcaccatactgtgtgatggacttaaatgggccaagctgctctgcctctgtctgaaattgtgaaccactaaa

SEQ ID NO: 33825 - DNA, 255 bp, Oryza sativa
attgcgcttattcttctccgtatcgtcattgactttgtctacaactagttattgtacttgcatcctataaccacttactccggagcaagattattgcaacaagtacttgtcaggcccaacttgcctttgtaatgtccagaatcttgataaatttattccgtatatatagcgcccctacgccggccggcccggcgactgtatattaatatacagtcagtcaatggtttcaccaatacatactgacgtttcccaagg

SEQ ID NO: 33826 - DNA, 1501 bp, Oryza sativa
ctctggggtgagagccgccgccgcctctcccttcatcgatctccgatctctatctctctctccgtcgcgccgctcgccacgagacgccgcgccacgacgacgccgcgccacgccgacgccacgccacgcaggcgctggcacgccacgccaccgacttcgccgccgcgcgcgcaacgccaccgccgccacgccatgccgcatcttcgccgccgcgcaatgccgccgcggcatgcaacaccgcgctgccaccgccgtcgccaagccgccaccgccgccgccgccgccgtcgccaccacgccgccatgccaagcgccggcccgatgccgtcacaccgccgttaacgaacacatgaacgagaacgaacacgttaacgtacgttgccgcgagaacgtgaacgagaacgagaacgatcgaacgaacgagagcgacaacgagaacgatcgaacgaattaacgtgacgagaatgacaacgaacgtgaacgagaacgaacgtgaatgaaaacgagcgaacgaacgtgaatgtgaaatgcaatatatatatgttactttgcatttatcctaatacatattttttgtatcttgcagaaaagacgtgttgtcggagtcgtccctcaagctgggagtggaagagctagccctagaaggaattcgtgcaggcaagtgacgtaataatataaatgattgttatatttgtaatgcaattaagaatattagacttgtaattatacttagcatataagattgtgtagtgttctaatattatttgagttttaatataagattattttattgcaaattagacttagtatgtaatttttgactacggaattggtgcgactcctagcaattgactattgtagtcttaattagacttagcatatacgcatgaaacacttagcatacatgactattttagtcttagcatgtaatattatttgagttttaatataagattattttatttgtaattagacttagtatataattattgactacggaattggtgcgactcctagcaatttacaattttagtcttaattagacttagcatatacgacagttacacttagtatacatgactctttcagtcttagcatgtaatattatttgagttttaatataagattactttatttgtaattagaattagtatgtaattattgagtacggaattggtgcgactcctagcaattgactattgtagtcttaattagacttagcatatacgcacggaacacttagcatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttaaattgttaaaacataaatgtctcgtgacttaccagatgtt

SEQ ID NO: 33827 - DNA, 243 bp, Oryza sativa
atagtccatagtttatactatatattgcatcccctgtttttgcatgaccaagtcatggacaactggacaagttgtcaactagtcgacaagtcggtccaggggtacctcgacttgactttacgacttgacaaccatgattgttgcacgtgtacccactatctgtatgactgcttgtatattagggttggtttggttctgtaccttgccaaaatcttggtattgccacatttcggtagtgtagaa

SEQ ID NO: 33828 - DNA, 1167 bp, Oryza sativa
atgccgacgacgtacgtcgttttgtatgttttctatgaactaataactcaattgatggagtattccattatcgaaaaaaaaatcaattgatggacattaagaactgattcaatttgatagctttccatgcaccgaaacctaataaacacttaaatacattgtatgccgtcatcgtctcatatatagatggctcatttcgccttcgaattgagaagctagttgccaagaaattaattaacctgtgcgcagtggtgattttgctacgtgttacatggtgcggacactggtggagaaaccatctttcgtcggtcggccgatttccacaatagtcccggatgcaataaaaaccagggttaaagatgatctttagtcccggttcaaaagggtaacgggcatatttgatctttagtcctggttggtaacaccaaccgggactaaagatcatctttagtcccggttcgaatgctgttagggcatgttaggcccccccgggatctttagtcccggtccgggactaaagatcgtaactttagccctagttggtattaccaaccggggctaaagatcctggtgatctttagccccggttggtgctactaaccgggacaaaagtcccacccctatatatatgtcttcttcctcctccagctgcccgagcaagcttcaaaatttcttcaaaaaagaggggaggtcatgccaaaaattctattgaatttattttggtgattacatacaaatcggaggtgcctaaaaggtttgcaacttattcctccaatgttttttttgtcatactacatttgcacctatgtttttcacacttttttttgtctccaaaatttaattgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttaaaaatagtttttaagaattatttggtgtaatattttatgatttttgtatgaataaagatatcttataattattgtatgactgtcattattgtaagaataattatttgtgtacggttttttttgactcatgtaga

SEQ ID NO: 33829 - DNA, 533 bp, Oryza sativa
atgttgttttttcaagacgaagggaacacatattacatcgacactgccaccggcgctgcagctgttcagtggcatcctggcctagtgctgctgctgttacacttcagtagctacagaggcggatccaacaataaaatagaaaagtttgtgtgggtggggaggaggtgggggctgaacatattaagctaaaccggctgactggcaccaggtcacatacctcggagatggattattgtcgtccaaaaaatcattagtaagatagattaatgctacgtccatcctaaaatataatactctatgtcactttgatttttttcctggtcaaacttaattaaatgtgataatccaagaaatgcaattgacaaatgtcaaaatccaagaaatgctattgacaagtgtgtgtccaaaaaatgccatcgtcattagggttccgtccaatctgcgcctgttgacgtttgatgtctcgactacggtatttggacagtatggggatcgtcggtgctagggtatacgcgagactgaggtaaaagaga

SEQ ID NO: 33830 - DNA, 377 bp, Oryza sativa
ctggatctggacaaggaatacggaatgaagagatggtgtacccgccgagatagaatttcttgacttcaatccaaattctcgattacagcaagacatgagacttagtcgtacactctgtactttcttggttgacatcagagattgactcagacaaaccctttaggtacccgcacgaggctgacaaaggaagtctaacgttatctctgaactcaccgagaacggtcacatgagctagataacagttactccaaggtctgcgcgtggttgagaatatgaattcgttcatttgcattgaagtcgggggttactgtcagggttatggatacaaaatacctaatagtagttgactacatctcggcaggacccaccacatacca

SEQ ID NO: 33831 - DNA, 1501 bp, Oryza sativa
aatggatttttcgtgactgcccctcactctcacgaaaagtcaaaagcctgtcacaaagatctttggttaccacatactgtcacaaaatgtcagtcacgcttgattagtcacgaaatctaatatttggtgaggggaagcagtcacaagctgttaagtgactgtcaagcagtcacgaaaaagcaattcccccaatttgcatgttttgaccatttttctaacagttttgattaaccgttgggaatactttttcgtgaaggtggtagctgtcacagaacatcaatttcttgacagacttttgccattaggaaatacctttcgtgactgggtggctgtcacgagacacgcgatgtgcacgtaattaatatgaaaattcatgtaaatcaatctcatatgctacaaagtgagttcagatataatacaacaaaatcacttattttacccaagtccaaattcaaactcacaaaagcatatattagcattgaacatcgtgagtccttacataattcatagaaaaacaatatttaattatgcactacaaatttctacacaagtcttgtatcagtccaacaattcttgaagtgacaagcccaatataatgccatagaatagagggaagcagccttcggtggccactcataaagcaagctccacgtgaaaaaaggaagtcttctgagctttccataaaagaacaattctacaattatctacaagatatgatataatatattaggaaagtttcttcaaaacaaattagtacatcaaagtgaatcatcaaattgagttgaactgtatcactggacttgaaattgttgccttaaaattcaatgaatgtcacttgaagattacagcaagctacaatttagttattagctaatattattactgaatagctccaaattcaaatgaaatcactagtcaacaccgtaaaaaagcctataaaaagcttgaatcagattaatcacatgaggtaatcaagtagatgaatcatcggtaaattgctcttatcatgcataccgattaaaacactgtactggaatgaagtcattagagccatgcaaaattacaatagttttcttggacctttagcaaatgctccaatatttttgccatgtttaggttcaataatgaatccaagataaaaagaacacacgccaggcagctgtcagataactggataagcacatttctgtgcagagtttcagcatctaagataaaatgaatacatgtataccatgtagcttcagatatctaggaaaaataatttctagatcaaagaacgcaagcatgccatgtagcttcagataacaagggagcacatttgtatgtgttaagtttcaggacatctttaagaaacagagacaatttccttaaatcttgcaagccattaggtaccttcagtatgttctagtttcttaaatacaaagctggtcattttggcataagatgactagtatcaaatcaattatgaccaattaatggtagcatataaatgagtatgata

SEQ ID NO: 33832 - DNA, 1501 bp, Oryza sativa
gaggatgatttttgcagacgcgaccagttatgatccatatgcaatctaaagaggtcattgtatagaaaactcgtttatttgaagtagtgatctgtagactgctttggagtgcgggagtaggatgttcatcagtaccaatttttatttctcataagtttgagaaatttgtagcgtttcaaaggaggccagatgtacaattgaatctatctacaaaacttttaaagctttctacaaaacttttagggcgccaaaagaattgtggatttatttaatttactgaactttaaccatgacaatggctagcattcttcagttgactctgcatatcccaccatatctatccagcacatgcaacttctgaatgccgaggacacgtggcaacgcacacatggtagagtacacactaattagccagctggtcttatatatagaatgtcttcccatccagtgacagacatataactgactatacataactaactagctagctgagaccatctatcaaccccataaacagatccaaactaaatcatgaagaattcagcacaagatcacattgcaataggtgacaaaagaccagatgatgggaggcacatggctgatggctgtcatattacatggctaggacaagccatgtggctctgttgattaggattaataaggacaacagaaacttatgagtactctagctaccttgtaatcattttatttcaaatattctttgtgtgtgaacagcaaataaaatttgtatggactatcttgggtgtactgtactccgatactttcatgattagctaattcataaactcatatcatgtactacagtaaatcaaatattggctttcgaattgtaactgaaggctatgttgaaattttttgaaattgagagaacaccctgtaaccccttctcctctcactccctttatcttcaccccatatatttatattgttctgcttcttttaaatattctgtctttttttattacaatacaaacagcaggggctccctgctgtgtttctctaaaaaaaaaattgagcatatatcaatatactactaactaggtgacaaaattaagcgcatgctttaataaaacattggcaatatatttacatatacttccctggtaaatacaagaaaatgtctatatttggttcacaaatggttctcacgtggtttatttttctttctgcaactctagtgttggatatataattaatgtgttctctaatctattaaaatcatctactccctccttgctataatataagggattatattttattttaaaagttaaaaaaagcaaaaggacggggcatagtaaaggttatggtggtgaaataaagtagtagaaaacttgtaggtggaaggataaaccagtaagaaagtaatgggtaggaaggataaactagtaaaaaagtgatgggtacaataaaccagaaaactcgtaggttaagtattgtattggaattacaaaaactcttatattatgagataaatttg

SEQ ID NO: 33833 - DNA, 216 bp, Oryza sativa
gggtgatgtagtggtgggggtgatggatccggaaggaaggggatcggagagagataattgagctcaacgggagcgggtggaacggaagatagcaatgggccgggccgggccgtgccggaccttgtccagagtgattttgttttttactgtgcccgtgcgttgcaacgggtaaaggtaattttaatcatttatacagatgggaaaaaaatataaagg

SEQ ID NO: 33834 - DNA, 333 bp, Oryza sativa
gggtgatcggttttgcatagttaatggacctcatatatctggttttgtggtttgaggacgtttttgtaactcgatgacaaattgagggaccttcggtgtactttttccatattttgggctagcgagatcgcttatggctccttttgtagcccaatccccgggaggaaggccagcgggagaaaattcaacgggccaaatcttcttgtccatttggaagcctacaaggtgggaattttatggcccaatccgcacagaatcgtgaggtcaagaaaatttcctctagctcgatacattgcgccaccgcttctccatctcgcgattgcgagcagacga

SEQ ID NO: 33835 - DNA, 404 bp, Oryza sativa
cgggcataaatagaagcccgacacccataagagtcatcggtgacgggctccaaagaaggcccgattgagatggccttaatgcccgtcaccgatgactcttataggtgtcgggcttctatttatgcccgttagagattagtgtgcgcccgttagagatgacatttttttttggcccgattgagatatactttgcacactatatatactccagcagtccgttgtctgtagtttatcccgctcttcactattttggtgggaggtttaagggggcgaatttttgtattttttttgcaaccaaaaacaggaaagtcataaaagtaagtaaaagagtactaaacatttcctattaatttagtagtacttatgttatgagatgttaactaatattttgttcattgttcagt

SEQ ID NO: 33836 - DNA, 338 bp, Oryza sativa
ctgtcttacatattatttctatttattattatcataccaaacttctgcagcaacgcgtaggggtttcatctagtatttattatttttgttacaacttgtatgagtcaaaccgtgtattatttgtcaaattttcgtgtaactgtgacatgtaagaaataaggtgacatcgatctgtcgagtgattgcatgagtcccattaattaattcctatatctgtatgtctccattactgttgtgagacttgacgtcaaccggtagcagtgtcttctgaacaaacggtatgtagaaagcctccttccctaatatgagtatcacgacgaccggagtgcaggcgccga

SEQ ID NO: 33837 - DNA, 432 bp, Oryza sativa
ctttttatgtgcatcataataattcccaagaattattgaatcgtgttaaaaaggattttaacagcattgggccacaccattgtgaacacaaatcgccaaagcaaaaagtgcctaagtccctagggatcacaacaggccacgctgattatagtattgggctgaagtactgtacaggcccaggcccattagtactcccgataccctaataataccgaagtgaaactcgtctcttcgtcttccccgccgagactctcgccattttccccatttcctgctacagtgcaaaactgcgccggccaaactagggttcatcaatccgctccaatccctcctcaaaatcttcacgaaatttctccccgtatccaccgctcaaattccccatccctttccagccgtatctcgaactaaatcagaccatccagttcacattca

SEQ ID NO: 33838 - DNA, 199 bp, Oryza sativa
ttgacaatactcttatccaaaacaataagtataatcaacctggagtaatgtttatagacaaaaatgttttatttgcacaataatgatcaagaaatttctttgtactaaacaaagtggattttccttttttttaaaaaatctaacactgtattggatcaactgattcaacaccatcatacacctatttgctctggacagg

SEQ ID NO: 33839 - DNA, 633 bp, Oryza sativa
actgcttaaaagatagtatttgaactgaacaaaaaactattttttttgtgtgaaattcactgttaaatggacctcatcattgcaactaggttctgacttgctgacatctctcctgcacacaacggtccatttccctgcatttcttctccaacttttgtctctaaattcatcccatccaatcgcaattactggcaactgttcagatcaacatgttcacaggatcaatgcaattcctgttgcgatgcaatgccgcaattactgaacacatttagatcaccatcagtggtctgctgtactaatactgaacctgggtatccggcaaccggtgaacatacaggccggcgtcagttactggaccactggctctcctctgagcagcagttactaaggatgcagatatcagtagcatccatccatccatctattgctgcaggaactgatactttctggcttagctagcattagcaattggaatagtagggaccagatttggtagtaacagtagttaggagatttggtaataacaatggtttgatatgcagtaatttgttttgttgcttgctctcgtactttctaatggattctgtcattctggggtgtaatgtaatggaaatgcgtttcttgttttgtgaa

SEQ ID NO: 33840 - DNA, 468 bp, Oryza sativa
atcggcatcggctcgaagataaatgatatgccatcggcaactagccgatcggctatcgtatatggatttaaccgggggtttcttgtctttctttcttgtgattacaggatcaaatcaactagcacgctcacgaacctaaaagcaagattttggacctgcactgaagttaagtagatcttctaggccagtgtgtgtttttcacatcaacagttgtgaagtcatcccttctttcttccagctgcgcgcttttcaaactgttaaacggtatggtttttacaaaaaaatatatatatatatacaaaagttgctttagaaaatatattaatctatttttttaaaaaaagataatattaaattaatcatgtgctaatgagttgtttcattttgcgtgctagggagattagctcccaaccccatggaaggaacataggcggttcattttacttttagaactgtagatctaattta

SEQ ID NO: 33841 - DNA, 350 bp, Oryza sativa
cgctaggatcgcctttttccactgctgctgcttttgtttcggtgtgaggactaagtgcatcttctgtaagtattttacgctttatttacgtttggaactgtatattacttattgttttgtgtaccctggctggtcctggacagggatttaatacacaaaatagtctggaaatttgggctaaatttctgggcgtgacactagcccaggttcagccgaggttcggccgaaccacaatctcagccatccaggctggggtttggcgtggacggtcttgatcatctcctgatggcggttgcggggcatttccgacaattcgcattgtataaccgtcatacctacccctaaatagg

SEQ ID NO: 33842 - DNA, 343 bp, Oryza sativa
ctcttcatttaatctcttccaagtaggaaaatatgctgatatggatctcttgtagagagcctatagataaccattgcaggtgccctaaggggtgttcaattagttcgaaacggtagatgaaaaagctagtggttgattagcccggtagaagtcattcgcgtatgtcgctagattgactttgtggcagcactgtctctgctttcctgggcataattggaggttccctgaagtggaccggtacgataaagaagggtagttacagtaaaaaaatcggctggtctctcatcatgcctagccttttcagcgacggcgtcgtcactgatgagttgatttcattcgtagt

SEQ ID NO: 33843 - DNA, 1501 bp, Oryza sativa
  unsure (1)..(1501): unsure at all n locations
ccccacttttccctctctctctccccggaattagtacgaaaagtttccccctaacttcgacggcgcatcaatggcggccggatcttccgcaggcgattcccctcatccggctctcttctccccctccggaccctatataaacgctccccgtgcctcctnccaccatttccgccactcgccgctctctctcccgtcggaatagagctcgcgccgtcgcccctctctttccgcggtcgccgccgagctccggtccgccgccgtcgtcgccccggactttctcccgcttcggcgtcgctttcttcgggttcgccgcaacctcgccgacctcgtccacctctccgtttcggtcgccgaccgccggaacgccgccgtcctcttctacccgagccgcgccgccgccttcctccgctccggtcgccgtttccgccgtcgccgtcgaaccggggtgagccgtgaaccgcccatttcgtttccctctcccctcccctctctcggccgccgctccgccgtgcctatggccgccgccggcgaccataggggcgcgggcgcgccgcctcccgtcggctgtgccggcgaggccgccttcgggcgcgccccgcggctgccatgtggggcccggccgtcagccgcccgagccctcgggtgcggctgacgcgtgggacccacggcgccggccggtgtgagccgcgtgcacccggtccaccgtggaccgagaggctgctgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttaaactcggaattggaccgttcaagtctctaatttttccttaagaagtcaagaacccatttttgtgctttgtttctgcttgttatatggagtttgttagagtaaaagccttttcttttccgttggtcgtgtagacgctgcagcttcggaagatccgctcttcgtggaagttgaagccggcgtttgggaaagcgagcaaggcaagtcacatgatctttgaacatattgaatcccagtttataaaattatgttgatttaaattattgcattatcgctttatttaaattcccgcgttatcactgttttatttagccatgcctatttacctttgttacgaccttattattattgttattgttattatttccttgttcacactagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcac

SEQ ID NO: 33844 - DNA, 339 bp, Oryza sativa
ttgtaaatttgttttattttgaatttgatttgaaatttcagtttaagttctcaattgccatataatataccactttaatatttttttccaaattcaaaaaaattgcaatttaaacatatcttttgaagatagtatcagagacaaacagaaaagaaaaaaaataaagagtgagagagagaagaaaaagaagaagaaaaagaaaaaaatggttttttttttctctcgactattcactcttattctttacaaaatgacagtttcgtttgtaaatttaaagagtgtgagagagaagaaaaagaagaaaaaaagaagaagaaacagaaaaaaaaaagggagaga

SEQ ID NO: 33845 - DNA, 367 bp, Oryza sativa
aaatagctgactactagtctaaaaaagccagagaatctaaatatgagttagcagctctaaattaccaaaatattagtcatgcttgtaataataatacttgtcctacaaagcaacttatgcaagctactccttggaaagacaattgtgtatctcttgtgcacattttccttctaatgtttaaataaaaaattactaagttgtaaaaacactgtttttagagcacatggcaaaccgcttttctgcagaccgaggagtaaaaagactatcactgacagatgggacccaccaaccattgtctctcactctctcccctcgcaccgcagcttctccaatccgtcactttccccatccctcccgcgaaaagcag

SEQ ID NO: 33846 - DNA, 902 bp, Oryza sativa
ttcctgcagccctggccaagtggaggaaggtaggaggcagtggactgggctagggctaaaaagtaaaaagaatgagctttcggcccaaaaccaaggatgaattttgattaactttttcaattataatgtatgtagggatcccaatattacaggaagaaaaccctttacctatcgattttgctatatatttgtcgacaaatttttccccaaaaatttgacagatgtaattacagtataatcgtagtgtaattacactgtaacttgcatgtaattatactgtaactatagtataacttgtatgtaactttcaaaaatctctccgtaacatgttatttcggtaaaatggaggtcgtgggaacaaattatttcacatatgtgtgtgctatgatttattttcttcctcaccaaaacaaatcttgtaatagatctaacgattcaaaattatgtgtagttacatgcaagttacagtgtaattacatataagttacagtgtaattacactataattgtactataattatatctgttaaatttttggggaaaaatttgtcgacaaatgtatatgtagtctcatgcgagtacttttctaagattaaactggtaatagctaaaaagttaagattaatttcatttattcaacacaagaaaggaaaaaaaacgtgtagaagccatcgtctctctcttccctagcaacaacaactcattcctcgcttgctggctgctgctccgtcgcctttcccatctccaaccaccactccactccacctcctcctcctccgccgctgccgccgcgcagatccgcgggcaaggggctacggtgcggcggcgccgccctgcacccccacgccgccctccgcaccgcgcgcgcatccagcagtcggaagagttggaggaggagggga

SEQ ID NO: 33847 - DNA, 153 bp, Oryza sativa
aaacataccattagtataattacatcgcaacccagtaggattagaaagggtatgtataacccacataatttttgcaactacaagatgtttcttaagagtgatcaatgagcaacattagttttttacaacatacacctttgtcatctcgcagat

SEQ ID NO: 33848 - DNA, 1396 bp, Oryza sativa
gccaaaaaaaacgctcccggtgcctccctccaccatttccggccattgcaggctctctttccccgtggaaaaaaagctggggcagtggcccttttctttctgccgttgccacgaagtccaggtccccccccggtgttcgcccgggaccttctcccgtttggggttcgccttcttggggtttacagaaccctagcagacctggtccacctttcggtttgggtcgccgaacggcggaaccccgccgtcctcttctacccaagccggtccagccgccttcatcagctcggttgccggtttccgcggtcgccgtcgaaccggggtgagccgtggcccgcccatttcgtttccctctcccctcccttttttcggccgccgttcctccgtgcctatgtccgccgccggcgaccataggggcgcgggcgcgccgcctcccgtcggctgtgccggcaagaccgctttcgggcgcgccccgcggctgccatgtggggcccggccgtcagccgcccgagccttcgggtgcggttgacgcgtgggacccacggcgccggccggtgtaatccgcgtgcacccggtccaccgtggaccgagagtctgctgcgtgggccccactcccgtggacccggtccgcgcgctcctcccttcggctgacgcaataaatccgattttaaattaaaatttaaatgaagaaattcgcaaatatccatttaaagagcatataaacttcaaatggccataacttggccatttaaactcggaattggaccgtccaagtctctaatttttccttaagaagtcaagaacccatttttgtgctttgtttctgcttgttatatggagtttgttagagtaaaagccttttcttttccgttggtcgtgtagacgctgcagcttcggaagatccgctcttcgtggaagttgaagccggcgtttgggaaagcgagcaaggcaagtcacatgatctttgaacatattgaatcccagtttataaaattatgttgatttaaattattgcattatcgctttatttaaattcccgcgttatcactgttttatttagccatgcctatttacctttgttacgaccttattattattgttattgttattatttccttgttcacactagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggt

SEQ ID NO: 33849 - DNA, 1501 bp, Oryza sativa
acccgaccatgggtcccagctcgtcccaagccaccccaggccaaccattccacattttagttgttaagcaggttttaagaattaaaacactaacttgggtacattgcacggcttgcccataaccgagggcgcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacccccgggacaggcaggcaggactgaacccctagcagcaggacaccggccctgtgccatgacatctcgactaccgggccgcagctcgtatagccttcatttgtcctagagatgtccatcgacccccgacttcttccatctccatccgtgtacttttgtttataactagactgagtcacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaatttcacaataaccaaaccattccatagtgtccaggtgatacgaacattcccaaagtctagagttgtaaaaccgcctaatgttacctaattaaaagcgaagcatctacctaaaatcatactagtgataccatgagtagagtgtccactagttggggttttgtttattctagtgtgaacaaggaaataataacaataacaataataataaggtcgtaacaaaggtaaataggcatggctaaataaaacagtgataacgcgggaatttaaataaagcgataatgcaataatttaaatcaacataattttataaactgggattcaatatgttcaaagatcatgtgacttgccttgctcgctttcccaaacgccggcttcaacttccacgaagagcggatcttccgaagctgcagcgtctacacgaccaacggaaaagaaaaggcttttactctaacaaactccatataacaagcagaaacaaagcacaaaaatgggttcttgacttcttaaggaaaaattagagacttggacggtccaattccgagtttaaatggccaagttatggccatttgaagtttatatgctctttaaatggatatttgcgaatttcttcatttaaattttaatttaaaatcggatttattgcgtcagccgaagggaggagcgcgcggaccgggtccacgggagtggggcccacgcagcagactctcggtccacggtggaccgggtgcacgcggattacaccggccggcgccgtgggtcccacgcgtcaaccgcacccgaaggctcgggcggctgacggccgggccccacatggcagccgcggggcgcgcccgaaagcggtct

SEQ ID NO: 33850 - DNA, 457 bp, Oryza sativa
tcctgcagcccctatgtagtaagatgtattcatctattgtcccagataagaacttaatgatggacacacaaaaatcggcacaacaatgattagaacccagtgaataaacatactaacatgatcctcatgcagaggaataactgaaggccaaccgggaaatttcaagaagcaaaattgtgcctaaggttaccatatgattgtctttgagctttctaacaaggtaacaattcagcagcaataattatcacggtcattacactagatcacaacaatttttaattttccaaatacatagaagaatcaccttagcaggtttatctccatcaaggcaactgttagtatgcaccagccggagctcttcacttaagtcagaaatatttgatccacacaaagggcattgcacttcacaagatgaattaaaactcccacaatccattccattcccttcaaggcaagc

SEQ ID NO: 33851 - DNA, 1501 bp, Oryza sativa
atttaggtggtccaaagtgaaaagattgttctatccctggtccaaattgacacgatggtaaagcaaggtggctcaaagtgcaatttgctcttgattttattagctgagaccacggtgcactgtggggaattgaaatatgtgatgcgtggcttcattcactttttttttgtctatgtagagcacatgtccacatgaaaaaaagtggatgcattgctaatgcacttatgagtgagaggggcataggcaagatggacatttcgcgttccattgccaccttggttggtggtgtggcagccggggccctgaaattgggtgtaaaatggcatattagagctgatttgtggggaccggggggcaaattatctaagttatttagaaagatggcatttaggaatgctacatcgaagtgaatgcaaatagtccaaaatctcggttaagttaggcgattagcatcagacattcagaatttcggactgaaacctttataaaccaaaactgcaaagttcctacattggatttatagttaacaaagtttatagtcaataaaatgtcaaagtgaggagcctagtggtatttgagtttttctattagtgaatacaccacttccattcctttttctttgaagtttttaaatctaatatacaactttgaccattgttatcatattaaaatttagtaataaaattacaatgtcataattaatataaatccaatgacataatcctcatggacaccgccgtagggccaatcgccccacccttgacatcactgaagctcgattcacaccaccgaagtcgatatggtgccgtgggaggggaatgggatgggagggggcaaagggaggtggctccaatagagatagaggggaaaggtgtcgccggtgaagggagaaaacggcgggtctgagaggggaggagaggtgtcgctatcggagaagagaggagagacgatattatcgtggacggagatggagacgcattgcacagtaggggagagagagagagcacgcgatcgatcgatcccgcaccctgtaatcctgtatgcgtgggagggagagaaaaagaaagggaaaaggtaacacgtctccctcaacagtaaaaccgagtggctgagggaagcgattcaatgagagcaagctatggagaggcaacatagacttttttcccaggttaaaaccaaacctgggccgtgagtaatgctacaatcctatacaggcccatatttgaaatcagtaaattcttatattgggccgctaccgacagaagcggtccctaccaagctttcgcgtttcttcccacaaataggcgcgcaccttttcccttttcaaaatttctccccccgaaaatttccatttcgcgctccctcgcctcgttccccttccacttccactcccagatgccggcgaaccccaagctcgcggcgaagccctcgccgtcgccgccgaccgccgccgcagccgcctcccggccgaaagccacagccaaacctcccctcggtgccg

SEQ ID NO: 33852 - DNA, 354 bp, Oryza sativa
atggcgagctcgccctggccgttctcgctactcagtcgcgcgagttaacttttctccgcatgaagtcacacactcatcgtgcaaactcgtgatgacatcactaacacgttatgaatttgctcactcactttacgaactcactgcgagttcgtattcccgctgtgcgacaatggtatatttctgccaattccttctaaaaatatgtatattcctgtaaaatcggtgaaagaaatgtataattttaatttattttccgttatttagttagcctcctaccgtgccatgtcaaccatttaggggcgggagcatgtgaattttgagtctaacagttaacaatccgcattgcaaagaagg

SEQ ID NO: 33853 - DNA, 567 bp, Oryza sativa
  unsure (1)..(567): unsure at all n locations
gatgcgtgtcatgcgtaccgcaagtagttcatcaccggatcttccgcaggcgattccccctcatccggcctctctctccccctcccgaccctatataaacgctccccgtgcctccctccaccatttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctattcgtttcggtcgccgaccgccggaacgccgncgtcctcctctacccgagccgcgccgncgccttccttcgctccggtcgccgttttcgccgtcgccgtcgaaccggggtgagccgtggaccgcccatttcgtttccctctcccctcccctatttcggccgccgttccgccgtgcctatggcccgccgccggcgaccataggggcgcgggcgcgccgcctcccgtcgactgtgccggcgaggccgccttcgggcgcgccccgcggctgcca

SEQ ID NO: 33854 - DNA, 1482 bp, Oryza sativa
  unsure (1)..(1482): unsure at all n locations
gatgcgtgtcatgcgtaccgcaagtagttcatcaccggatcttccgcaggcgattccccctcatccggcctctctctccccctcccgaccctatataaacgctccccgtgcctccctccaccatttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctattcgtttcggtcgccgaccgccggaacgccgncgtcctcctctacccgagccgcgccgncgccttccttcgctccggtcgccgttttcgccgtcgccgtcgaaccggggtgagccgtggaccgcccatttcgtttccctctcccctcccctatttcggccgccgttccgccgtgcctatggcccgccgccggcgaccataggggcgcgggcgcgccgcctcccgtcgactgtgccggcgaggccgccttcgggcgcgccccgcggctgccatgtggggcccggccgtcagccgcccgagccctcgggtgcggctgacgcgtgggacccacggcgccggcccgtgtgagccgcgtgcacccggtccaccgtggacccagaggctgctgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttaaactcggaattggaccgttcaagtctctaatttttccttaagaagtcaagaacccatttttgtgctttgtttctgcttgttatatggagtttgttagagtaaaagccttttcttttccgttggtcgtgtagacgctgcagcttcggaagatccgctcttcgtggaagttgaagccggcgtttgggaaagcgagcaaggcaagtcacatgatctttgaacatattgaatcccagtttataaaattatgttgatttaaattattgcattatcgctttatttaaattcccgcgttatcactgttttatttagccatgcctatttacctttgttacgaccttattattattgttattgttattatttccttgttcacactagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggt

SEQ ID NO: 33855 - DNA, 1501 bp, Oryza sativa
gaatctaaagaaaatctgatgatattatactatatgagtttttaaaagttaatggttaaagatgaaaatatttgacttcagatgaactagagtgtaagaaaatttgaaataaaggagtacacgaaaccaaaacacacattgaacaaggacggtccagtggactcttgcccgagaaaactccaaatgctgtacatagtggcttaatggtaatttacctcgtagcaaatggccacattggggttcagaaaaatgtcgtcagcaggcccctcgaccagctacaattgtatatcacttggcctctggccagattggtggagaaaggcaagttctcaggctgcagaggaagcagagctccaatctgttcatgccaatggctgctggcacctgggtgaaggtaatttctcttgcttactcatacatatgcaattgattgtgtactcccttgatctataccttttcataagaaaggtttggttcagttttgggggaatttttttggctgagatttgttcatgttgcaagagtatttggctatttgctgcttcgagtgatggttatggacatggattagttgggaattggggcttgtttctgaaggttgttcatatattttggggagggttgtggattgaccctgctaggatgaaactttgttctaacccaagaattttgacatttggggattttttttttctagagcagatcactaaggaatcagaacatgaggcttagaatttttgtttttaaggaattagacttcgaaaattgagtagcatgttcagaagctagggatttcagattataaaaggttggggtttaattagcgaagaagtttcaggttgtgatgctatgctgcggtgttgattgggtaacagtgacggattgatagccatggacatgaaaatgagttgggaacttgggttttatgttggtgatagtaactgtttgaagattatataaagggtcaaatatcttcggtgtatcttgttgattccagttttccaaggtttgttgacaatgaagattattcgggagggcgttgtcagaatccatttcagtttcagctctctggagttgaccaagggattttgattccaaatttccagggcgatagcaaaatgctgacttcaaatttatgtgtcaataacatttccagtcagttttgagaagtacaatttgtgttattcaggtgtttctgaaaactgtcgactgtcttcaatatcagatgcacaaagaaaccctggaaatgcagaaattcgggccattaggctcatgaacatatgcaaataaaaagcgccgccacatatagacatccacatattagatgtcacttaaactaattagtgaattcctggaaattttatagaaattacaatcctgtatagaacgcaagaatttcatagcaaatactaataatcttcgaacacaaattgctcagcgagagagtagtaattttctttgcagattgcagcatccagttttgtctaatttgattagtaat

SEQ ID NO: 33856 - DNA, 260 bp, Oryza sativa
agtagttattagattgcgtagacgcggtgtctgggtaagaatttctagtggttgctgcgtatcccacagttcgattgaggtaggtgtagaggtggtgacagccctcaagagcacttaagtcctctctgtccaggtacatactatagcgacatctgggaatagcggattgccagtgcctgaagtattacgttaagattaaagttaagctttccctagacattgtttctcaccagtaaatcctctctatcctggcctatcat

SEQ ID NO: 33857 - DNA, 170 bp, Oryza sativa
tcaccttgctgcagaaaatcgtggcaaagaattgggggggctttggcaatctgacgcgcacagaggaaaggagagagttagaaattttgattcccttcagatctggacaaagtactcttctttttctacttacctgctagctctcacggtcagagctacgctctaacaga

SEQ ID NO: 33858 - DNA, 179 bp, Oryza sativa
atttgcaccggcattttcttaggctggtttataaattcaattttaggcttaggaggagaacttcagggtgtgacacctggtatggccggtctgaccggttctaggcagagcgctggagggcacgtttcaatcaattttaaggccgaattaattgtgaattcggacatttgtgcccaaga

SEQ ID NO: 33859 - DNA, 167 bp, Oryza sativa
agagcaacttcacataaatgatgtgtagtattaagatgagctaggggattaagcaagtaatatacctcatagaaaaaggcaacagatacacggtaacgaggggaattgttaacaactcgatgaagtgttggttgatatattccatttgaccaaacctaacccaaata

SEQ ID NO: 33860 - DNA, 1501 bp, Oryza sativa
tcgaaatacgattttcttcaaaaagaattggcattaacatcacttatgctgataacccttatcgatctaaacccctactttaacgtatttaatttgtccaaaataaccataatcgtgaggatgtatctagataccgtattagtattaccctgtagatacatttttaggattaaatttttatagaccggatggagtaggcttgatctccttgtgtgcatttgcagggacgaatctaaagtagaagtgtcggtgttaggcgacaccgatgactttctataaaatctatagcaaaactgtttaactatgttataacaccataatctaaataaatttagtatactatgatagcgatagacacgttatgtcacatacgaatcgattttctggatcagtcactgtgcgtttggttggcgtacattgtgttcatgtgggtcgatttattcgtgttttatttaattagcgtcctcataatctcattgtgtcattgagttgcgtgccctatggcaccatgggatgacgcgaaatgaggaagccttggtgcccagtatgtgcttttgtggctcgacgatcgtggcgtgcattctggccaaactagtttgcacggtttcgttcttcactttcaattgtaaactcgctctcttgattgcccatgaaatattttgagttcgtgtgtgttcagggctaaccacttagaccactaattagaatatatttatgccttgtctagtagggttgtttcagctccatttatcttagattccaactaaacggtttaacctctataaaaaaagagcataatggggtttagaccacttcactccatactttgttttcgaagttacgacggccacatcaaacagactcttaatttttttccataataaactattggagtaccagtaattaataagtatccattaacttttcatccaaatctcctccaagaaaaacctgaccttcccaagttcaagccaacaaccctgacagccgcatggacatacctagaggtggtaataaatccaatattttagcctatgaaatatgagggttgaataaaaagagttaaactaagattttttttagagaggggcatttttatcttgcctctatatccaatcggatatatgcatcctcattaagaaacttagcctaacgaacaggtaacttagtcctcaaataacccaatctaaaaggaacttagctttcaaataacccaatctgaaattcgctcctagtgaggttaccgcaaccactaggcttcatgccctttcacaatcattaggtcttgtacgtttaatccctcctataagaaaattgagggagttttagaggggatttatttcatatctattggggtgaaattataccccttcaattttcttcgttctcttaaactgaggattaacgaacaaggcattacggtctagatgggttgtttaacagggttcatggcccctaatccattactgcccctactcccaggcataccgtatacgctcgc

SEQ ID NO: 33861 - DNA, 415 bp, Oryza sativa
  unsure (1)..(415): unsure at all n locations
gtgggtnnnttgacctcatgtcataccgggnccatcaaatttgtgagacattcgattctagaactatacacttattaatcaaggccgtgaacccactctaacctgccttaacccaaggcctacgatgattcataccgaactgggcacccgaccctgggtcccaggtcgtcccaagccaacccaagccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacgaaagacgtgacatagtttccaacccatccta

SEQ ID NO: 33862 - DNA, 1501 bp, Oryza sativa
ggatcaaaggttcaaagtggagtatgctatgaagcaaccaacggtggcgatctgaccagccaacaactcctacaaggagtcaaaacagacgtatctattctccgtggtgtgatcgctatttgatccgatctgtgttggtctcttccatcggactaactgaacacttaagacaaagtaaatcaaacagttacttcctccattagccaatggtcacgcacggggggccaaattaatccctattttgtgaaatccgtgtctcgtacgatcatgtggccgtgtcatacacgagcacgagacgacgaatctcttcgatccgtgtcatgtcacacactcgcatgtgccaatcgaccacgcaccgcacctccacctagcggtggacttggaccaacctcgcgcaggtgggcccgtggaagctggtccatcccgctgccttgtgggcccacacctacctttctaggttggccgtcagcctcagctgaactgtcagtcggttacactgcgtggaggtctgaacgcttcacgctgctagtaagagcaagattaattaaggaaaaagttacacatataaactttttattattaatttgttattaacattgatatatcggtctaactttcatagtgttcataaagataagtgtgcgcgtgttatggactgtgtttcttaaaaaaagagcaagtttaattaaggaaaactgttatacatacaaacttattattattatttaattattaacaccaaggtgtcatgccgtgagtgtatctagagtagatattttataacttttatttacctaacttaaacggtcgagattattgtttgtaaaaaattactaagaaaaaaatagtacaatagcaatgctctttaattaatctagccaactgctagttttaaaaattaacatatcatctaccgtactttaataaactatcaatacaatagttttatataaagtaaatatatagcacattattaaacttggttcacatattgatgagagtctgtgctacaaatccgcttttctcctctcttcttctcatctgttagttgacctgccgccgccgctcgtggagtcgatccaacggctgcggtgcgaggccgcgagtggccggcaaagggcaattcggtcatttcgccgccaccaccgccgccgccgtcgtggtggttccggcccaactccaccgtctccacgcatcatcgtctcccgctccttttaaacccgtgctgctcctccgacgagcgccgccgccgccgccgccctcgccatcgcctccgcgagcgcgcgtctccctgctccatgggccgcggggcccagacgaccagccggtgcgcgccgtagatcccgcgcgccagatccgatgggggagaccggggtggccgtcgcctcctccccgcgcgccgcggcctcctccccgcgcgccgccgcttcctcggcgtcggtcgcgtcgtcgccgcgggcgggcggggtgggcgggcggcaccaccacaggcggtggggtg

SEQ ID NO: 33863 - DNA, 341 bp, Oryza sativa
tgggagcacataggttcgagcagaatattagtaattagttcagttgtgcattttttgaaaaattttctgattcgattgtatttttgaaggtttgttctgtccccatttactgagagcattcgtgcatgttcaagttgagaagattcctcatacatatgtactgcgtcgttactcaaaggaagcaaagagtgatgtcaattttgaccggcgtgatcgtccaatatcggggccagacggtgttaaattatcatacaggacaaaggtgttgtcattggatgcacaacagctagtaaagtgggggaggaggtcgtcggttgctttcgaaagggcaacctcagtga

SEQ ID NO: 33864 - DNA, 357 bp, Oryza sativa
cctgcagccctcctctctctcactcttctctgcgggggcggtcgatgggtgcggaggaggccggtggggcgaggcaggagagtgtcgacagccggcgacggcggcacgaaagaaggggatgtggctatttagaggtgaagagggtgtcggtggccggcaacgggtgacccggtggcagcaacaacacgggagaaagagaggcagcggttgtatagactgttggagccgacgagcaccgacgcggcgcgggcccggtatgtggcgagccaatccgccctcacaccggcaccatccgtgcccacattgaaccacccatatgaggcctcctccacctcgcccctgtcgttcacctccagc

SEQ ID NO: 33865 - DNA, 1501 bp, Oryza sativa
cctcggattcattcggaaagtttccccctaacttcgccggcgcatcaatggcggccggatcttccgcggccgattccccctcatccggcctctctctccccctcccgaccctatataaacgctccccgtgcctccctccaccgtttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctctccgtttcggtcgccgaccgccggaacgccgccgtcctcgtctacccgagccgcgccgctgccttcctccgctccggtcgccgtttccgccgtcgccgtcgaaccggggtgagccgtggaccgcccatttagtttccccctcccctcccctctctcggccgccgctccgccgtgcctatggccgccgccggcgaccataggggcgcgggcgcgccgcctcccgtcggctgtgccggcgaggccgccttcgggcgcgccccgcggctgccatgtggggcccggccgtcagccgcccgagccctcgggtgcggctgacgcgtgggacccacggcgccggccggtgtgagccgcgtgcacccggtccaccgtggaccgagaggctgccgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatctgctcttcgtggaagttgaagccggcgtttgggaaagcgagcaaggcaagtcacatcatctttgaacatattgaatcccactttataaaattatgttgatttaaattattgcattatcgctttatttaaattcccgcgttatcactgttttatttagccatgcctatttacctttgttacgaccttattattattgttattgttattatttccttgttcaccctagaataaacaaaaccccaactagtggacactctactcatggtatcactagtatgatttttggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggt

SEQ ID NO: 33866 - DNA, 1501 bp, Oryza sativa
aaccaaaccaaactgagaacataatgaaacatgaggaaatgactcacctgaccatggagcggattgtgacgttgtgaataataatgttagtagatggacgcccataagcaattccatattggtcccaaccactctttatagcaatcccatcatcaccaacagaaatatagcagtttttaatcactacattctcacaagaatctgcatatatagtaaaataattgagaatcttactagtgaagcataaagtttactaaataatacaaatgactccaacatgatgtaggaatacagggttgtctggtacatattgtcatctacatgtacatattgtcattatacagtcataggagattgtaagatataagaaaattgcagctgtggcattgccctgtggttctaaaaaaattataagctaacagaaatgaagaaaagctcagaatcacaaaaaaaatgaaagagataaaattgggaaatgacctggatctatcccatcagtgtttggagctccaacaattggagccaggatggtggtatctgatatagtaacatccttgcagtcatatatatgaagtgtccagaagggagaatcccgtagagtgatgttagaaatggtaatgttacttgaccgcatgagttgcacaagaggaccccttgtgtgattgaggactttcttccgaaatttgctccaccaactttgaccttgcccatttatggttccattttgtcctgtataaggtagggaaaaaggagaaaacctctcagctgatgaaaatacaagccaatttcagcttcaggacaaagagctgctagcaaggataagagtacaaggaacaggctgccaataaataatacacaaaaggaacaaattatatgaccagtgccaacatttagcctactcctaacagaatgatagcttataaataaatgtcagttagcttaattgcaactgtttctgaaaaaataatccaggacctctcttttagtcttatatgctgaaataggacatgtcgacaaccaaatacgattcatattaaaatttagtgactgagaaataactttttcaaccatttgcatgatttcagatatagtggtttcaagatctgatggaacttggctctagaattgctttaacaacaaatacactgcaccaaatattcatacctcctacaatgtagagaaaaatatgctattaaacaagatcgtatctttgtcaagttattctcaatttgccacatgcttgctggtggaaaagatatccagtaccgctatttaaagtttcaagaaattggtgattgtatttactgttatattttagagaacatgtgcaggatgagatcaactgacgagcatgtctccatatgatcaagaaccaagtgattggagttaaactcaaaagtccttgaaaagatagatgacaacataagctccaggctccagcatatgaccacacacttctatcatataatgttttcttttccgaccactatagctgagattt

SEQ ID NO: 33867 - DNA, 1501 bp, Oryza sativa
tgaaataaaatgaaactggtggcgcaaggtccaccactccatgtagctgcaaagtaataaagctgatgaaccaaatagacagcaggagctttacacatgtaagacatcaccataaactagcatcacatgccaaaacagcaattcagctattgtgaaccagctttgcaaaaacagcatgtcttaatatcaccataaaatttgaaattcagactcaaactttaagctgagtgtgggaattggctgtgattaggtggaaacattactaacagatctgttcattgctggaacagtatggcagtcaggcagtgtcaactttgcatagatagattctaaggttccttaagacgcatacacagaccaccgacaccgcaaacatgtggaggaaactagaacatcatcaattatttttggatctgttaacaaattagtttgcgtctttgatataaccagccaatccagtacgataattgctctgcaattgaaaacaaaacgaaatgatctcctaatcccttcaagcgccaccgcgagctttgagagcgcttccacactgtgaaccaaatccaggcaccagatcgcacctcgcaagcagtagcaacgcacgcacagaaacccaaaacaccatagacgtcacaggtctcccgaataagagtggggtgcagctgtgcctcaccttgggcgacacgaccgtggcggccctcacgacgagcccccggtacccgcggcgccccctcgatgcggcggcggcgaccgaaggcatcgccaccagcgccgccgccggtgacactgacacccgcgggccggcggacagctgcaccgacgccatgagctcgctaccgccgacgacaaccgcgagaagcgagcgagcgagagaggagagaggagaaggttctggagctgggggggataagggtgagctccactgaggttgttggcttgctgggttttggaggagacgacccggttcgttctagaaggttttgggcttttggcccttgcttcgcacgtgagtgccgctttgagattcggaacaacgcagcaccagaatactaatcatgggatcagccaaaatttaagggtctctttgaatcacaggaatgaaaaaacggagaaataggaaaaatatagaattctgacaggaatataagtgtaaaacagagaattgcaaaacacagaaaaaacataggaatgaccgtttgattggaccacaggaaaaacacagaaatttgaggagagataaagacttgtggagattatgggtacccaatacccacacggcatggttatcgactagtcataggagatagcttatatctgtggaatatgtacagatcatgacttgggtattacgtttccttttatattatggagcggcctaaagtcctgatttgataatattgtaaaatagatttaggaaaccgataccgtattggttaaggtttctatcttgtaatcctgccccccatcctatataaggtgggcaggaggccctctagggggcatg

SEQ ID NO: 33868 - DNA, 1501 bp, Oryza sativa
aaactcaaaatcttgtgtcctgatgcagcatcaaccagttgatcggctactggcattggatattcatcctttggggtagctttattcatgtttcggaaatcgatgcacacccttaccttaccgttcttcttgataacagggactatgctagaaacccactcagcatatcggcaaggacgaataaaaccaacatcatataatcgtttaatctcagccttgacaggttcaagcatatcggctttacatcttctcagaggttgctggtgtggcctaacccctggtttaataggtagccgatgttcaacaatcgatcggctgagaccaggcatttcataatactcccaagcgaagcaatctctgaattctttcaacagctctattaacttggttctgaattccgaagacaaattcttactgataaatgtcagccttggtcgaccacctggacctatatcaaattcttccaaatcatcagccgacatgaaaccctgtccttgtttgtcatcgagatcatctactgtgtccttggtgtagacgtttgaaccctccacgacaccctcaaaataatagcttgggttctccatcttcaactggctgtatatcagaatcggacacttttagaaaatctccatcccaaacttttccagataaacaatcaagaccatccatctcccaaagagctaaatcggcaccggcaacattgactgacttgtcggctggcacaatttcaatcttgtcgccttgccactgaatcaagcactgatgcatagttgaagggatacaataattagcatgaatccaatcccttctaagcaacaagctgtaagaacccttcctatcaatgacaaagaacgttgtagggatggttttgttgccgactgtcagctccacattcaaaactcccttggtttccgatggattgccgccaaagtccttgagcaccatgtttgtcttgatgagatcttcggcgtttctacccggcttcctgaatgtagtgtaaggcatcaaattcactgtagccccaccatcgaccatcatcatggacatcggcttcccattgacatagccatttatatataatgacttgagatgccaattttctgtaccctctggcttctcgaaaattgccttctacagtgataaaattaatttagctgattctgcttccacttcatcgacattggcttgcttgatcccaaattcagcaggcaacgtgaaaaccatgttgaccgaagcaattacaacacttttccctttagccaaccttcttgcttcataggctgtggcttcattggctacaggagcttgattcttaacattgaaagtgcattaatcctcctagtgggttttggtgattaatgacaaatgtggttaagggactaatgagctcattgagtagctttcaagtgcattagtccaaggtgtggaagatggatgcttggagaccccccaaaaagtacaaaatcaaatcggactggaactcgagaagtgtataggatag

SEQ ID NO: 33869 - DNA, 1501 bp, Oryza sativa
tgcaaaagaacccctagcctcctttggttatatcttgcatcatacctcctcttcctgtatgacttgctgagtacagtgggtagtactcagtcttactctcttctcccccgcaccagagctgaaggtctttctagttggagctgtcttgttgaagttggttttgtcgctgccgtcaaggattgcctgtggagtggagtcgccccgctgctgaagtcaagcttcccggtttagctcgcttttatcctttccgctgcatttgtaatctttatatttttgtaagacgtggatctgtatgtcaacaattgtcgtttgtgtaccctggctggtcctggatagggatttaatgcacattcagtttagaaattctggttcgtgaatttctgggcgtgacatggccgatgtgggaacaaagtcgtccatcaatggcaataaaaacaccagccatagaagcagcttgaggcgactgacgttgaaagtgaagacgcccatcaatggcggcataataagccagccgtctaggcagaaacaccagtcggcggcaacgaaggcgagccggcggtgaaaatgcagacgcccatcaacggtggcataataggccagccgtgcatgcggaaacaccagtcgacggcggcgaaggcaggccggcggtgaagtcatagacgcccaacaacagcggcataataggccagccgtacaggcggaaacaccagtcggcgacggcgaaggccagccggtcggtgaagatgtggacgcccatgaacagtggtgtgaccaaccaaccgtataggcgaggacaccagtcggcggcgacggaggcaggccagcggtgaagtcgtagacgcccaacaacgctggcataataggccagccgtgcaggcggaaacaccagtcgacggcggcgaaggccagccggtcggtgaagatgtagacgcccatgaacggtggtatgaccaaccaaccgtataggcgaggacaccagtcggcggcgacggaggcaggccggcggtgaagtcgtagacgcccaacagcggcggcataataggccagccgtgcaggcggaaacaccagtcggcggcggcaaaggccagccggtcagtgatggagtacatgcgatgatacatgcaaagacaagaaattgcacatcaacctgtggttagatatttgtaaaaagaaaataatttatataataactaatagatccaaacacatggtttgatttgtgcttgatgaagaggcttgcatgaccaacaacggtggtgtgaccatccaaccgtgaaagtgaggaaaaccagtcggcggcgacgaggctgccggtcggtgaagatcaagacgaccgtcagcaacggcataccatgccagccgtggggacgaagacaccagttggcaacagtagtgccgcggtattacatgtaaacatcagaaaataccaagagattaatatgatatttagagatcaatataataaatgatgctagattagaagggaaaaactctggtgatg

SEQ ID NO: 33870 - DNA, 1501 bp, Oryza sativa
aatggacaagagtttgttgtagaatggactgccctgttataagcaaattcaacatgtggaaggcagtcttcccatagcttcaaattctttttcaacacagcacgcaacatggttgacaaggtacggttgacaacttctgtttgtccatccgtttgtggatgacaagtggttgaaaataacaactttgtgccaagcttagcccacaatgtcttccaaaagtagctgagaaattttgtatcccggtctgaaacaatagtctttggaactccatgtaaacgaacgatctccctgaaaaacaaatcagcaacgtgtgaagcatcatcgctcttatgacatgggataaaatgtgccattttagaaaagcgatctacaacaacaaaaatagaatccctccccctctgagaccgaggtaaccccagaacaaagtccatagatatatcttcccaaggtacatgtggaataggtaatggagtatataaaccatggggattgaggcgggacttagctttcaagcaaacgatgcagcacccaacgtgccgctggacatcacgtcgcatatgtggccaaaagaaatgatcagagggcatgtccaatgtctttttgacaccaaaatgaccagccagtccaccggcatgtgcttcctgcaaaaggacttgacgaatcgaacaagctggaatgcatattttgttagtccgaaacaagaagccatcatgcacataatatttatcccaaccttttccatcaatgcaacgagagaaaggttcgttaaaatcagcatcaacagcataaagtgttttaatggattccaaaccaagcactttcgtatctagttgtgtaatcaatgcacatcttctagacaaggcatcggcaacaatgttatctttaccacgcttatgttggacaacatagggaaatgtttcaatgaattcaatccatttagcatgtcgacggttcagcttgccttggcttttaagatatttcaaagcttcatgatcagaatgaattacaaattctttagggaacaagtaatgttgccaaacttccaaaacgcgaactaaggcataaagctctttgtcataaaccgagtaattcagatgtggaccatttagcttttcagaaaagtaggcaacaggtttaccttcttgcagcagtacacctcctatgccaataccacttgcatcacattcgatctcaaatgtcttaccaaaatcaggaagttgtagcagcggtgcttcacaaagctttgttttcagtgtgtgaaatgcttggtcttggtcatggccccacgtgaatggaacatccttctttgtgagattgttaaggggtgcagcgagggtgctgaaatttttgacaaaacgcctatagaaacttgcaagaccatgaaagcttcgaacttggctcacatttaccggtgtaggccaatcctttattgctttaaccttctcttcatcaacctgaataccatctgcggaaacaacaaagccaaggaaaacaacacggt

SEQ ID NO: 33871 - DNA, 526 bp, Oryza sativa
tagtcccggttggtgtactaaccgggactaaagatcaaatatgcccgttaccctttttaaccggaactaaagatcatctttagccctggtttttattgcatccgggactattgtggaattcgaccgaccgacgaaagatggtttctccaccggtgtttcaaccgttgcggatggcataccctaagctagtccaaaagtacatagtatatatagctgaagatgaaagtccctggctagttgcttgtatatatgctgaagtaagaagtgaactgtcggtttgccctccaaataaatctagctagcacacctcgagattcccaattaagtcaatcagtaataataaataattatgaacccctaattaagaccaataagaaaaaccaaacacaggaggaaggaacggagcaattaaatataagagtgaaagcgacagggcaccggagcgtggcagttgcgtaaattactccaaccctttctctccatgcatctcacctccacagcgacccaccacccttctttctgccat

SEQ ID NO: 33872 - DNA, 554 bp, Oryza sativa
tatcaagctcactccctatttttcccatacctaattgcatgattgatttgtgggcccttgcatacgcacttatcagtcatcactcatcatgaacacaaatcacagaggatccatcatccacgattaggttccccatccttctctggaaaaaaaaatatgatactcattaattaattgagccatcctggacagatcatattatttgtcaatggagactcaacgtctattttgtcatatggacagatcatatttcacaattacaagaataccatcttagtctgaacacaaaaatgcatgccctcagtattatttgctttcggatttcggtgttgatgaagttcaaagataattaatccaattttctactactctttaatttgtgcttttgaaccaattaatgaagtttacagccagtgtttacaaattttgttattttcatgctccacgtgatccgtccatttgtaatacaattaaataataatcacgatgattaattaaataataaccacgatgatgaattaattgaaatgaatgaaaataaaattgcatgcagg

SEQ ID NO: 33873 - DNA, 449 bp, Oryza sativa
cctgcagcccgatgccttagctaagctaatctagtaaggcaatttagacgataccggcaggaaccctaaagcgagaaccagccgataggctaaattgagatactaaggctagattaacgaagacatatgataatagatggtcatgataaaagaactagaacatctaaaatgacataatagccccgatagcacaagccattgagacgggttacctcttgttgagaaaactcgccgaaaataagaacaaaaagggtagcgatgtgctgaagttgtattggattgtctctcgtattatagttgtacggggttcatatttataccccaagtacagacttagtccattatggacatgactcaaacctttctaaagataaaatacaaacaagaccatatatggtggcctcttaccaaatctaacgaaaaccgacttaaatatcctaattaataga

SEQ ID NO: 33874 - DNA, 220 bp, Oryza sativa
gttggtttagtaccaccgctttggtgttggttaattaaaatgaatcacatggtgggctgtgggtgcatggttttgctgatcgcacccttggcagttaaggaccggttcgcgggatgccctggaagaacttatcgtacttaccacaagccagcctgggcaacggctgggcttgtagtgtagctttcctctagctgacgcatccaggcaagggtgggcgtga

SEQ ID NO: 33875 - DNA, 414 bp, Oryza sativa
ttcctgcagcccggtgcgacaggcccaaccatccacctatactatccaatttcaatagactaaactagggtgagactaatcacggtgaatctggttgaccgcccataaccgcgggcatggctattcgaatagttttactctgattagaggtgtacaactgtacccacaagacatagccccacgacacatttccgtgtgccgacatgccaccacgacataccggaaagaggccgtgacaggacccttcgcataaccccctataaccaagcacaccacacctcaggtttcacccccagtcctcgcaaggtagcgggcagtccctctcgtgcctaggtgaatccggaagcgacagaggccgtcgcagggcccgccccgctccatcacgcccacccttgcctggatgcgtcagctaga

SEQ ID NO: 33876 - DNA, 1314 bp, Oryza sativa
attcctgcagcccgaatcttgcgatcctactctccgttgaggagctccaaagagctgggtctcaattaaccccttgcctcacttgtgcaaaaacccctgaggaaatccacagccttcaaccccaaacacccctaggcaaatttctagaattgagtgaccaccaagatccaactcaacctacttctagaaatccaccacaagtgtgggttgctctacttggaaagcctctagaatctcagcacaagaacttcaccaacttacctcgttccctttcggaggagaggaaatccttcacaaacttacccgggacatccacaatatgcaacggattctcgcgggcgacacctaaccatctaggagatcatctccaagagtaataagcaccgagatgacagcccacgagatattccaagtgctcacccaagatcctagtcttcacacatctccaaatcttcttctctccctctcaatctctctttctcacaagaattaggctctagattgagtggagaagacaagaaacacttgggagaggctagcaatagctctaggtttgaaaaatgaaagtggaatggccaaggaacgagctggaatcgagctgtatatgtatgacggctaggtaacgtcatctagccgttactcacaaatttgaactggaaactagacaggaagttccggacctgaaagaccggaacttccggactacacttaggaaaatctttttcacaagaccggaacttccggacctggaagacaggaagttccggacttgcatttttggacagatggagtatttgcaaaaatgactcctagggaaacttgacacttggttcacactaagagcacttgatatatctcagagcatcacctggaacccctcttaatagtatagtttttcctaaaaactcgatttcaaaagataaactatcctatgcccttctcgagttccggtccgctttgattttgtacttttttgggggtctccaagcatccatcttccacaccttagactaatgcacctgaaagtcactcaatgaactcattagtcccttaaccacatttgtcattaatcaccaaaacccactagggggattaatgcactttcacctacatcccgaagaagctcctcctggcccgcgtggcgtccatctcgatccactccccctctccccacgtaggacatgggcttgataggcggcggcgttgggcgggagccagagccggtgttagaggagaagcggaggagcgagaggagacgatgcggctgggggtggtggcggctagagtgggagaggaggaggcggaggtgagcca

SEQ ID NO: 33877 - DNA, 408 bp, Oryza sativa
tcctgcagcccggaagctgttggttcgcgcaacccaaatagcactgcaaacaaatccccgcacagtacagcaaaaacttcatcgaaactacgcaatatctcactaaaatggttcggttaatttcttcctgcgcatggatgaaggaacattgaagggaattttatacgctattgcacacaaatcggagaacatagcaacatcatctacccatggacggatctaacgtgggacatggtatactgtgatgtaaatttttttgggggaacaaacaaactgttatttgtaaggtgatcaaaattgagagaaaagaagcttccagatctggaagagaagctagaattaacgcagggaaattcaaggaaaaaagtgggtgggtagagatgaacgagaaagaggatggatactcac

SEQ ID NO: 33878 - DNA, 524 bp, Oryza sativa
gtcaaaacatcttatacggagggagcaacaaagatgcatgtgcgttacaacaggtaaagacaatttcacgattgataaaaactctaccaatttaaacgacaaaccgaaacaagacaaacaaaaccatggcaaaacaaagtcagaaatcatatataagtattgagcacactagcttcatgcatcatcatatgaaggatccttcatgtacactttcccatagcctcacaaattgatcgggtggctattctattatttgacacgtgtattttgctatacctcattgaccgaagattgtaattttgattattcaattagtgaaattattttactgtaaatggaaagtatttgcaaagtaataaacttgccgcatacacaccttaaacaattataatttcaaaagaaaaatatttatgagaagagaaattcggaagagaaaagaaaaatgagaaaatagacgagattgaaaggatcggaagagaattaggatgattgggagaaaaaagaaaaatggaaagagaaaaaga

SEQ ID NO: 33879 - DNA, 185 bp, Oryza sativa
ctgctcaattttaaggaccgaccatgcatttcactctaatcggaaacctgtaccctgactttctgtatttacaaagttggagaccagatatgaagaaatgatgctttgacactataatgctttcagcctttcacttcgattcttgatcaaaacatgcgcaccttactccttttttatttcatagg

SEQ ID NO: 33880 - DNA, 158 bp, Oryza sativa
ctgcacgatgcatgcatcaggcatgcagtggccgattgcaggccggacaagcatccattatattttgttgacgaagctgatctgacggcggctggccagctactactccggccgcctacctccgccgtgcgtggcctcctgtgcttcacgaatcacga

SEQ ID NO: 33881 - DNA, 916 bp, Oryza sativa
aaagttaagtccccggatccaaacaccaccttagtccctaactaaactttagtccctctcacaaaaaaattagtccctaactaaactttagtccctctcacaaaagcaaaagtccctcccatagggactaaattttttgtgagagggactaaagtttagtccctccttgccaaacaccaccttagggacttcaattttacaggcttacacagactccaacagatgataacttcattacagtaatttatcaacaattatttgttccccttgtttgctaatgagtaaagtccatcaccggtccctaaacttgtaccgttgtgtcatcccggtccctaaactcgcaaactgaccgttcaggtcctcaaacttgttcgactatgtcatcccggtccctaaacttgcagatcactcatttaggtcctccaacttgttcggttgtgtcaccccggtccctaaacttggatttgaatatcatctgggtcaaataggatggtctaaagactttatatttaaaaataattcataactttttcatatgaattctaatgaagacaaactttatatcaaacttgtagccctcgacgcgatctacaactttgtagttgaattttttttatttaaagtcattttttgtcccaaaatgtaattttaaaattaaaatttcaaaatctataaacatgcaacaatattttgggaccctaaacagttttaattcaaaaacttttcaactacaaagttgtaggtcgcgtcgagagctacaattttgatataaagtttgtcttcagagttcacatgaaaaagttatgaattattttttgatataaagtttttagaccgtcctgtttagggaccggggtgacacaactgaataagttggaggacctaaacgagtgatctacaagtttagagactagga

SEQ ID NO: 33882 - DNA, 363 bp, Oryza sativa
tctaaaaactttatataaaaaataattcataactttttcatgtgaactctaatgaagacaaactttatatcaaaattggagccctcgatgtgacctacaactttgtagttgaaaagtttttgaattaaaactgtttagggtcccaaaatattgttgcatgtttatagatttttaaattttaattttaaaattatattttgggacaaaaaaatgacttaaaataaaaaaaattcaactacaaagttgtagatcgcgtcgagggctacaagtttgatataaagtttgtcttcattagagttcatatgaacaagttatgaattatttttaaatataaagtctttagactgtcctatttgacccaga

SEQ ID NO: 33883 - DNA, 1501 bp, Oryza sativa
ctgaactggacatggaacataaaaagctagctgatctcccaaaatctatcgaagaacagaaggtaagactcaaatcggctatcaagaatgttgctgatctaaccaagtctttgaaaatcatccttggaaccgatgctcaagacaccaaagccattgaagaagtagagcaaattaggcaaagagctatttcggctatccagcgatatttgtctcagtgacatcctatgtaataggtcttagaaatttttgtaatcggctaaggacctctaactctttatgtaacttatctcaataactgtcatgccgattcaatttaactccatattttgctcaaaaatttgcaattttccatatatgtgccccctaattttacaatgtcaaaagcattgataaaattaaaagaacgactaagggcgacacaatgatatcggccatttgtacatcggcaaaccacaaccgattacgatagaaaaataactaagggcgatataacaatatcggccattgtacatcggcaaaccacaaccgattacagtagaaaaacaactaagggtgatataataatatcggccattgtaaatcggcaaaccacaaccgattacaatagaaaaacaactaagggcaatatcggtcatctcgaggcgatgcaaatacatcggctatcatgtatcggcaacatcagccgatcatgaattaacccaaacacttggataatatttcttcaagtatttgccattcaatgctcttccatagacttctccatcgagtccttgcaacatgtaagcccctttagacactactttatgaatttggaacggtccttcccaattcggcgaccacttgccgaatttgctatcccaagtcccaatcggtgtcgaaacaaattttcggcaatatagaaaagggggtagcgcacgagacctaaaagtggatggatgtggagacaaaggatttagacaggttcagtgtcacatcctgatttttgtttcaggatttataaattatttaataaattattattagaatttatattaaatgttcattaatttacaagtgaagttaaatgtgggaaataaaatttcctaaatataaagcatggatggatttaattttcattaaattctccatgattaattacactctctgaaattttctcagatgtttcggagctcaattcttaatttttaatcatacaaagagcatttcagtaattacccacatattaaattaatcattaaatggtctgtttttaatatttttaaatactttgggtgtacaagtatgttcaagatttttcttggaattatttgagcataggaagtatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagc

SEQ ID NO: 33884 - DNA, 165 bp, Oryza sativa
cctgatcgttgctttgtgactttgtgaagtgtctgggttcacaatggtgagtgggggaactgaattagaagggctctagcccttttccctctgaaatcttaccattctgtgaaccctcctactgggcttggggatcttcatttttgcagaagtcgtgactgtaac

SEQ ID NO: 33885 - DNA, 630 bp, Oryza sativa
ccgcttagctgtagcaagtggcaagtagcaacccttatctctgtctgcgcataatttctcaagaattctcaatccacatttgtacagcaatgactgttgaaactcgattttatttttcttccaaagcaaacacttgcggataaatagtcccatcggtttgtctgtagccgtaacgtttattagcgacaacaaattatgtgcgaaaaacttttatatacaacctccttataatagatgacgccgttgatttttaatatttgttttattctaaaatttatttaattataatttattttgttgtgagttgttttatcattcaaagtactttaaacatgaattatatcttatatatttgcataaattttttgaatgaaacgaatgctcaaacatatgttttaaagttaacggtatcatctattaaaagacggagggtgtaagtgtttttaacgacttaaaagtcaaatataaaaaataatcaacaataaaaaaccattaaaaacaactctaacaatctagatttaaaacttaggccccctttgattcaaaggcaaattcataggaattttagaggattttattcctataggaatttttcctagaaagccctttgaatcaaaggaataaacacta

SEQ ID NO: 33886 - DNA, 1501 bp, Oryza sativa
ttctcgcatcggattgatttcccctttcctcatcttgttttcttcttctcgattcttttggatttgcagcacctctccaatctagttgcgattcctagcttgttgcatgaaatccattactttcttggtccaatcggcaaccttgaccccactgatttgatcatcggtgaagccaacagaatccctttagattagctaaccctaatctaggtcactggaagaatgcttttaagtcttggccatctctcgagaaaaccacccctgagaagagttggaccacatggtacaagcgtttatcggctattaagaaagttcactgggacgagatctggatcgaccaagcgcttgcccttaccatagccaattccgctaaggatgaacctctgatgacggccaccacctatttctggtccaacaccatcaatgcctttctgttcaaccaagggctgatgactccaactttgatcgatatcaccatgatcaccggattagatgtaacttcatcggctaaccctatgagcatgaacaccaagaaccaatttgacttcaggaccaaaagcataggtggttggtctggttatgtggcaccatatatgggccaaggatctgttactcctcgagagcatgtggcctttttactcatgtggctggaaaagtttcttctctgcgaatgcagttgtggccctataaccaattggtaatttgtagccgaagtcctagaatcaaagaaacaatttcgtttgggcaaaatcctccttggctatctataccaaatgttgaataatgcatcggccaagatagtcgtcggctcagtagttggggcaggtggaccatggtggctgctgcagacctggctaaatctaatggtcatgaaagttgtcaatcggccatctatgacagaagctgaatttccgaggttggaaccgactgtagacgatgatggagaggaacataatcatcgcaaatgcatgtcatatggagaatatgcatccacaccaaccgatgccggagcaaaactattggctgaattgctcaaggattggttttgcagtttttatgagggctttcagaaagatacccgagtctggtatccctatgaggactcagtagaccttgatctcccatcagaatttatgtttgaggacattaatcatgaaagataccaaaaagccagggaagttttcacagctgcaatcagtccatgcatccttcctgtcggcattcattagggaagaaacattcaagtctcttatgaattttatcacccaatgagctcagctagataacttggactgggtcaactcccaatcggcttattctttgccgataagatccagtgccgaggagaaatctcatcaactttgatgatgggtcggctgcttaacctccaagaaccccctctgggcagtattgaaaacattgagttggcaggattcaagagcagaaactttgacagatggtggggtgaatggaagctacacctatttcaccaatcggcctc

SEQ ID NO: 33887 - DNA, 1501 bp, Oryza sativa
tggctggctggagctgtggctcgtggctttgattttggtagagagcatatattgatgatgcatcatggtgtgtgatctactactacttctatgtgatgtgctgctgccctgtttgcttctgcttgtgtgatattcttctggtgtgtgccttggaagcaagtgcatgtgtgtgtgtatatatgaattatatatatatatatatatatatatatatatatgtgtgtgtgtgtgtgtgtgtgtgtgtgtgtgtgtgtgtgtgtacacaaaccgtggtctatgctggctggcctgacgctggttttgttgtttagcatcctccttccccattgtgcccatccgtattctgacgcctgcacctgtcatgcatgttcccacaagaacaaaagagaaaaagaaaagaaagaaagaagaaatccttgtgaagaggttaaaggggataagggagagagagatttggtagttggattcttgttcttccaagagagaattaaattcctcttgctttcttactactatgatagtatgagcatatagtattttcctagttaggttcacgtgatgcagtttgtgcttagcaccattctagcctagctataagcactactgggactggaatgtttgtcttggtgttgtttatcctattcctgtggtttatgtctctagttacccacacttaatcatacttcttttttgtctcttggtagagatagttgccagttgccaccccatgcattgctctggggttggaggcagcatgtgcttcagtttagttgctaaaacaacaaggaccacttgcaaattggatactgcaaattggacattgcattttaatgagacagccgattctagaagaagctaccacactggtttaaattccctttcccctgctctgggtcctttaggtctatgaccatttttctctttggcctatattagtacaattatgctgaatagattgtaatagccttcccttcagaactgcgtaaccagtctatttgacaggtggacccacttacacataccacctcacttatacttccatcatcgcttcgtataaaaggatcaacccgggagtcatatggttgaagggatgaattctaatatgtcggttccactcttactaaactagcaaggtgatagtaaacatacgcacatagttatcataagtcacacatgctaaattctaattagaccaggatgctatgtagttgtccattcttctttttaagtttacaaactaggaatcttcgtttacctaggatcccttgttgtcaatggcagtggaagatagattacaatggacttagagcagatacaatagcaagctattaaccagctataaacatattttaatgagataaacgatgagagagaagagcagcgggctacagattcgtagccagctgcaacacggactccaagacgcaatgtgtatatgacaggtgggactatatattaatagtatagtaagcaactattgtatgaattggctattagttta

SEQ ID NO: 33888 - DNA, 1501 bp, Oryza sativa
tgaagcttgaatcaagagcaccttgctctgataccaattgaacgcgctgatgaagcctagagggggggtgaaaattcaatcagacccggaacttcctggtaaggaactccggaacttccggcctcccaggcccggaacttccggtgttctaagacaggaacttccaggtaaaagaacagagataaaatttaaatttcgaaacaagagactaagccaatcttcacaagatggtgcacaggtattctaagcagaggatagatcacagaatcatccacagaaacatcacagaaagagacaagagcgattttttcccgaagttcggatcttgtgatcctactctccgttgaggagctccaagagctgggtctcgattaaccccttgcctcacttgtgcaaaaaccccagaggaaatccacagccttcaaccccaaacacccctaggcaaatttctagaattgagtgaccaccaagatccaactcaacctacttctagaaatccaccacaagtgtgggttgctctacttggaaagcctctagaatctcagcacaagaacttcactaacttaccattttccctttcgaaggaaaggaaatccttcacaaacttactccggacatccacaatatgtaatggattctagtgggtgacacctaaccatctaggagatcatctccaagagtaataagcaccaagatgacagcccacgagatattcctagtgctcacccaagattctagtcttcacacctctccaaatcttcttctctccctctcaatctctttttcacgcaagaattaggctctagattcagtggaaagacaagaaacacttcggagaggctaccaatagctctaggtttgaaaagtgaaagtggaatggccaagcaacgagctggaaacgagctgtatatgtataacgactatgtgacgtcatctagccgttactcacaaatttgaactggaaacaagacagggagttcgggacctggaagaccggaacttccggactacacttaggaaaatctttttcacaagaccggaactttcggacctagaagacaggaagttccggacttgcatttttggacagatggagtatttgcaaaaaaaaaaagaactcctagggaaacttgacacttggttcacactaagagcatttgatatatctcagagcatcacctggaacccctcttaatagtatagttttacctaaaaagttgatttcagaagataaactatcctatacacttctcgagttccagtccgatttgattttgtactttttggggggtctccaagcatccatcttccacaccttggactaatgcacttgaaagctactcaatgagctcattagtcccttaaccacatttgtcattaatcaccaaaacccactaggaggattaatgcactttcaatgttaagaatcaagctcctgtagccaatgaagccacagcctatgaagcaagaaggttggctaaagggaaaagtgttgtaattg

SEQ ID NO: 33889 - DNA, 1501 bp, Oryza sativa
ctcgacgccacgcaatgaatattgaataatccgtacgtaccgaggatggcggaggtggcgggggcgccggcggcgaggacgtcgagcgccatggggacgtcggcgacgcgcgcggccttgagctgggccattatattcggaggatgtcctagctgcgcgcgtataggaggatcgtgggcgcaatgcaatgcaacaacgagacgtgacgcgacgcgacgcgacgcgaggaagcgggagccgagcctaatttataacaaggcgggggaaggggaaagggatcgagtgttgggtgtgggtcgttggagaaaggaaggaagcgggaatggggaatattcggggtggggatgcgttcgccatggccagccatcgcgcgcatttgccaatttgctgccaccgtccccgcggatcggatggtttatcctccaggatattccggtccaaaggcacgcacccgacgcagacagacgcttccctctgctgctacaactacgagaacgaaccaacgaacgaacacatcaggacagcgctgtttccgttttttcacctgtcctttctgccacgatttttccccttttccttttttaccctccgtgcctcgttttttctctttgaccgaggctgtgttctgtgttcatacagatgttaggtgaaaatttttgacgtgtcacatcagatatatgaacatatatttgaagtattaaatatagactaataataaaataaattatagattccgtctgtaaactgcgagataaatttattaagtctaattaatccatcattagcaaatgtttactgtagcaccacattgtcaaatcatggagcaattaggcttaaaaaatccgtctcgcaatttacacacaatctatgtaattatgtcttttttatattgaatactctatgcatgtgtctaaacattcaatgtcacatagtgaaaagtttttacgtgaaaactaacagagcccgagtcgacgttgtgcgttcgcgtacgtgcaatcgttcaaagccgccatcgtggcaatacaacttgacaagtggtgtcgtccagatggtttggaacagctggtgggtagtactagcttttaccacggcttcgcccgcccaatctgcagcgaactcctgcagcatccgcccgcgcaacgcgtgcgtgcgtctgtgccgttgcttgcgcgcgctcgtcgatcgccgctcgctgcctagctagccgttggtcgagtgtgtcaagtgatatcattcgtatcagccacatcatgcggatgcatcgatcgttctggtggttccgcttttcgtcgtcacttcgtatgcgattctgtttgtccaataaagaagaaatcgtgattctgttccacgacgggttaaaggataagacgattggtttattcctgctatacgtgatggacacgacagattcatcacgagagcacaaaggagcaccttcttttctcggttttatttaggctgaaccctgagaatatgtgcagaggagattgcaagtttcagt

SEQ ID NO: 33890 - DNA, 1501 bp, Oryza sativa
ttcaccgatcggcttgccttcgccgccgccgactggtgtctccgcctacacggctggtgtcacgaccggaaataacccaacgggcgttccttacgtgcgtgtattattccttgtcccaggaggcaaggtacaccaaaagttgatacaattcagagtttaacaagcggaagcgtaaataattaatttattacatgggcggcgaaggcccagcacacacaaagacaaacgggaaacagcggaagactagggcgacgaccacaggcgctagacggcaggcacgagctagacaccaaagccttcatcttccaggaactcctctcctgggtttgggaaaaattgagcaagactgagtacaaccaccgtactcaacaagacacacccacaagtgcagaataaatgtaagggagtacaagggggttatcatataaggggttagggtttgcagtaaacagcattaaaagacacttagttgctcaaagctattttgtaaatacgatcctagcgctatacaagattattagtcaaggccgtgaacccacacgaacctgccttaacccaaggcctacgatgattcggaccgaactggcaacccgaccctgggtcccagctcgtcccaagccaacccaggccaaccattccacattttagttgttaagcaggttttaagaatcaaaacactaacttgggtacattgctcggcttgcccataatcgagggcgcggctattcgaataggttatactctgatcagaggtgtacatctttacccacaagacacatcttcctcacgtgtaaccacgtgccacataccaccacggtatacggacggaagacgtgacatagtttctaacccatcctagccatagacaagagtaccgacccaaccccacctacggccggaacctccgggacaggtaggcaggactgagcccctagcagcaggacaccggccttgtgccatgacatctcgactaccgggccgtagctcgtgtagccttcatttgccctagagatgtccatcgacccccgactttgtccatctccatccgtgtacttttgtttataaccagactgagccacaaactaagccttacccactagacatgtggaagtacggtagtgctttgcaacagaggcccgaagaccggtccttatatggccgaggtgctaccatcaaaaccatgcacctcgagcccagcctaaaaccattttgaggattttgaatagagggggaggtgtgaatccaattccacaataatccaaccattccatagtgtccaaatgatatgaatattcccaaagtctagagttataaaaccacctaatgttgcctaattaatcagcgaaccatctacctaaattcatactagtggaaccatgaataaagtgtccactagttggggttttgtttattctagggtgaacaaggtaataataacaataacaataataaggtcataacaaaggtaaataggtatggctagataaaacagtgataacgc

SEQ ID NO: 33891 - DNA, 182 bp, Oryza sativa
ttgaacggaatatacaaataaaacataaccagaccatactacaagtcactcctatgaaaacttctttttactaaatattaatttgcactataagtcatctattgatatgcatataaaatatgcatataaaaacagtatatactacaaattaactgtatatgcacattgttgtaaattgcagc

SEQ ID NO: 33892 - DNA, 1501 bp, Oryza sativa
gaaaagaacgataccatttgaagttaaaattcagagatgccttgtagcctgaaaaactcactgtactcattcagcgctgcttattaccacatcctgcaaaatttaccactgatgaaatcctctaacgtaagtacttatcacttcctatatctgaaactgacctgaaaggaaatcgttacagttagcacaaaaaaggcaagatctctcgtagcatcatcaccatcaccagcatcatgcagtcgtgtagtatggtccatagcttcttgaaaggaggctgaacaactaacacctttcctaggaaagaaccccacaaaagacagcaacggattgaaaaggagaagaagatgataaaaaacattttcagaaaagatgattccaggactgaagaagaatgcagtaaagatcttggcttaccgaagaagacacgcatgcaccgttttcaggtagcctgaccatcgtgatctctctcatccgctgttatatgaattactcgcatcgtttttaatagtagatgagttaacgacatgtttaactattcatcttatttaaaattcctatataaatatataagatataaaatatacttaaaatactttgagggatacactaattcacaacaaaataaattataactacatactttttaattggataaataactaaacgtgtaataaaaagttaatgaagaaatctattaaaaacacaggaggtaattctctttcttgtctaacctgatagaagtacatgattaatcgatgattagccgataggttgcattgctagttggttgctgtcagacataccggaaatgctgtcctcttctctgtgctctctgctgctgttgtgcagtccagtcaagaaccgactggatgagctgtcagccgtgcttacctgctttaatttatgcataatgttgcttcataaactgtctcaaaaaagattaacaccaaaacagtagcacaccgccgttcatgcatactaatgacgaaaattgaccataggcgtgacgagtcacgtcggtacaggattaccgccactgactagccgggcccacgaggcagccatccattcgggaaaggaaaaagacgacgtggagtcgtggactcactggccggtggggacagatatgtgggccccaccaatcagttgccgtcggcatttataatttatttatttatttattttatttagagtgtattttattttgttgggaggtgataaaaagtctccgcttccacagctttgctactaatccgcgcactaattggataattagtggtgcgaggaagcccaaaggagcaaagcaacaaggggaaaatacccgagacaaaaagcgaattcgataaaacgagcggccgctcgaagcggccactgcacagcgccctctcgcctcctcgcctcgccgccgccgccggcttaaggctctcctccccgcgccgtaccggcgggagtgtggaggtgttgtgctgcggcgtgggtgtgttgggagttggggggtgaa

SEQ ID NO: 33893 - DNA, 1501 bp, Oryza sativa
gctaccacatggacaataaacaaattaaaacggcactgaaataccgaattcagctacacacgaaagaagaaaatatctactctagtagcaacttgcaagctttaattccttctcccttaattaacccttcccctttatatatatatatatatatatatatatatatatatatatatatatatatatatatatatatatataaactgaaacttgcaatctcctctgcacatattctcagggttcagcctaaataaaaccgagaaaagaaggtgctcctttgtgctctcgtgatgaatctgtcgtgtccatcacgtatagcaggaataaaccaatcgtcttatcctttaacccgtcgtggaacagaatcacgatttcttctttattggacaaacagaatcgcatacgaagtgacgacgaaaagcggaaccaccagaacgatcgatgcatccgcatgatgtggctgatacgaatgatatcacttgacacactcgaccaacggctagctaggcagcgagcggcgatcgacgagcgcgcgcaagcaacggcacagacgcacgcacgcgttgcgcgggcggatgctgcaggagttcgctgcagattgggcgggcgaagccgtggtaaaagctagtactacccaccagctgttccaaaccatctggacgacaccacttgtcaagttgtattgccacgatggcggctttgaacgattgcacgtacgcgaacgcacaacgtcgactcgggctctgttagttttcacgtaaaaacttttcactatgtgacattgaatgtttagacacatgcatagagtattcaatataaaaaagacataattacatagattgtgtgtaaattgcgagacggattttttaagcctaattgctccatgatttgacaatgtggtgctacagtaaacatttgctaatgatggattaattagacttaataaatttatctcgcagtttacagacggaatctataatttattttattattagtctatatttaatacttcaaatatatgttcatatatctgatgtgacacgtcaaaaattttcacctaacatctgtatgaacacagaacacagcctcggtcaaagagaaaaaacgaggcacggagggtaaaaaaggaaaaggggaaaaatcgtggcagaaaggacaggtgaaaaaacggaaacagcgctgtcctgatgtgttcgttcgttggttcgttctcgtagttgtagcagcagagggaagcgtctgtctgcgtcgggtgcgtgcctttggaccggaatatcctggaggataaaccatccgatccgcggggacggtggcagcaaattggcaaatgcgcgcgatggctggccatggcgaacgcatccccaccccgaatattccccattcccgcttccttcctttctccaacgacccacacccaacactcgatccctttccccttcccccgccttgttataaattaggctcggctcccgcttcctcgcgtcgcgtcgcgtcgcgtcac

SEQ ID NO: 33894 - DNA, 1501 bp, Oryza sativa
cctcggattcgttcggaaagtttccccctaacttcgccggcgcatcaatggcggccggatcttccgcaggcgattccccctcatccggcctctctctccccctcccgaccctatataaacgctccccgtgcctccctccaccatttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctctccgtttcggtcgccgaccgccggaacgccgccgtcctcgtctacccgagccgcgccgccgccttcctccgctccggtcgccgtttccgccgtcgccgtcgaaccggggtgagccgtggaccgcccatttcgtttccctctcccctcccctctctcggccgccgctccgccgtgcctatggccgccgccggcgaccataggggcgcgggcgcgccgcctcccgtcggctgtgccggcgaggccgccttcgggcgcgccccgcggctgccatgtggggcccggccgtcagccgcccgagccctcgggtgcggctgacgcgtgggacccacggcgccggccggtgtgagccgcgtgcacccggtccaccgtggaccgagaggctgctgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacttggccatttaaactcggaattggaccgttcaagtctctaatttttccttaagaagtcaagaacccatttttgtgctttgtttctgcttgttatatggagtttgttagagtaaaagccttttcttttccgttggtcgtgtagacgctgcagcttcggaagatccgctcttcgtggaagttgaagccggcgtttgggaaagcgagcaaggcaagtcacatgatctttgaacatattgaatcccagtttataaaattatgttgatttaaattattgcattatcgctttatttaaattcccgcgttatcactgttttatttagccatgcctatttacctttgttacgaccttattattattgttattgttattatttccttgttcacactagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggt

SEQ ID NO: 33895 - DNA, 649 bp, Oryza sativa
agggcgaattcgagctcggtacccgtttcctgtattgtgtaaggagtattctgaaagatgttcctgagactatggtggctgtaaaatactgagagtgttccatcatactccctatataccaaaaagaatccaaccctagagataaatctggacatacactatatacagatttaacctcaggattaggttttttatgggacaaaggaagtaactttaagtagtgaaaaagtttggcaatcattcttggtttgataagaatcttaagcacatcagattttgcatttgggatgcaaaataatagatgaggacttactctagacattaatcattttcagggtcagggcatttgaattagcctgatgatcaacataagaaaatctgcatgagatgaacagaatgtactcgacaaagaactgggctcttcctgggaatacatctgttttgttattttgatattaacactagcctggagtttgtacttgtgaagagaagccagggagttgatatacgaacttatcatttaaagatgcactgttcatttggtccttgtttaccgaacattctgcagtaagcttcttttaccagggacttgattgatttgctcgagaaaatcaaccaagaattgctatgcttataagaccatgaattt

SEQ ID NO: 33896 - DNA, 1501 bp, Oryza sativa
aattattgcattatcgctttatttaaattcccgcgttatcactgttttatttagccatgcctatttacctttgttacgaccttattattattgttattgttattatttccttgttcacactagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtgactcagtctagttataaacaaaagtacacggatggagatggaagaagtcgggggtcgatggacatctctaggacaaatgaaggctatacgagctgcggcccggtagtcgagatgtcatggcacagggccggtgtcctgctgctaggggttcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataattgtatagttctagaatcgtgtttacaaaacagctttgagcaactaatgtctttaaatgctgtttactgcaaccctaaccctttatagtataactcctttgtactcccttgcattcgagacccctcgtgctgagcccgcgcccgtggttccccaggagggggaagcctccggcgttggtagcacggaggatgcgctgttgctcaccttccgtcctggcccgtcgtagcggtagacgagcagttagtaggcttgcgcgtgtgttctttctcgtttgtcttcttgttggagttgtgtggggcatggttatgccggtgtgtggcataactgtgtcggagcctgtctttattttatttgcctaagcaacttgaactttaatgaaccaatttaatagcagtaataaattcaagaattatggtagtcgtgggtggttagctttaattgtcagctctctctgtttgctggttctgtgtggggttttc

SEQ ID NO: 33897 - DNA, 633 bp, Oryza sativa
atatacctagtggaacatcgtgcaacatttaaaaataattcaataataagctaaaaaaaatttcgtcggaatatatccatgtgtggtcttgttttgaagatttaattgctacgaatttaatggtgcaatcggatcattatttagataagtagtttaagagaaaaatcagtttaaaatagtttttgcacgtaaatcgggcgctgacgtcatgctgacatcagcgcccgattttaatcggctcccatcgggcgcccgacgggaagtcacgtctgctcttaggaagtcttcatcagggaaatacatttcgcacccttgcactcaaactttcttgttcttgcagcattctccacgcttgtctcgctaggaggttaaataattcaaatcctttaaccccatccctcccatttcttggttctggtggtttgccttcgacggactcatggaatgagtaaacgattgaatgtgattcgtttgggcaatgaaatcaagtgctggaccccttttctctcttattgaattaactaattcatttccttttgacttttgttggatttttggatattttttttgttgatttggcattattcaacagaataaaagaaaattttcgataaattcctttttttttaatta

SEQ ID NO: 33898 - DNA, 1501 bp, Oryza sativa
cctcggattcattcggaaagtttccccctaacttcgccggcgcatcaatggcggccggatcttccgcggccgattccccctcatccggcctctctctccccctcccgaccctatataaacgctccccgtgcctccctccaccgtttccgccactcgccgctctctctccccgtcggaatcgagctcgcgccgtcgcccctctctctccgccgtcgccgccgagctccggtccgccgccgtcgtcgccccggaccttttcccgcttcggcgtcgccttcttcgggttcgccgcaacctcgccgacctcgtccacctctccatttcggtcgccgaccgccggaacgccgccgtcctcatctacccgagccgcgccgccgcctttctccgctccggtcgccgtttccgccgtcgccgtcgaaccggggtgagccgtggaccgcccatttcgtttccccctcccctcccctctctcggccgccgctccgccgtgcctatggccgccgccggcgaccataggggcgcgggcgcgccgcctcccgtcggctgtgccagcgaggccgccttcgggcgcgccccgcggctgccatgtggggcctggccgtcagccgcccgagccctcgggtgcggctgacgcgtgggacccacggcgccggccggtgtgagccgcgtgaacccggtccaccgtggaccgagaggctgccgcgtgggccccactcccgtggacccggtccgcgcgctcctcccctcggctgacgcaataaatccgattttaaattaaaatttaaatgaagaaattcgcaaatatccatttaaagagcacataaacttcaaatggccataacttggccatttgaactcggaattggaccgttcaagtctctaatttttccttaagaagtcaagaacccatttttgtgctttgtttctgcttgttatatggagtttattagagtaaaagccttttattttccattggtcgtgtagacgctgcagcttcggaagatccgctcttcgtggaagttgaagccggcgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttacgaccttattattgttgttattgttattatttccttgttcaccctagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcgaggtgcatggttttgatagtagcacctcggccatataaggaccggt

SEQ ID NO: 33899 - DNA, 1501 bp, Oryza sativa
attaggcggttttacaactctagactttgggaatgttcgtatcacctggacactatggaatggtttggttattgtgaaattggcttcacaccgctccttctattcaaaatccccaaaatggttttaggctgggctcgaggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctctaggacaaatgaaggctacacgagctgcggcccggtagtcgagatgtcatggcacagggccggtgtcctgctgctaggggttcagtcctgcctgcctgtcccgggggttccggccgtaggtgggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggcctttggttaaggcaggttcgtgtgggttcacggccttgattaataattgtatagttctagaatcgtgtttacaaaatagctttgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccgtcaagtgcttatggtcgtcgccctagtcttccgctgtttctcgtttgtcttcgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaatatgagagaagtgagaaacaccacagccccattctttgtgctcttgcacaaggaggtcctactttcaactaacgatttaccttcatcgctgcctagtgttgttcttgatctcttacaggacttcgaagatgtttttcccgatgagataccagctggacttcctccactccgtggaattgagcatcaaattgatttggtaccaggtgcttctcttccaaatcgtccagcctaccgca

SEQ ID NO: 33900 - DNA, 1501 bp, Oryza sativa
tcacggttaggatcatacttgccgtcgaactcgaatgccgtgcgagatctttccttgattggcgctagtcggcatttgatgaaatgccgagtgatctgttctccctgtaagccttgttctttaagatttaacatacgatccaacaactccaaggcttgtactgcttcatctccgattggaagagagttccaagtatcttggtacactggaggaagacaagagtacccgggaagagcaggctcgggattctggacatagaaccagtttgcatgccatcctttgttcgaagtcttgaagggcatcgagaaatatttttgactcagagttccccttagttggaatcctgcccccccgactacacatggtttgttcttgtttggttggggcttgaggaagaagatccggcggaatagggcaaagtgaggtttgatccccaaaaaggcttcacaagcatggacaaaattggcgatatgcactatggaattcgggtttaggtgatgcaagctgattccatagaaattcaagatcccgcggaaaaattttgaggtcggaagagcgaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcctccgttacgtcggatgacgcccattggccttcgaagctttctctctcttccgccattggtttcactaaaatgcgttgatttgatttgagggatggcttgggagaggtgagggattgaggctgtggatcacgggaaggattttgatgcacttttcggaggtggatttggccggagttgtgaaccctagttcgccggcgcagctttgcactgtagcagggaatggggaaaatggcgagagttccggcggggaagacgaagcgtcgcttggatataggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatcaaatcatttttatgcggtcatataattctttggaattactgcaatgcaaattaaaaaggtacccgacagaaaggcgttatgctatttttgcaagcttttttaggctacaaaagctgtttgggttaactaggaatgacttgtttttattatagtcatttccttggcgtgttatatgcctgttttcatggtaaatagtcatggcctaggctattcgacttatttattaccataatctttataatacttgatgggtaatctttagagtttttatattcggatgcctgtcgagtgtgttcattcgtgaaccttttagagtgtaaaccactcggatttcttttattgtggctaaaaagcagtcggctagcatg

SEQ ID NO: 33901 - DNA, 1501 bp, Oryza sativa
gttattttcaaccacttgtcatccacaaacggatggacaaacagaagttgtcaaccgtaccttgtcaaccatgttgcgtgctgtgttgaaaaagaatttgaagctatgggaagactgccttccacatgttgaatttgcttataacagggcagtccattctacaacaaactcttgtccatttgaaattgtttatgggtttataccgcatactcccatggatcttttgcctttaccattacaggaacaagttaacttggatgctacgaaaagatcagactttatcaagcggttacatgcggagacaagaaagaatattgagaagaaatcagcacaatatgcaaagcaagcaaacaaaggtaagaagaaggttacattccagccaggagatcttgtatggttgcatctatgcaaggatcgctttccccaacagtgtaagagtaagttatcccctaggggtgatggtccgttcaaggttctccaacagataaatgataatgcttacaaacttgagctgccacctgaatattccaatgtgagtaccacattcaatgtcaaggacttgcttccatttcctggtgagcctgagtcgaggacgactccttcccaagagggggaggctaatgaagacattcctagcattcactcatctccaaatgaagctacacttgatatagctggtccaattacaaggagtagagctaaacaattggagaaggaaattcattctcaggtgaacgctaaccttatgcttaataatcagattacattgaatgaacctatgcttttgagtacttgtttcaatgttcttaggaatgatggagtgcacgaacaagcatgggatgatgatggattctgcccgccaaatatatgcaaggaacctggacgtgcatgagagaggaaagaccattcagctaccatgaatatcagccattgaagtgcaagcaaataattcgggagttaggaatgcatgcaaccagcaactgggttgctgtccacacacgctccagcatgcatgcagagaataccaaccagccaggtgtcctactaggcttggtttttaataaaagtagtgctgcaacttcccactacatgttctcaattattttccaccaagctgaaactccactagtgctatatatccctgtaatggatgacgtgaacagtaactcgtgattgcaatttcagaataccaactcttggaattcttgttccagcgtgagtcttgagaggcttgcaaacttgttctttcgattcctgagggagttgtagaacgccgaactgtggttcacccagtttgtgccttcacgtctatacggcgtaattgcgtgggctgttcgtcggtacgtggaagggtgattgtctcggtagttcgtcgcgtggacagcctcgcggtgcattgcctcttcaccaggtcacgcaacgacaatttatcaagttcgcagatcctacgagaagatcgggccacaacaacttgctacacatgctgcatagacgtgtgcat

SEQ ID NO: 33902 - DNA, 1501 bp, Oryza sativa
ataaaggacagatttaacatatcgctgaagcatatagagcaaatacaattaaatcaggtaagatcagctgaaactccgacgctaccctaatcggcgaccagaaggcaggctagagattgatattctaagcacgacttaatagatcaaactcaactgatgcagcattaagtatgaaaagaggaacaatatctagacaatcaagccgctggaagtttcatagagtggtagatatcttatataatctaggtcaacgtcactatttaatccaatcggttgccttctgttgacagatgttagccgattataggttagatgacgatattgtcgaagattatgtaagatatacgataatttgacgaattacatagacaagattagagtatcataaagatggaagcactaatcccgaggacagaatccatcataacaagttttacctcttgttgaagatcgaaactgatgcagctcaacttgaaagcaagaactcatcgaaataaaactaaagcaacaaggtggtgatgcgccgagattgtattgaacgtgtgtgttcttcaagttacatagggctcgggtctatttatacccgagaattacaagatatgtccataacggacacgactatgatctctaacaaactctaagataccataagtctttgcagcagacttttgcccaagcatatctataaggaaattacataaaatatcctaattaatagatacaattgccttctcaaacctctatccatgtgtggcaatcatcttgaagtgcctcaattcaacccgacgtcatacatcaagttgtattgtcggaatcgactgcatcggcttacctagtccgactcagacctagccgatcctaatcgtagccgatctggactccagccgattcctgctctgttttcgaactcgatctctgccttcgacttcacttcgatctaatcttctttcccgatgccgatattaccaattttggatgttaacacatgccccccaagtctagaatatttggtaatgtttcggatttgctgtaaatcgactctgagcaagtttcgcactttgccgttttccgaccgttactgccgtgctttaaatactaaccgttaccctcgagaagtctcacacagtcctcctccgttttcaccgctgaaaccaactttgttctctctctctctctctccggcgatctccccgacgtacaaagcaatccccaggcgatttcgttcctgatcaaatctccacctgcggcgatgtcgtcttgtaatgccctagaaaaaaaatagaataccgtagaggatatattggaagttcctaaggttttggtgtttgaaattagaagaaaaacaaaaggtatatgctagctaggctagcttttggccagcccaaggcccagctgccccctggacatcctcaaaacactaggagatcccctccccacctccccctagccgtcttttggtacccctgggcgcccacctctccctctggtcgacctccccatg

SEQ ID NO: 33903 - DNA, 1029 bp, Oryza sativa
cactctaggacctacatgtcaaggaatatttcttttcttttatttttctttttctctctccttctctaccccttcccttcttcctgctttcttcttccggttttcgaaagttagcattatattttcaataattttattgctactatcacctttcttaagagattgttattctaggtttctcttaaaagcaaagattaaggttcatgaaaaaaatgcaatgcgttaaatgatttactcctggttgagaggaaatgattgttgatagtagaatgtgagaaatggttgagaggggaggatgtttgagggtagaacggaaagaaatttaaatatggcatgataatctttgtggaataaatttgaatccaagagtaaccatttttttaggatattagaaataaaaaaaatggtaaaatcgtgtgaattatcgatgtccaaaactataagtggaaaaactggaacattaataattatatggtataaatgttatataatcaaattgtatgaataaaaatgccttttatgttggtaatccaaaagattaaatgctatccttggttaagaaattatagtcaataaatacagcaaaagaaatagaaattatcgagtctgtcactctttgtcagttctaaagcctgcttagagcatgtataatagcagactataaacaagctataaacacatattaagaagttagaagaagagagagatgagcagcgggctatagctacagcatgagcatggattttaagacatattgtgtgtatgataggtgagaccagatattaatagtgtagtatatatttatcggtaactattatataaattgactattaaattgattacagatgatttggaatagttagctgtaatcttaaacttgctcttaagcatatgtaaagtgatcggccacgcccgcagatcccaatctcgctgggcttttcgcccctcccaatctcccatagtagccacctcgacgcaaaccctaatcccatcgtctccgcctctccctctccctcctccccgcctcca

SEQ ID NO: 33904 - DNA, 1501 bp, Oryza sativa
gaaagtatgccataatattgcctaaaataaacaaacctaatttatgttttgcatgcaatatgctattcatttatttgcaacagtgagtgctcatcttggttatacatgtggcaatactgctatgtttggctgttgataatattaactatcatcacaggttgatttatagaaaactgtggtaggaagagttgacacagcagattcaatgccaacaccacgagtggattatttcaaaaggagtataggtataggtcatagtggtgccaattctatcaactcacagtgtgtttagttcgcgaaaagaaaatttttaggtgtcacattggacgtttgaccggatgtcggaaggggttcggacatgaatgacaaaactaatttcataactcgcctagaaaccgcgagacgaatttattaagcctaattaatccgtcattagcacatgtgggttactgtagcacttatggctaatcatggattaattaggctcacaagattcgtctcgcgatttccgtgcaaaccgtgcaattagttttttttatctatatttaatgctccatgcatatatccaaagattcgatgtgacgtttttgggaaaaaaaatttgggaactaaacaaatcctcagtttttagtttttaccaatgaattatgtgaaaaaagagtggtaaggaaaaaaaattgcaaacatgccttcaattgacagtttaggtgcagccagcctatgaatgcactaataactccaaaaagacaacatatttatacaaacaagtgtacagaacagtagtaatctactagtatgataggttgagcacttcaagctgcaaaagaaaaatgagaaaacaataaaggtataaggaaattacaagatagatacctgtggagtgagaatttgacaattatcccttgtgcacctgaaaagaaggttgcgcctttgatctacagagtccctggtggcaaccaagccatacacatgcagcggccagtcaagaccaccttttgcttctttcacttggagagagaagatctgcaaggtatcaccacagcaagcatatcttgggataggtccctccgtatagcgcatgggacatacggttgctgcagtcaagtagcagtaatatttattatcaaataatagcattgtggatgctattgttgtgtcccatttttgactcaaaaatccaagttttagttaaatgattgatgtgacaatgtggataagcacatatatggagtactagacattaaccttgatgagaatgaggagtaagatgaacaacatatcaagactgctctgagctcaatcccaacataccatctcacagttctacgtacaaaaatggttgatcaagaaaattgacagaattaggagagcctttttgtggaaagggtaagacccagaaaatatcacccctggacacagtttggtaaattgggcgactgtatgccagccaaaccaagaaatttgggtggacccatttttggagctgcaggagttcgccagg

SEQ ID NO: 33905 - DNA, 731 bp, Oryza sativa
cctttggtggatggggaggagcagtcgtcctatgaccccatgggggaaaagttgaagatgatgagcggcaagattatttcggaggagcagcgtctagtggagttggagttggagttggaagatgaagaggaggtggaagatgaggagttggccgagctgataacggcgcgagacttccgtgtcagctgggaacatcgctttacccctcgctattccttcaacgacaccagtaagtaataaatcctcctccgccccgccgttttattctgcttccgtttctttctttacttcaacgcaatcaagattatttctgcgaatctatctatcatgtttcgtatcaccattatatactggagtatataccactatctatttgtgctccaattctggttgttccaagtgtcttgttttattttgggttaagagattgccaggctaaatacctgtgtttgtgtgtcctcaactatatatgcaacacatttagcatgtgaaacaagtgctaggttttcctaattacactctataaaccatcacagtacaaatcctgttaatcacaacaggatactagaaagattaaatttgaaccagatccgatagattatctgacgtggtgccaactaattatgtttcatatatatattgggccgcaaaagcatgttaaataatctgagccaatttgtcttttttttccccttcatctagcacaatgaattctgacagaattaaagtgg

SEQ ID NO: 33906 - DNA, 1501 bp, Oryza sativa
agttatgtgtcgatacggatggacatagatttggtgggttgctcttgtctcaaatttcacactagacaatgttaggtttaggattatgtttctgtgggattagcgcagctgattgctttttccacttcggaaattcgcctctttccaaacgccacataccttctctcctctctaatcctccttctgcatgctgtttgttcttgtagcatacaaataagttgtgcttgtggctgcccatggtatttttgcattcctgcaattgatttatttattgtttgagtgtgcagccagtaactaactactcggtcaatctccaggtaagccattccaaacgataatcacattcaggtaggcaaaggtcatgcaaggtctgaaaccattcaaacttcctatgcagtccatgttggcaaaatacaaagtatgagcttactagtgaaattaattccaaatgcaactgcaactaatgaacagttttcttagtcatggatcagaagaccaggagagatgaatatgcagatgtgatatcaaatcaacttgaaggtaacataagctcactgtcgtagtacacacattttaattgtgcactctgcagtatgtagtgatattaccaaacaaattgacacgattcatgcatgtttgcaaagattcacgttaaaggatttcattgtagctcattgatctttcgatttcttcttttgacagtctctttcaatgtcctgcaggagggaggccctcatctgtgtaatgttgccttcactgattcttttgtccaatttcctgatccaatcagctgggccactcttgttggcattggctctccaccatctgcatatgacctgtacagcagccagaacatgtatggcgcaatcatttccattagtctgctggggcgtttcagcgttaataacatctccagcagtgggcagcactccccgcagaacatttgcaagcttttgagcagcatgcagattgtatgagttatcccctgaacgcacactgtcatggtggatgaactggataacaccatcgttactggtcttgtggatgactaagaggctccagtgtttcccatcaccagcttggttgaaatccagattatcatttactggtatgaggaccaggcgacgactagcaagtagcaagtggtcggcctcggcagcaacatagtgtttattgttcagcaatgctgcgttcgttggttgcaccaggagtaggccatcatctgagtaagctcttgaaaatttggccaaggcatagcccaggattgcatctgtcacccaatgtgggccgcgtagactgtccaaatcagattcatacaggttaatcccgtcacagctgatcaatgaacgattctgatggttttcacctccagatggagcgccaatagtggcatctgtgtttggattctcttggtttttcttttcatcaacctcctcagcctgagttttcttgtggttcttctgctgtgttaccaccattggagtaactggtggcgctgaaa

SEQ ID NO: 33907 - DNA, 1501 bp, Oryza sativa
aatgattgggaaaccatccccactgctttcattaattggttttgacagaaggccttgatgaaaagctttgttgattactctttgcaacagctctccccccaacacaaaaagcagaggtgagagaggatccccttgtctgactcctcttctgcatttgaaagaattccctggcaccccattcaataacacagcagaagaagcagtagagaaaaccatctgtacccactcaatccattttggaggaaaacccatatgctacataactgaaataattgcagaatgctcaatggtatcaaaggctttttcaaagtctaacttcaaaagaccaggcaagtcaatcttgtatggtttttcctttgatgaaaccatattggttatcactcaacagtttaagaattatcccttgaagtctgtcggctagcaatttaattaagatttttagatacccataagggaaatgggtctgaaatcattaacagtctttggaaccagggttatgaaagagctattaaggatttccaaatcaacatttccaacatggaaatgagctgccagtctataatagtcctgagctatgatatgccaacactttttcatgaagaatccattgaaaccatccggccctggtgctttgtcagctggaataatggagatgagactatctatttcctgagttgaaaacatgtcaaccaagctgttcaaatctatgtctgtcaaaaatagagtccaagataacgatgttagccgattgtaggttagataacgatgttatcgaagattatgtaagatatatgataacttgacgaattacataaacaagagtagagtgtcataaagatgtaagcactaatcccgagaacgcaagccgccataacgagttttacctcttgttgaagatcgaaaccgatgcagctcaacccgaaagcaagaactcatcgaaacaaaacgaaagtaaaaagggtggcgatgcgccgagattgtattaaacgtgtgttctatcgattacatggggtttggatctatttatacccgagaattacaagatatgtccatatcggacacgactcttatctctaacaaactctaagataccataagtctttgcagcagacttttgcccaaacatatctctaaggaatttacataaaatatcctaattaatagataaaattgccttctcaggactctatccatgcgcggacatcatcatgaagcacatcaacctaaaccgacaacatatgctgcgtcatattgtcacattcggctcaatcggctaaccccgtccgactcgaactctgccgatcttagccgtagccgattcggacttcagccgatcctcactctatttctgggacgatctccatctcaatttcttctcgatttcttcttcatctctgatccttagattaccaaatttggtcgtcaacagtggcgtatcccctctcctcctaggggggcttgtatttatacccatagatgcccccttgtccaagtaagacta

SEQ ID NO: 33908 - DNA, 1501 bp, Oryza sativa
tacatctttattttttttttcaattttcacaaaagaacaattaattaagaataattaagtctggcatcttattctcttagtagcagcatcctaacgtggtcatccttttttgtgaactttagccattaggggcaaggttaagcactaattcaagagggttagtgctaaccactagttgatgtggtttagcaattggcctcccatataattccacctccggtagacacgtgtctagcacacagacaaatcaaatactcctgtacattttttttgactaaaaaaataaaatgggccaaattaaaccccttggtgtggaataaagataagaaaagaaatttttatcccatcacaaagattgacagagacggtaggagcctggcagggtattgttgtgctctaatcacaagtcctaatcacacaataaattaatccacctccttaaggcagcaccactccttgcaatgtccaccattgttatccaaaggtttctccaattccaaaaccccaaaacaccttttgcttgttacatcatggagatatgaggcatcatgggcatttggtatttagcaccgattcctctggttaagccccaactaactctctccctccaggacattttttttctttaagctagcttatggaagtggctaagactgcaactatggcaattaatatcctaagttgatcacttaattaagccatccattcctacacggatataccaacattgttctaagcccatggctgttgaacaatacacatgaccctcctcccttactaatccttttaattgaaaagctccttattggcttcccacctaagcaatattgtcatcaaacatttagacataaagataaggacattcataaatgattttattttccatgtaagctattgtagtctcctgattcgttcatgtcgatgttcaaaaggaattctacttttgtaaacaactcacatgttgagaataaagaataaatccatcacataaatttagaatacaatcaaaattaccatctctccattttaaaaagtgtccctaataataccaagtttaggagaatgaaaatgccatgagaagaacaataccttttttgtataaaaaaattatggatggtcattttaaaatatatccctaataaaaccaagtttgggcatttgggcttggatgcttgattacaatttagtactagtgtactacataaatgtctcatctcctccacatgatgagtgtctaataactaaaacaacccctccaaaatcctcctaatcccttctcttaagacacaacccctcttccctccttccttcatgccctctttgctctctctctctctctctctctctctctcccccttcccttcttccccacgcgtcccctcccctcctcgccgttatctctccgttacaccacccgcctcacgccgtcacgtcaacttccgccacaaaaaaaaaaaaagaaaggcacacgcgccgcgcatgtccaccgccggcgaccccg

SEQ ID NO: 33909 - DNA, 188 bp, Oryza sativa
aaaattagggtcattcatcccgggcaccggtcagaccggtggtacagaagtggtcagaccggccactgtacttcggtcagaccggcctcggaggaatttttctgaaaattctaaaattgattttgcacgtggatatatgcttattggatcttctggtcgtgtgtttcagtactggattcctaaatttt

SEQ ID NO: 33910 - DNA, 360 bp, Oryza sativa
ggcgaattcgagctcggtacccatccaacggctgataccactccactgctcttctttataatttaatggtcaacttcagctcggaagccaaataaaataggagtagtataatgtggtgtacgtgtacctctgttactgacgagttcagcccaaaggccaccacttccagcgtggttaatctcctgcacaaataataataatacagatttcgataaggaaaaaagcaaagcatccgcaggagaataaatggaaaaagaagaaagaaatgaaaagaaacgagacgtagctagctagctagtcacctcgaagaacagaccgaacagagtgtccggcattcttcgagcgacagagtaatcgaca

SEQ ID NO: 33911 - DNA, 313 bp, Oryza sativa
tcgagaagtcataatcatgaaataatcacggatatccaaacaaacaacccgaaaccgaaaccgacacagtgtcggccggtcagaccgtgggctggccggtccgaccgctcgatcaccgccggtctgaccggcatacacagcccggtctgaccggtcacatgaaataataaaatcctgcgattacctgtgaatccaatcatctccaaaaccacttcgtgaataaattccaaataacaaaaccaataatctccaatgtctaattgttcatcacagaataataatcaaaaatacctttgattttatatggcgatga

SEQ ID NO: 33912 - DNA, 1501 bp, Oryza sativa
cctggcggacaatttcatcgggtttttctgtaaacttgctgaggaatgattgtcgaaactagatttcggcaataataaaagggggtggctatcaagctcggaaagtgtatgggtttggagacaaaagatttatacaggttcaggccttcttataaaagaagtaataccctactcctgtccggggatgaatccgccgagtgtattattgattgtatgattcgggaaaaatcagcatctacccctagaggcgcccggaccccccttataaatgggaaggagtccggattacaaaagataatctatattcctaacggaatatgaagatataggtaaaatacagtcgtaaccgactaagtctcagggtgtttccttgatatacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatgataatccgagcacttcaaactcttcaagccaaaacctgccgagtggactgtaaagggcgaaaagataaagaatatggtgcatcgaatagatgcacctaattaggtgtagcccccaactatgtgattagttagcaaactaaacatatagttgaaaggcaaaataataacacaattgtgcattatatgacaaaagcatacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatgactataataaaaacaagtcattcctagttaacccaaacagcttttgtagcctaaaaaagcttgcaaaaatagcataacgcctttctgtcgggtacctttttaatttgcattgcagtaattccaaagaattatatgaccgcataaaaatgatttgatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatcctatatccaagcgacgcttcgtcttccccgccggaactctcgccattttccccattccctgctacagtgcaaagctgcgccggcgaactagggttcacaactccggccaaatccacctccgaaaagtgcatcaaaatccttcccgtgatccacagcctcaatccctcacctctcccaagccatccctcaaatcaaatcaacgcattttagtgaaaccaa

SEQ ID NO: 33913 - DNA, 583 bp, Oryza sativa
  unsure (1)..(583): unsure at all n locations
gagggagaaaagaggaagggaagaagaaaaaagaagagggggaaagaagggagaaaaaaaagagaggagagggagganaagggaggagaggaggagaagaaggggggaaagaaaagaagagaaaggaaggagaaaaaagaggaaaggaaggggaaggaggggaaaaaanaannggnnnnannnnnannnanannnngnnnnnnntnnnaannannnnnnngnnnnnnnnnnnnnnnnnnngnnnnnggngtcatctattaaaaaacggaggtagtatttaataaaactaaaatatgaaaaaaagtttaactcttttgatggagggagtatataagatcaggtgaactaacgttgaggagcaaagttgattgtggtaaaagaaaggcagaaagcgttattagactccctaaagacgaacgataagcccttcgcaaagacgacggcatgcatatggtatgatattagattataaacagttctagtggcgcacagcctcgttgtcacccgtcgcgcggcgcggtgacgaagcagagtgcgagaacaagccagcaaagaaccgcgggaaggaaaaaacaaatcgtaa

SEQ ID NO: 33914 - DNA, 1501 bp, Oryza sativa
gaaaacattaaactatatataaaaaaagcacgtatctaactgtcgaaactagatttcggcaataataaaagggggtggctatcaagctggaaaagtgtatgggtttggagacaaaagatttatacaggttcaggccttcttataaaagaagtaataccctactcctgtccggggatgaatccgccgagtgtattattgattgtatgatttagagaaaatcaacatctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagtcaagaaacaaacccgagatacaaataagatattctatacatattcggtatcctatatccagcccaaatagtatcgccgtgtagatatgggatatccataatctccacagtagcccccgagacctttgcagtcaaccatcgtagccttctcaaagatagcaatccgagtgcttcagattattcatgccaaggcccaccgagtagcgaagacgaagactgtaaagggcgaaaagataaagaatatggtgcatcgaatagatgcacctaattaggtgtagcccccaactatgtgattagttaacaaactaaacatatagttgagaacaatataataacacaatcatgcattagatggcaaaagcatacgcgtcgcctaaagaggcattctagccgactgctttttagccataataaaaagaatccgagtggtttacactcgaaaaggttcacgaatgaacacactggacaggcatccgaatataaaactataaagattacccaccaaatattataaaaattatggtaacaaaaagactaatagcctaggctatgtcaagttaccacaataaaaataggtatataacataccaaggaaatgactatgataaaaacaagtcattccaagttaacccaaacagcttttgtagcctaaaaaagcttacaaaaacagcataacgcttttctgcagggcaccttttaatttgcattgcaataactccaaagaattatatgaccgcataaaaaggattttgtcagcattgggcaacactattgtgtgcataaatattgccaaagcaaaatatgcctaagtccctaaggaacacaatgggccacgctgttaaaagtattgggctgaggtactgttcaggcctaggcccatttgcacctccgatacccttaacaaaaaatccgagatccaagcgacgcttcgtcttccccgccggaacgctcgccattttccccactccttgctacagtaaagagctgcgccggcgaactagggttcatcaatccgtccaaatccaccttcgaaaagtgattaaaaatccttcccgtgatccaccgcctcaattcctcacctctcccaagccatccatcaaatcaaatcagcgcattcgggtaaaatcga

SEQ ID NO: 33915 - DNA, 1501 bp, Oryza sativa
aatcaactagcacgctagcatacccaaaggcgagtttggacctgcactggagttaagcagatctcccaggcctcgtgttttccatcaactcctacccgcgaacccccctacccctctcaccatcccccgtcacccccaccacctacccaccagtgtcaccactcgccacccatgcccatccacctctcacaacccacaagatgtaccccataaccgccaccgccaggacgcctttttttattctgaccacaacttatcgagaataattcatttactgaaatcgtagagacgcacacgcctcaattagtaacgcgtttactaggccaacagttctattgccgcagcccatgatcggtcaaaacggaaacggctgaaacaaatcgccgcaaaaggggcagtttctgttttagtctctctcctttatcctcaccgtcaaccgtccacggtcatttcccactttccacgctctcctccccgtctccgtcgactccacccctcgccgatttcgccgcaatcccttcaccgggtacggcggcacgcactcccctcacccacattctagttgccgacgaccgcggcggccgcatcgaggaagtccaccgtgccatcggcggcgcctagccgcggccgaggcggaaagcaccccgacggcggcacctagccgcgaccaaggcggccaccaccccggcgaccctcattggtacgcgcgactgaggaatcaacacacgcacaccagagctacactgattttagcaaaggttagtacaagcatctacactacctgtcatacacatccatttctccgatctaatccaatacccattgttcagctacattttttaagatgaagcggaagggaaaaatgccagagaaggttaggagagtcaagttcatggggtcgcaataagaatgcaagattgtgctcgatcaatcctagccgagtgagggcccaactacccgctccaagcgagctcgtgcagacggaggaagtcaacaaggaaccgccaaaaaacgtggccgcaagaaccagtaggatagagccctgaaggacgctgcacttgttgaggtgaggcacactctattctttctcaaaaaccctaaccctttattccctttgtttggttgctgtccatttatttctgcgtgtgtggttgtcgtcttatatgattgggattgatgtagggaccatggtactaccaaatctttctgtttttgtcctattcataaatccgacaggagctttatgttctgtgacccaccatatttttcccccacttgatctaaatcatgggtaatgcttttcatataattaagggttaggattaaaggtaagaggcagaatgcacggttacgatttagggctgtcttttggtgtgtgggaattcatttacccaacacattagccaaacagggcaatagtgtaggaacatactcagtgttagtaaatgcattactctcatcagtgttagtaaatgcattactctcagtgttagtaattgct

SEQ ID NO: 33916 - DNA, 1501 bp, Oryza sativa
ccgttcgtgaggccaagattgaattattggaaggaaggcttggaagatttgtgatggatgacaaggagacaccacaagagatgtatgataggatgatgatccttgttaacaagattaaaggacttgggagtgaggacatgacaaatcactttgtggtcaagagacttctccgtgcttttggtccaagaaatcccactcttgtatcaatgatacgggaaaggaaagatttcaagaggctcaccccaagtgacattcttggaagaattgtgtctcatgagatgcaagaagaggaagctcgtgaagtgaggcaaatggtgaagaatgccgccatgatcaaaaatcaagaagtagctttgaaggcaaaacaagaagaagagtcaagttgtgaagaaagtgaagatgaagaaatgacttttattgtcaagagattcaagcactttcttcgcaagagtgactatggcaaagggaggaaggatgatgacaagggaaagaggcaatcaaagagagctttagcaaacccgctatgcaacatttggctaagttaatgagagctttggatagtaaagaacaatctctcaaaaggcatgaaaaattacttattcttgagaagaaaagaaaccttgccttagacgagagcctagctaaagaatgtgctaaaaatgaacaactagctaatgagcttaatttggctaatggttctctagctagccttagggatgtcaatgaaactcttcaagagaagtttgctagtttagacaaaagtcataaagatcttgatgttcaatttgacactctttggaatagcacttctcaaccaaatgtggtttctaattcttccaacccatctactagcaatggttgtgctaggtgttacaatattgatttgaactctcatgctactaatgttgatgctatgcaagctcataagaaagagaatgaaaggttgggcacattagtgaagtatggatgcatgaagacataccattcaaaagatgccctttacaagaccatctccgctcatcctaacaaggattgatacgggctcgggttttctggtggaagccctgtgtctaagcgtgtgatggtaaatggggaagaatgcttgatgtttgtaacagaaggaaaagctccacaagcaagttccggacttgccccctcactggtcagacacccggaagttccgggcaaaatgaccggaagttcctgccttgtaagacaggaagttctggacattttgtcaggaagttctgggcttctaatagggggaaggggctggccggaagttccggttataatgctaggaagttccggccagagggtcttttctatgattcatatgtaatttccaaaaattcagagggcaaagtggttgcttattttattgggaattacaatgatgagtaccgcacttgtgtgtgggtgccaaaggctttggtgactaacatcaagggacctaaacttacacaagtttgggttcctaaatcccaagcttgatctcttt

SEQ ID NO: 33917 - DNA, 1501 bp, Oryza sativa
tcgttcgttcacgtctgtccacgtacgtttgttcacgttcgttctcgttaagttcatgttacgttcacgtggcggcagtggagcggcggcgtggcggcgcggctgcggcgtggcgcggtggcggcattgcggcgcggcggtggcgtgtcgcggcggtggcgttgcgtcgtggcccctttccaaacactactttaagatctttaaccatagcaaacactgttttcccgctgcgatgtttaggcttcgtacggtggtccaccttatgttcaaagtgtttgcctttcttccgtaccgggtggtttgcagcaaggaatcgacgatgacccatgtacacaaccttcctacagtgcttaagatacgtactttctgtttcatccatacagtgagtgcaagccttgtaccccttgatggactgcccggaaaggttgctaagtgcaggccaatcgttgatggttacgaacatcagcgctcgtaggttaaactcctcctgtttgtcctcgtcccacacggggacaccttcctttttccacaacagtttaagatcttcgaccagtggtcttaggtacacatcgatgtcgttaccaggttgcttggggcctcgaataataatcgacatcattatgtacttcctcttcatacatagccaaggggggaggttgtagatacacatcgtaacgggccaagttctatggccgctgctcatctctccaaaaggattcatgtcatccgtacttaaaccaaaccgtatgtttcgtgcgtcctttccaaagtctttaaaatttctgtcaatgtttcgccactgcgaaccatcggcggggtgtctcagcatcccgtcctgttgacgttcttcagcgtgccatcgcatcattctagcatttcccttgttcctgaacaaacgccttagccgtggtattatagggaaggaaaaagtacgaattatcccccccaaactactgtggcagtatgaattaccccctcccccgaaccacaaaaacagacatattacacctcgaactattgataccggaagaattacccccccccccgaatcattcctaagcggtttttctcctacgtggcatacacgtgtcgctgatgtggaaattcaatcaacaaaaaaataaaagaaaatatagggcccacctgtcattatctctcttcaccctcccccttctctctctcaggcgtgtgtcgacgggtagtgggcggcggcagtggcgcgtggacaggcggtcggcatgcggggggcgacggcagagtgcaggaatggcacggcgagcgacgggcggcgccgaggagggcattggaggatgcggcctacgtcgtcatcgtcgtccctctctctctctctcggctcaggcaaacggtgaaagtgcattaatctccctagtgggttttggtgattaatgacaaatgtagttaagggactaatgagttcattgagtgactttcagctgcattagtccaaggtgtggaagatggatgcttggagaccccctca

SEQ ID NO: 33918 - DNA, 314 bp, Oryza sativa
tgttcatgtcttgcacataatccatacctcacgtataagatgggagaaaaattgtgggttagtatgcttgcatatgtggatataccattccctgaatatatggttatgaacttatggttccttaatgttgaaaaaaatgtttctcaagcttgtgatgactttgttaattaaggtttaaagagttgagggatgaataatgtccagttttgaagtttagggacgaattttaggctttgatagagttcagggacttaaaataataaaatgtacttttctcttagttaaatgacaaacaacttcctgtttgttgcagc

SEQ ID NO: 33919 - DNA, 165 bp, Oryza sativa
atattattcaatttctaatatagtgatattctcgaagtagtatgttctttctatttctaaaagaagaaacatcactatcgttcgctagtacatgttattatgggctttccgacagtgaaactgataagatcatggatgatatgatacttttgcctcctccatagc

SEQ ID NO: 33920 - DNA, 1501 bp, Oryza sativa
gacggagaaacaaattcttatgagtaaatggtactccctccattccaaattgatctacatatttcataggtacactaagaccaagaaatactaatatctctctcatactgtatttactatagcaacaaattcgatatatgcaccatccccactattgtctagcaaatagcaaatcaagatattgcatgtgggttatcaatacttgtgtgcatggatgcatgcatcaatgtccatttactctaatgcacaaataaaataacgaatagacttaataaatgaacacaaatatgtagatcatttaggaataacctaaaaaaaattatatgtagatcaatttggaatggagggagtattgtacaagaatattatattaatatatggagtatgaattatgattgacgaacaaaagcaaattaaaattatcgtgagacataggtggtgttcttttctcctgaagatgaagatgaagattatttttttatgcaaaacgaggtggtattaacgtactccctttattcctaattgatcttcatattatatgagtgcaccaagaccaagaaaatataataactctctcatgctacatttactttagcaataaacttgatgcatgcacaatccccactattttctagccaatagcaaatcaaaacacttgtgtgtatggatgcctgcatcaatgctcatttaccccaatgcacaaataacgaatagacttaatgaatgaacataaatatgatgatcatttaggaatattttcaaataaattatactcccttcattccaaaatataaggcgtaaccacacttgactcaaagaacaagaaacaattattattatctctttgtttgaatcaatccaactaacacaatacatgcaccctagaattaagcatcttgtgagtgtatgatttaaataataataatttaggagagaagagatgctaattaattgccatacatacatgcacgccttatattatgaaacatctttaaaaagtagttgtgtcctatattttggaatggagggagtacgatgatcaatttggaataaagggagtatgattgattgagttttaattattacaaacttgaaaaataaattaatatgatattttagagcaacttttatatataaagttttcgcacgaaacgtgcagtttagcagtttaaaaaacgtgccatgaaaatctttatcttaatccagctcttgtgggagaaatgagccggaccatagtaacctttgttgtcaatttaataagacgaatcttgagacaccttggatgatcaatccaaatatatagtgcatacaggagtacaaattttgcatccaactaaaactgaactcgttaaaatatcagtaagctacaacctccattttgaaatataaagaatttcaattgtatatcttatggctgggtttaattcgtagtactgctagcaggatcgagacagacagactccagccacacccttgcagtactccagcatcgatcgatcga

SEQ ID NO: 33921 - DNA, 180 bp, Oryza sativa
aaagacgtttcttataaattattcaatttctaatatagtgatattctcgaagtagtatgttctttctatttctaaaagaagaaacatcactatcgttcgctagtacatgttattatgggctttccgacagtgaaactgataagatcatggatgatatgatacttttgcctcctccatagc

SEQ ID NO: 33922 - DNA, 349 bp, Oryza sativa
caagtgataaatgctatggctatattcaatatagcccgcattgtacgctaaacaaataacacgctttaacgtatgtatattaatagaaaaaatgtatagcatatttgtatacgagttttcaaatctcacaagaataaaaccaatagtattatctatttaattcatttttatagctatctttgataaaattataatccaataacattatcctcagtttcttttttcaccctctcatgttctgatgtgaaaaaccctctgccctcttgaacccaagaggcttgcagcgaacacacgcagcacggaaaggggaaaaaaaaagaaaaccaaaccctctcgtcttgtccttccc

SEQ ID NO: 33923 - DNA, 377 bp, Oryza sativa
aatgtctaacgaaaaaagttatcaaacaaggctaacatccactctaataaagtttacctatcttcttaacatatctgccacattatctccttctatcttttacacaaatagcaattctaccttgaatgtatctctgtgggctgaacaagcactgcatttgatgctgagagtatacacaaagctggacaaagtgagcctcaaattgttctgtttgttgggacccttgcaaagaactatcctggcataggtaaaaaatataactacagatgtatctttgcttatgtagagcactgcaactaactattttaacaatacagggttagctctgtcgagaggctctgcatgcaagtggtacattaacataaatgtacctgaga

SEQ ID NO: 33924 - DNA, 1501 bp, Oryza sativa
aggagctccaaagagctgggtctcgattaacccctttcctcacttgtgcaaaaaccccaaaggaaatccacagccttcaaccccaaacacccctaggcaaatttctagaattgagtgaccaccaagatccaactcaacctacttctagaaatccaccacaagtgtgggttgctctacttggaaagcctctagaatctcagcacaagaacttcactaacttacctagttccctttcggaggagaggaaatccttcagaaactttcccgggaaatccgcaatatgcaacggattctcgcgggcgacacctaaccatctaggagatcatctccaagagtaataagcaccgtgatgacaacccacgagataattccaagtgctcacccaagatcctagtcttcacacatctccaaatcttcttctctccctctcaatctctctttctcacaagaattaggctctagattgagtggagaaggcaagaaacacttgggaggggctagcaatagctctaggtttgaaaagtaaaagtggaatagacaaggaacgagctagaaacgagctgtatatgtataacggctaggtgacgtcatctagccgttactcacaaatttgaactggaaactagacaggaagttccggacctagaagaccggaacttccggactacacttaggaaaaactttttcacaagaccggaacttccggacctggaagacaggaagttccggacttgcatttttggacagatggagtatttgcaaaaatgactcctagggaaacttgacacttggctcacactaagagcacttgacatatctctgagcatcacctggaacccctcttaatagtatggtttttcctaaaaactcgattgcaataaataaactatcctatgcacttctcgagttctggtccgcttgattttatacttttgagggggtctccaagcatccatcttccacaccttggactaatgcagctgaaagtcactcaatgaactcattagtcccttaactacatttgtcattaatcaccaaaacccactagggagattaatgcactttcaccgtttgcctgagccgagagagagagagagggacgacgatgacgacgtaggccgcatcctccaatgccctcctcggcgccgcccgtcgctcgccgtgccattcctgcactctgccgtcgccccccgcatgccgaccgcctgtccacgcgccactgccgccgcccactacccgtcgacacacgcctgagagagagaagggggagggtgaagagagataatgacaggtgggccctatattttcttttatttttttgttgattgaatttccacatcagcgacacgtgtatgccacgtaggagaaaaaccgcttaggaatgattcgggggggggggtaattcttccggtatcaatagttcgaggtgtaatatgtctgtttttgtggttcgggggagggggtaattcatactgccacagtagtttgggggggataattc

SEQ ID NO: 33925 - DNA, 497 bp, Oryza sativa
atgcagaatttgaagagagagagagagagagagagaggtgttattactttaaatttgtcatcttaggtttgttttgtaatgtttcagctaacaaataaaaaagagtaaagtgcaccagcggtcctcaaacttgtcgaggtgtgtcatctaggtccctatactctcaaattgcactttaacatccctaaactcaattatgcgcctattagtggtccaaaccagcctcgggatgacttttagccgacgtggcatcatgacgtggatggtgctagtaagctgcgggggtaatattgcaaaggagccctccttttttttccaaatcgtcacacacatcttccctgtgtcccctcgagttcttcgcgtcagagatgagcggcggcaaggcaggcgacgcaaggcggcgatcactggcgaatactccatccttgctccttgctgctgccgaatccctagccgtcaatatctaaatcacgcagccccagtaggtcctttcgttg

SEQ ID NO: 33926 - DNA, 1501 bp, Oryza sativa
aaatgcgaacgtgaatgaacatgaacgaacgtgaatgaaacgcgaacgaacgtgaacgaaacgcgaatgaaacgtgaacgaacgtgaatgaaacgtgaacgaaacgtttaacgaacgtgaacgaaacgttaacgaaagtgaacgaaacgtgaatgaaacgtgaacgaacgtgaatgaaacatgaacggtcgccttatatgacactacgtgaaatacaatatatgttactttgcgtttagactaatacatttttttgtatgttgcagaaaagacgtcgtcgttgtcgtccctcaagcctgagtggtagctagccctcgaaggaattcgcaggcaagtgatgtaaatatatgattgttagatttttaatataatatcctacaggtccggaacttcctgtctagtctccagttcaaatttgtgagtaacagctagatgacgtcacctagccgttatacatatacagctcgtttccagctcgttctttggccattccactttcacttttcaaacctagagctgttgctagactctcacaagtgtttcttgccttctccactcaatctagagcctaattcttgtgagaaagagagattgagagggagagaagaagatctggagaggagtgaagactaggatcttggatgagctcttgggatatctcaagggctgtcatctcggtgcttattactcttggagatgatctcctagacggttaggtgttgcccgcgagaatccgttgaatattgtggatgtcccgggtaagtttgtgaaggatctcctctcctctgaaagggaacgaggtaagtgaatgaagttcttgtgctgagattctagaggttttccaagtagagcaacctacaattgtggtggatttctagaagtaggttgagttggatcttggtggacactcaattctagaaatttgcctaggagtgtttggggttgaaggctgtggatttcctctggggtttttgcacaagtgaggcaaggggttaatcgagacccagctccttggagcccctcaacggagagtaggatcgcaagatccgagcttcgggaaaaaatcgctcttgtctctttctgtggatgattctgtgatctatcgtctgcttagaatacctgtgcaccatcttgtgaagattggcttagtctcctatttcgaaatttgaatttcatctctgttctgttacccggaagttcctgtcctagaataccggaagttctgggcctggcaggccggaagtttcggagttccttaccaggaagttcccggtctgcttgaattttacagctgcgattggtttttaagtatccagagacagcctattcacccccccctctaggcttcatcagcgcgttcaattggtatcagagcagggtgctcttgattcaagcttcaccgctttgagtgatccacgatgtcggacttagtggaaaaaaacggggaaaatggaaatcaagatggagcgagcagcaagggaacttcaccacccaagggagc

SEQ ID NO: 33927 - DNA, 1501 bp, Oryza sativa
aaatggcttttattgtcaagagattcaagcactttcttcgcaagaggggctatggcaaagggaggaaggatgatgacaagggaaagaggcaatcaaagagagcttgcttcaattgtggcgaatatggccacttcattaacgattgtcccaagtgaaatgaagctaaggctaagggatgcaagaagaagccgaagcgtgctcatgtggcggaggcacacatggcggaggtgtggtactccggagatgaagaagattccgaggtcaagcccaagcctaagccaaaagacaaggttgaaggagaaggtggtgttgctaccgtcgccttcaagtcatcctcttcaagcaaggagcgtctcttcaacaacttgagtgatgacgatgacgactcctaccactactcatgttccatggcccaacgccgcaaggtgatggctcaaaagcccctctcacacctctcttgatgttgattctagtgatgaggaaagtgataatgaattagatgatgtgcttaagagctttagcaaacccgctatgcaacatttggctaagttaatgagagctttggatagtaaagaacaatcactcgaaaggcaagaagaattgtttattcttgagaagaaaagaaacattgccttagaggagagcctagctaaagaatgtgctaaaaatgaacaactagctaatgagcttaatttggctaatggttctctagctagccttagggatgtcaatgaaactcttcaagagaaatttgctaatttagacaaaagtcataaagatcttgaagttcaatttgacactctttggaatagctcttctcaaccaaatgtgttttctaattcttctaagccatctactagcaatggttgtgctaggtgttacaacattgatttgaactctaatgctactaatgttgatgctatgtaagctcttaagaaagagaatgagaggttgggcactttggtgaaatatggatgcatgaagacataccattcaaaggatgccatttacaagaccatcactgctcatcctaacaaggatggacacgggctcgggttttctagtggaagtcctgtgtctaagcgtgtgatggtaaatggaaaagaatgcttgatgtttgtgagagaaggtaaagctccacaagaaagtgaggtgacttgccccttcactagtcagacacccagaagttccaagcaaaatgaccggaagttcctgccctgtaagacagaaagttacggaccttttgtcaggaagttccgggcttctgataggccaaaggggatgaccggaagttctgggtaaaataccaggaagttccggccagagggtctttactatgattcatatgtaatttcaaaaaattcagagggcaaagtggttgcttattttattgggaattacaatgatgagtaccgcacttgtgtgtgggtgccatagacaaacatcaagggacccaaacttagacaagtttgggttcctaaatcccaagcttgatttattt

SEQ ID NO: 33928 - DNA, 1501 bp, Oryza sativa
gatagttcaggggggtaattcgtactttttcctttcgcaaaatcaaatatcatcccctcatactgagataaaaacagtaagtatgaggggaacttttagaggttaattaaagcacatttatacaaacaagtgtacagagcagtgaattgcctactggaattgtgcacacattatcgtcccctcgtactgagataaaaacagtaagcatgaggggaatttttagaggttaattaaagcacatttatacaaacaagtgtacagagcagtgaattgcctactggaattgtgcacacattatcgtcccctcgtactgagataaaaacagtaagcatgaggggaatttttagaggttaattaaaatacaaaccacctcattccaaatatgtgaatgcaccatggcaggttgcccatttcatatttgaatgaaaccataaggattactagataaaaactctatccaaatatatgccttaagatagacaacaacatgtgaataactcaggtagcaattagatacgatgatgcttgtagatcaactattattctaaggtaaaaatatagtacagacgattattgcatcacagaatagctactaaatactaaagctcctacacaaagcattgtgaatgctcaaccaaaaaatacatggagcacaaatacttcagcaccatcctctaaatgattcattcatataagctattagccaggtttatggtcatgtgacaaggaaggaatacctggtcttctcggttttaacttgtagttagaccatatgcatgttgatatgatcagcatgcagttattagatgaaagaacagcagcctggctacaatttctaaatcattacaacaataggtgaaaagaagtaaactgcaagatagagtatataggttatacaatcgtagatagaggaagaactctagtacaagagcaaagcctgatgtacaattatgagataggggatttctctagaattattatgaagccaatcagaagatagggacacccaattactcaattaaatgatgcaacctaatagcatacagatgcagtaagtaataataaatgtaagatgagctagtaagatgcactcatcaatgaaagtagtggtagaattgagaagcatcctcaagaagaaaagtgtagtaacactagcaatcaatcccaaagagacaaattttgcgagcccaagtaattaattagcaacaaatgtttgaaagaaggtaagaagaaacagtaagggaaccataaacttgcactagggtatattgcttcacaaatcagttcaaatttgaatggaaccataaggattagtggaaaagaactctatccaaacatgcattaagatagataacacaacttgtgaattactacaaattagcattcagatgtactagcagcaatagatgaggttgcaagaggagtagtagtagaattgagaagcatcttcagtaacagtaactacactgtaacaatcaaaattcccaagaggcacattttg

SEQ ID NO: 33929 - DNA, 1501 bp, Oryza sativa
ttttctgtaagtgtctgtttaactcatatgcatgttgcaggggttccacgaggacgctaacgaccgtgtgatttattagtggaaaaaatgcttcagcccaaattggtctactgttttcagtcaatgtgaaaggaagcttaatgatatcaatgtatatatgggagtttagaggagttttgggtttgaggagcactctgtttcttcactttagtctctctcttccagcctatttatgattggagaactcttattgcaggaattgtcatttaaaaagagaagggtttgtcaaactaattcctttttgctacagctttcagtactgtccattaaatctgatgtgcttctaattaatcttatacacaatatgccaaaatttcagcattttaaacactgttgctttcatttgcagaacaataattggttaataaaactaacactatatttccattaccagctggtctgatgagtggtaattaattagttgggtgttgcaaatatacaggtagagagatagcagaaaggtatgccaatcagagatcttgtgggaattctcatctgtactatctctctacctgcatagattatattggagtattgcataatctcacaaaaatgatgggtcttcagaaggaattctagagatatttttgaaggaattctagagataagtctacgtgtgttgaaaattggggagtttggcacaaggatggaagaagatgggaacatctaaaattggggagtttggcacaaggatggaagaagatgggaacatctgtactatggtagtatggtctatgtgagattatgcaatacttcaatataagaatgggagaagatgtgaactctggttctctgaattatttaagtcaccagcaataacattacgacgaagtagtacagcaagattttaggcattggctaaccttttctgatccatgcaatggtgatggaaaaatcatagttgcaagccaagaattaactggacaatatgaagatacatatatgaaatttgtgatttttctttgtatagagagtctttttaatggataacctcgctctgcatcttactctgccactgaggccactacccatcttaagaggatatgattttaatctgcgttgtgcaggtatagatgcatgtacatttctcaaaaaaaacatattttagttaaaatacttggcatggatagcatatttacaatccgttagccatgtttttgttaaaactcttcatatatatttttaattcgtttttaattggttatctcctcttttcatcaaacgtgagcatttcaagagattattacgactattaagcaggaaaagtcctgattgaaaggaaacttgctgtcattatatctttttatatgcacatttaatactatttttatcatttatggatgtctaataaaatagcttcagatgttggcaaaccttccacgccaatttagtctaaaatttgattaccatgcacacacatatgttgtcgcacacatatatc

SEQ ID NO: 33930 - DNA, 1501 bp, Oryza sativa
cttgttattaactagcaagagacacgcgctacgctgcgtgtggacatggatagaatccaaatgagctcatgacatacaacacatacaaattctgttcaagatattagtagttttaatgtacagtatacacgctgtaaaaaattgttacaatccaaaataagcatgacaggcaattgtagatataaacgggcgcccaaacgtctgtttgtttcttccctgatatattgacaattttgaaagagaataataagatattgatggggcacacaacccaaatttttgtcaaatgcagaaacagggcctagctaaagggataataaacctatgtgctttcagataaacttcatatatactgggtggagtgcaacaaaaattctaagaaagtaatgtagcttggatggcaaaggaactaaatcaaaatagaattgtttcaacgatttacgattccactgaactaacacaacatacatctttacatgccttacctgcaaacacaaaatatcagtcattccatagcattttttccgtactattcttaaaagttaatattttattaactctatcacacacacatatataacattaggacaaaatgaactaaaaaacatggcagtataactgcttcagatgttaggacatggttacccatggaagatctggtggtaggcctttaaaaataaaaatatttcatgagataaactgcactaaaatgggagtctctaaggacatggtagtaattagttgtatggtgagtacattgctatgagagaaatcatatacacaattcatacatgactactaaaatgtgagaaccaaaaaataatgtttgctgaggcaatgacaggctctagtacatccttgtgcactataccttgctaaataaaggatttcctgcaagaggaatccttaagttgcaactttgagattctgtttgagaaaaccaggagggcagatgcactgaaggaatgagcatagtagcccaaatacaggcttgaatagatttatccttcaccctactgcattccctaaaagaaaaagaagtatgacattagtgttttctcaaaagtaaagtgacagatgtacatgaatagggattgttttttttttaaaaaagcatccatatatatatgcattggccatgtttttaaaatgtgatacaatagaagcaggccaaacataacatgtaagaaaatcaaccatggaatcatcgtagcatgtggataagtaccacaggcaggaatcatcttcccgtaaatcgaaagaagcgaactttaatcaacaatgtagcccgtaatagggtgtgctatcaatcctatgtgtaagccttcgtgcatgcttagtgcacagtccagtcaagaaagagtgaactaatctattgcggaactgcggactgtagaagcacaatcaagttgtatgaacttgaggacagtaagcttccttgctaaaatgcataatggacgatttgtttctgtgctgtatcaaggcgattaggagaaagcat

SEQ ID NO: 33931 - DNA, 1501 bp, Oryza sativa
tattaagtcgtgcttagaatttcaatctctagcctgccttctggttgccgattagggtagcatcggggtttcagccgatcttacctgatttaactacatctattttatacacctgattgacatgttaaatctgcgctttatagtaagatcttgtcgcatttaagtatattagtcttttgtttagtatattttacttgctttaatatcttaatatagagtagtatcggagtattagccgatacatgctagatctatataatcggctatgctataaacgtatatagtcttgttattaatatatattttgattggagtgatttatactgtctcggcatgacgaccgatctatcccaatcacttgatttaattatatatcgacataaggactatatgtcgttaatatctacatccgatcaagtagatttagttctttcttacttattaatgattgccgatcgatgcatatatgacatcggctcaaagataaatgatatgtcgtcggcacctagctgatcggctatcgtttatggatttaaccacggtttctttgtccttgtttcttgttgattgcaggatcaaatcaactggcacgctagcatacccgaaggcgagttttggacctgcattggagttaagtagatctctcaggcctcgtgtttttacatcaacaatcaacggcggcgacggcccgatgctgggcaaatctaagccgtctgatctaatggatggctccaatcgtccctgcgccggatgatgcgccgaccgagagagaggggcaaaaccttagctcccaaatcgttctctcccgatcccattgccgattagggtagtatcggggtttcagacgatcttacctgatttaactacatttatcttatatgccttattgacatgttgaatccgccctttatactaagatcttgacgcatttaagtatattaggctttcgtttggtattttttacttgctgtgatatcttaatatagagtggtatcggagtattagccgatacacgctagatctatctgatcggctatgctataaacacatatagtctcattattaatatatatttcgatctaagtgatttatactgtctcggcatggcgaccgatctatcccaatcacttgatttaagtatatatcgacataaggactatatgtcgttaatatctacagccgatcgagtagatttagttctttcttacttattaatgattgccgatcgatgcatatatgacatcggctcaaagataaataatatgtcatcggcacctagccaatcggctatcgtttatggatttaaccacagtttctttgtcctcgtttcttgttgattgcaggatcaaatcaactggcacgatagcatacccgaaggcgagttttggacctgcactggagttaagcagatctcccaggcctcgtgtttttacgtcaacacgcttttggcacgcccggtgggacagatcagaagtcagaatcacaacagcaattttcctca

SEQ ID NO: 33932 - DNA, 1501 bp, Oryza sativa
aaaaccaattaatgaaagcagtggggatggtttcccaatcattcagtatgctgatgataccttgatcttgttaaaagcatctcagaaagaagtcttctgtttcaaggctattttgaatatgtttgctcaatccacaggcctcaaggttaactataataaatcaagtctgtacccacttaatatgcctcaggacaaagctgtcttactatctggcattttgggatgtaagatcggttctcttccattcacttatttggggctacctttgggaaccaccaggcctagagtggtagactttgctccgttggtagacagggttgaaaggaggctgacagcaagctccatttttttacctcaaggaggaagattaactttgatcaactcagtcctgtcttctatcccaacctactacatgtcctcattgcagctaccagttactgtcatcaaggccattgacacagctcgtaagaattgtctgtggagagggaataacccttcttctacaaggaaatctctagcttcctgggatagggtgtgcatgcctaaggagaaaggaggcttaggagtgatcaatctgagagttcaaaacacagcccttcttctaaagcatatggtcaagttctataatggtgctgatttaccatgggtgaaattaatctcacaatcatattatgagtataaagttccacacttgatgatgaataagggttctttttggtggagggacatcacatctcttgcagacatattcagggggatagcaaaatgcgaaatcaggacaggaagaactgcccttttctagaatgatttatggaatgatgattttaagtgcaccagctaccccaatctctttgctgtgactatgtatatgtctgattcagtcaaggccatgtgttcaagacccttagaagactcttttgcactacccctctcagatgaggcttattcggaattcttgcagcttcagggggttctggacagtttgactttacaatcagggatgggggatgcttggaattttatctgggactcagataagtacacagctaagaaattctataagctaaattattctgcattgcaactccccaggcccatgatttggctatggaaaacaaaatgtgtcatgaagatcaaagtctttgcctggctaatgttctgtgataggctcaatacaagagatatgctggatagaagatattgtgccaaagaagatgatgatctcacgtgtgttttgtgcaatgcgaattgtagagagacaaggctacacctcttcttcttatgtcctttcagcatcaggtgttggcaatacctgggaattgagtggaataataatttggagtttttcccaatgatatccctagcaagaatcaaatttgctcagaagggtttcctggaaattttctttttggcagcttggcacatttggaagcaaaggaatggcttcatatttcagaacattcagccctccttccagacatggagatctctttttgtcaaa

SEQ ID NO: 33933 - DNA, 1501 bp, Oryza sativa
ttggtggagggacatcacatctcttgcagacatattcagggggatagcaaaatgcgaaatcaggacaggaagaactgcccttttctagaatgatttatggaatgatgattttaagtgcaccagctaccccaatctctttgctgtgactatgtatatgtctgattcagtcaaggccatgtgttcaagacccttagaagactcttttgcactacccctctcagatgaggcttattcggaattcttgcagcttcagggggttctggacagtttgactttacaatcagggatgggggatgcttggaattttatctgggactcagataagtacacagctaagaaattctataagctaaattattctgcattgcaactccccaggcccatgatttggctatggaaaacaaaatgtgtcatgaagatcaaagtctttgcctggctaatgttctgtgataggctcaatacaagagatatgctggatagaagatattgtgccaaagaagatgatgatctcacgtgtgttttgtgcaatgcgaattgtagagagacaaggctacacctcttcttcttatgtcctttcagcatcaggtgttggcaatacctgggaattgagtggaataataatttggagtttttcccaatgatatccctagcaagaatcaaatttgctcagaagggtttcctggaaattttctttttggcagcttggcacatttggaagcaaaggaatggcttcatatttcagaacattcagccctccttccagacatggagatctctttttgtcaaagaagttcttctgcatatgtgcagaatgaatgatcctttaaagcaaactgtttttaattgggtacaaaccttatagtctttctgtgtgacccgcatgtaatctctgtaaccttgtaaatattttctttatttataaaattacactgttgggcaaagccctagcagttttcctggtaaaaaaaaacatatgctaatagagggcagccgaataggctaaataacgacatttgcttagattatataggatatctaccactctaggaatcgtccagtgacttgattgtctagatattgttcttcttttcatacttaatactgcatcagttgagtttgatctattaagtcgtgcttagaatttcaatctctagcctgccttctggttgccgattagggtagcatcggggtttcagccgatcttacctgatttaactacatctattttatacacctgattgacatgttaaatctgcgctttatagtaagatcttgtcgcatttaagtatattagtcttttgtttagtatattttacttgctttaatatcttaatatagagtagtatcggagtattagccgatacatgctagatctatataatcggctatgctataaacgtatatagtcttgttattaatatatattttgattggagtgatttatactgtctcggcatgacgaccgatctatcccaatcacttgatttaattatatatcgac

SEQ ID NO: 33934 - DNA, 1501 bp, Oryza sativa
tttctagaatgatttatggaatgatgattttaagtgcaccagctaccccaatctctttgctgtgactatgtatatgtctgattcagtcaaggccatgtgttcaagacccttagaagactcttttgcactacccctctcagatgaggcttattcggaattcttgcagcttcagggggttctggacagtttgactttacaatcagggatgggggatgcttggaattttatctgggactcagataagtacacagctaagaaattctataagctaaattattctgcattgcaactccccaggcccatgatttggctatggaaaacaaaatgtgtcatgaagatcaaagtctttgcctggctaatgttctgtgataggctcaatacaagagatatgctggatagaagatattgtgccaaagaagatgatgatctcacgtgtgttttgtgcaatgcgaattgtagagagacaaggctacacctcttcttcttatgtcctttcagcatcaggtgttggcaatacctgggaattgagtggaataataatttggagtttttcccaatgatatccctagcaagaatcaaatttgctcagaagggtttcctggaaattttctttttggcagcttggcacatttggaagcaaaggaatggcttcatatttcagaacattcagccctccttccagacatggagatctctttttgtcaaagaagttcttctgcatatgtgcagaatgaatgatcctttaaagcaaactgtttttaattgggtacaaaccttatagtctttctgtgtgacccgcatgtaatctctgtaaccttgtaaatattttctttatttataaaattacactgttgggcaaagccctagcagttttcctggtaaaaaaaaacatatgctaatagagggcagccgaataggctaaataacgacatttgcttagattatataggatatctaccactctaggaatcgtccagtgacttgattgtctagatattgttcttcttttcatacttaatactgcatcagttgagtttgatctattaagtcgtgcttagaatttcaatctctagcctgccttctggttgccgattagggtagcatcggggtttcagccgatcttacctgatttaactacatctattttatacacctgattgacatgttaaatctgcgctttatagtaagatcttgtcgcatttaagtatattagtcttttgtttagtatattttacttgctttaatatcttaatatagagtagtatcggagtattagccgatacatgctagatctatataatcggctatgctataaacgtatatagtcttgttattaatatatattttgattggagtgatttatactgtctcggcatgacgaccgatctatcccaatcacttgatttaattatatatcgacataaggactatatgtcgttaatatctacatccgatcaagtagatttagttctttcttacttattaatgattgccgatcgat

SEQ ID NO: 33935 - DNA, 1501 bp, Oryza sativa
taacgaaactgacatttttttccttgccttgcaagtggaacaagaaagactatatagtgatttcaaggcgatctcctccccggccaagtttccgctcgtggcgatgtcgacctccgccagtccatctgtcgcgccatcggctgagtatgcagaggtaagtatccattggctagatctctttcttttgcaacatattggttttctcctgcctcatattgttttcttcttctctattcttgtttgcatccatagcatctgtccaatctgtgcaattccaagtctgtcgcatgagaaccactatttccttggtccaattggtgattccgaccctactgaattcatcattgcagaaaccaatagaatcccctttagattagcaaaccctaatctgagccattggaagaacaccttcaaatcttggccatccctcgagaaaacctcccctgagaaaagctggactacatggtataagcgcgtatcggctagcaagcaggttcattgggatgatattggaatcggccaggcactcgccctcactatagccaattcagctaaggatgagcccctaatggctgccgccacctatttttggtccaatgccattaatgcctttttgttcaaccaagggccgatgaccccaactctgatcgacatcaccatgatcactggattagatgtgacttcatcggctaaccctatgagtttgaacactaagaaccaattcgatttcagaaccaaaagcataggtggttggtctggttatgtggcagcatatatgggccaagggtctgtcactcctcgagaacatgtggccttcctcctgatgtggcttgagaaattccttttctgtggatcaagttgcggccctacaaccaactagcaatttttagccgaagccctagaatcaaaaaggcaatttcctctaggcaaaatccttctcggctacctatatcaaacactgaacaatgcatcgtctaaaatttctgtcggctcagtggttggagcaggaggaccatggtggttattgcaatcttggctaaatctggtagttatgaaagccattaatcggccatctatgacagaagccgaatttccaagactagagccgattgctgatgatgatggagaagaacgcacccaccgcaggtgtatgtcctatggggaatatgcatccacaccagccgattcaggagcaaagttatcggctgagctgctcaaggactggttctgcagcttttatgaaaactttcaaaaagacgcccgtgtctggttcttctatgagaattctgccgacttggatctcccatcggacttcagatttgaagacatcaatcatgagagatagcagaaatctggagaagttttctcaacttcaatcaacccatacatccttcatgttggtattcatcaaggaagaaatatacaagtttcttatgaattctaccatccgatgagctctgccagacagtttggaatgggacagctaccaattggcctgttc

SEQ ID NO: 33936 - DNA, 1501 bp, Oryza sativa
agatgtcgaaaaacttgcaaagaaacccggtgtaagtgttgtgacaaaagaaacaactggggattgaaattttggcttaggtttttcaactcacacaaagatgaagcattttgagcactagtattcaaccaattatatgcatgtggtatccctcttaatagtacggcatcctaaactcaaatttaaaaagcaaagttataccaataggagtaccttcacaccatattgtttcttcacttggagggttaccaacgtcaaggtcatttgatcatcgggaagatctcatcttcttgatctttgacatttcatcttccatttctcaaatgactaatgcggataatccgtggcttcgaatggcctcacacggtgttaatgaccaaatttgataatccaaggatcggagataaagaagaaatcgagatggaattcgaggtggaaatagtcctggaaacagagtgaggattggctgaagtccgaatcggttacgactaatgtcagcagaattcgagtcggacgggattagccgattgagtcgaatctgacaatatggcacggcatatgttgtcgggttaggttgacgtgcttcatgatgattgccacgcatggatagagtcctgagaaggcaattgtatctattaattaggatattttacgtaatttccttagagatatgtttgagcaaaagtctgccgcaaagacttatgatatcttagagtttgttagagataagagtcatgtccgatatggacatattttgtaattctcgggtataaataaacccgagccccatgtaatcaaattaacacacgttcaatacaatctcggcgcatcgccaccctttttactttcattttatttcaacgagttcttgctttcgggttgagctgtatcagttctgatcttcaacaagaggtaaaacttgttatggcggcttgcgttctcaggattagtgcttccatcttcatgatactctaatcttgtttatgtaattcgttgagttatcatatatcttacaaaatctccggcaatatcgttatctaacctacaatcggctaacatctatcagtagaaagcagccgattaggttaaatagcgacgttggcttagattatataggatatccaccactctatgaaacatctagcggcttgattgtctagatattgttcttcttttcatacttaatgctacatcagttaagtttgatctactatgtcgtgcttagaatctcaatctctagcctgttttctggttgtcgattagggtagcatcggggtttcagccgatcttacctgatttaactactttatatattatatgcttgattggcatgttaaatctgccctttacattaagatcttgtcgtaattagatatgttaggcttatgtttgacatattttacttgctttaatatcttaatatagagtggtatcggagtattagccgatacatgctagatctatttgatcggttatgttacgaacgtatataatcttgttg

SEQ ID NO: 33937 - DNA, 170 bp, Oryza sativa
agctgttaaaacagttttcctctgtttgttctcttctcacgcgttctacgctacgcgggaggcatataaatccggcaagcaagcgaccactcccacgccacgcgccgctctcactcggtcactctcactcttcatttcgtcgaacacctttgcctcacaaccacccccca

SEQ ID NO: 33938 - DNA, 1023 bp, Oryza sativa
atctctgctgaactcaccattctggatctatcacccatggaacttcagaattttatttacaccagatgaccattggtgatagtccaaacctacatttaagtccagcaattttgatttatttatttttcttaatttgcactaattatgttctgaacacctctcaggctgtgttcattcaaaggtgttgggaactaatctctcgcacactaaaacatagctatccattaacacatgattaattaaatattggtaattttttttaaaataatttttcttaaaaaaacttttacaaaagatacaacctttaactgttctgtttgggaagcgtgcatacggaaaacgagtgatgagttagaaaaatactctctttgtcccaaaataaaccaacttcgtatgaaatatgatacatcctaatactataaatgtggacatacgcatgttcagatttgtaatactgggatgcatcagatcctatacgaggttgatttattttatacgagattgattttttcttttttgcggagggagtaggaaaaaacacagcccgactactttcgtagcagtggcatagtattatggtggtgtttcagagcttaaactagtttagtccttgtcacatcggatatttggatgttattttggagtattaaacatagattaattacaaaactaattgcataaatgagagttaattcacgagataatttttttatgtctaattaattcataattagcacatgtgtactgtagcatcacataggctaatcatggattaattaagcttaatagattcgtctcgcgaattactccagagttatgaaatgagttttgtcattagtctacatttaataattctaattagtgttaaacatccgatgttattgggactgagtttatacatatatcacgcacaagatcgaccacgcaaaccgtgtccgtgaaatgcaacacacgctgctcattgacttttttttttaaattgacgattggtaaagaaactcgatttttttccgcttgcgcagt

SEQ ID NO: 33939 - DNA, 1501 bp, Oryza sativa
attacattgcccaacaccatagtactcatgtacaaactcccagtgagcccaatcgcataacctgacaactgatctagcaaaccacaaccgttcattgcatttagcgatgaaagagagctgaccactaacccacatacatgctatttaagtggaccaacccaccaaccacgtactccatccttgctataaaaaacaaacctagaatcagatatgacatattatagtactgtgaatctggacatatatatgtctagattcgtagtatgaaggtgtgtcacatccgatcctagattggtttttttacgagagaagggagtagtaaataacctattttggtgagtttgtacatcagcctacttgcatccctaattgcattgcagcccacacaagcatgtacacaatctctcctgcctttaggcgcacgagatgtgtgcctcctcgccgacgtggatcgccttcgtcgacgatggcacggcgcactgtgccgccgccgccgccgttgccggaaagaggacgcctgctgctgctgcttgatgacggcggccctcttgcaggcggccatgacgagcggctggtcggcgccgaggggacgacggggaggttgtcgcagttgcagatctcgatcatgaagccatcgggatcgtggaagaagatttggtccacatagatgccacctttctccacacatcgttgtatgtaagggatgcctagctccttcagccgccgctccactgccaccatgctctcacactgcaaaaccgaccagctacatgtcaagtctagttcataatccaacatggcatatgtaaatttgtatagcgacgtagcatattttatagtataaaatttggtacctctcataaaatttattttttggacctcttaaatactgtaaaatttctcgcgcaaaatttatactaaaagttttggtatttttttggacctcttaagtactgtaaaatttctcaagtttgtaaaagaagttgctttacattactgggcttgtttttaatatatatttgtagcatttcctttggtgtagaaaacttttacataaatagtgggtgatacaacggctagatatattttcatatttttgatgtctgaaaattttcaaaataaaagagatgacatagacgtagagatacctcaattacctcttaactaggaataaaaaaaaattaaaaataacttttcttaattatctgatgtgtaagtttttcctcgagttgtaaattaactatgtacttatgcatcgggacaaaaaaactttttcatgtaatatgatgtgtgtcgtcgttatcgtcgtcgtcgcctgtctgccaccttcatcttcgtgtgtgcgctatgagtcagcaacgttgtcaggtttatgataagatgacacagtcacacacacacacacaagttgctcgtgataatatctccttaactaattggcaagctagtgatcatatgcatgcatccacaacaatcagtgatgcagcatcagcttgtccat

SEQ ID NO: 33940 - DNA, 1501 bp, Oryza sativa
ggaggatcactcctgctaccacatggacaataaacaaattaaaacggcactgaaataccgaattcagctacacacgaaagaagaaaatatctactctagtagcaacttgcaagctttaattccttctcccttaattaacccttcccctttatatatatatatatatatatatatatatatatatatatatatatatatataaactgaaacttgcaatctcctctgcacatattctcagggttcagcctaaataaaaccgagaaaagaaggtgctcctttgtgctctcgtgatgaatctgtcgtgtccatcacgtatagcaggaataaaccaatcgtcttatcctttaacccgtcgtggaacagaatcacgatttcttctttattggacaaacagaatcgcatacgaagtgacgacgaaaagcggaaccaccagaacgatcgatgcatccgcatgatgtggctgatacgaatgatatcacttgacacactcgaccaacggctagctaggcagcgagcggcgatcgacgagcgcgcgcaagcaacggcacagacgcacgcacgcgttgcgcgggcggatgctgcaggagttcgctgcagattgggcgggcgaagccgtggtaaaagctagtactacccaccagctgttccaaaccatctggacgacaccacttgtcaagttgtattgccacgatggcggctttgaacgattgcacgtacgcgaacgcacaacgtcgactcgggctctgttagttttcacgtaaaaacttttcactatgtgacattgaatgtttagacacatgcatagagtattcaatataaaaaagacataattacatagattgtgtgtaaattgcgagacggattttttaagcctaattgctccatgatttgacaatgtggtgctacagtaaacatttgctaatgatggattaattagacttaataaatttatctcgcagtttacagacggaatctataatttattttattattagtctatatttaatacttcaaatatatgttcatatatctgatgtgacacgtcaaaaattttcacctaacatctgtatgaacacagaacacagcctcggtcaaagagaaaaaacgaggcacggagggtaaaaaaggaaaaggggaaaaatcgtggcagaaaggacaggtgaaaaaacggaaacagcgctgtcctgatgtgttcgttcgttggttcgttctcgtagttgtagcagcagagggaagcgtctgtctgcgtcgggtgcgtgcctttggaccggaatatcctggaggataaaccatccgatccgcggggacggtggcagcaaattggcaaatgcgcgcgatggctggccatggcgaacgcatccccaccccgaatattccccattcccgcttccttcctttctccaacgacccacacccaacactcgatccctttccccttcccccgccttgttataaattaggctcggctcccgcttcctcgcgtcgcgtcgcgtcgcgtcac

SEQ ID NO: 33941 - DNA, 317 bp, Oryza sativa
tgtgccctaccaaatttttagcaatttgaattgtactttggctagtttttggtttgctaaaaaaataccaataataacacacatatagattgacaaaaaaaaattggcactaccaaaatttttctaggttttggtattttccatattaattttggcatggtagcaacggaaaaaactgaaaaaaaaagaagaccagggcacacactacactgatgaatcccctaatgatttttatcaaaatcattaagttaaggtagatacacatcttgtcatatgatcaaatggtttcgccaaaaatcaataatcagacaacaaaa

SEQ ID NO: 33942 - DNA, 1501 bp, Oryza sativa
acgggccgtgccgcgaataaacgaataataatcggcgaatttcgggcgtttgattttgtagggttcccggcagcctgattaatttgagatgactcggatttcggaatcctaatcagtcgcagaataaggacgggatgtgcttccatgaacatgaacgctggacgggccgtgccgccgcaagccctctccgcgagaggctcccgcgcgcacgtggtatattaggtcttgtaggctggtttgggctgcatgtcagcgagacggataggccgtatgatagcgttatgagtgagcccgttgatgggagagtatcgggcttctttcatatgtgttattgccccctcttttgaggataattttcatatttcttttgcttgcacatctttttttaaaactgttttgcttgcacatctgagttgtctgagatgcgggtgagcactgtgatattattggggcaccatcataattgtaccttagactattttcgaatcaaggggatgagaacctcaccttccacatagaaaacatattaacgcagtattaattaagtaccgttgagtagtttgagaagcatacgcacaaaagtcgagagtgtgaaagttgtgaaagtatagttccaaataaaacctgaatattgcttataattctttgttgataatttgatatataagtatgatactatgtcttagtacaatgggaaagtattatgtgatacttaactagtatggaagtttttacatagggaaatttaactattcgctactattaggtttgccaattaaaattgacgcggcagccctctctttcctggctgcagcggcggaggagtaggaaagggagccaagtacgggagacggagatggcgtaggtcagtaccgaccagcggattctccaaggaagagcgtggcgagctcagcgcctccagcgatagagttgtcagcagcagcggagccgcccacgtcatcttagggtggctggggagggaggaacgccgcgtcggccgactggagtccgtggttgccatggagcatggcgaggcggaggtcggatttgcggcggcgcttggctcctcctcccatggtgtgctggcgagggaggccgcgttgcgctgctctgtctcgacggcggcgccacccaccaactcgtagctgtagaggcactcgtcgaggactttgaccaccgttggcgcaaacgatgcgagcacggcttcgcacgtccgatccagcgtgtaaatgctcgtccttgaccgcggcgtcacttggctcctcctttacctctgccgcgagccgtcgcaccgccgccgccgctgggaaagagagggttgccgcgtcgatttttaatactgccggaggcagagaggaagggagacttgtgagactgacaagtgcatcccacgtcgctttttacactacattgccacgttggcatcccagatgggcagaagtggtaaaaagataagaagccaccatcttagagaggcaaaaaaaaaaaaagagagcaaatc

SEQ ID NO: 33943 - DNA, 926 bp, Oryza sativa
taaagatcaaaatttttaaaaccgggactaaaaacaatctttagttccggttctttttggatccgggactattatggattttgccggaccgaccaaagatggtttctccccccagtggagttatataattttaattgaacatagtaatcacattttaattgtacatagtaatcaccctttgcaacgcacgcgcgtttgtaattaaagtcctatacaacaacacatttcatctaacagaaaggaactttacagatggtacaaagtcaatatgaccgtaggaagttatcatgtacccaagattcactagtttgctattgcaggcttacatgaagttatcatattacccttataaagtttatgaccttaggggcatattaaaacattttagtggtccccaagtaacatttgatgctactggtgagagcagttgacgtggttcccataacacttttctaaaatatatgctttgctggatggtacttttcctcaactccgatcgctcgagtcgaacacttgtgcctggacttaaaaactctcccatcttttagctcctcgtcacttcacttgtcttagccaaagaacctgctcaaacacaatgcctttagtgatgccaattcgagcaagtaatcttgttcgaacacattttccttggaacaggccttattgggcgaatgcaaatttttggtcagaaccggctacatattagaatttatttgagcaaagctcaaaaacactttcctcatcatgcgagtttttggccgagtataggggatggtgttcaccccctgctacaacagtaatggccagcgataactagagactgggatgcacataaacgtacagtatcagcacttaacgatggcattatcagtcttcggacacgcacatatctctaaactaattgtatggtgagaaaatcgaatgta

SEQ ID NO: 33944 - DNA, 1501 bp, Oryza sativa
gtcaaattgcaccggttttgcaagttcggggggtcgagatttctggtattgcagttgagggatacgatttagattcggtggtcagttgagggagtcaaagtgatcttattccttagattcagtaactagttaagggaccaaagtgaacttattcctatttaaaaaggattttgttattcggcccatggagatatttttgtacggatcactccgagtcatcaactccaagaaggctggcccaatccatgcataaatgcaaaaatcaaataaagcccattaacaattccttcccatctccttcttgacctcttgccagttctctgccaggttatatgacccactatccaacatgtgaatatgtgatagtagatggatagttgctcaactccataactcagcacaaatgaggatcttgagttatggatgggccttcaaaatcatttggaccactcccagaaagtgaactgataactgatagcccaccgaaacattcggcttctgcctgttttagcatttttgtcgctcccaatattacttgacaaaattcaggatttgggactccacgtgaagacattatggtcccattatagataccctaatggctaaacctaaaaaagaaactatacagccccattattttgcttatacttatgattatatgtacgacttattagcaataaaaaataatttataaatataatttttatatgtgttcttagcgtttcaaagccaaatattgtaaaataaaccataataagaaaaacataaaatcatctgtaaaactaagttttaaaatttaagcataagtataagcaagacgatggggccatatgagtggcaaatcttgaaatccctatgggcaataagatacaagggatgtttaggggagctgctagatgttgcagcttctcccaaactgtccaatggtctgtttgagagagattaagattctaagaagcagctggttggtagttagcttctaagaatctgtaaaagttaggtttcccaacttctggattctagttcattttttggaatctacaactacagcttctcagaatctggagcaaaagctggactgtttgggggagcttatgattctgggagaagctgcagcagctagaagctcccccaaacagaccccaacttttggtccagattctaagaagctgtagttataaaatccagaaaataaactagaagtcagaagttggacacccaacgtttccagattcttagaagatggttatcaaacagttacttctcagaatcttaagctcacctagctcttgtatatcttggatgattgcacataaaccaacttgtctaaaaacactaaaatttctgagggtgaaaggagcggaagatataaattgtatggttttctatgcgtttgatttaacaaaactagcagctttgctcgtttgacttatgaataactatccgttgagaaatggactagtaggcaatgtcaaaacttttatacctatatcttttcatc

SEQ ID NO: 33945 - DNA, 192 bp, Oryza sativa
tgccttagttcacaccaaaattggaagtttagttaaaatcggaatgatgtgatgaaaagttgaaagttaatgttgtagaaaaacttcgatgtgatggaaaagttgaaagtttgaataattattttggaccaaaacacggtccaaataagagaagataatccctccggagcgtcgaagagtctaatctcctga

SEQ ID NO: 33946 - DNA, 1501 bp, Oryza sativa
aacgttgggtgtccaacttctgacttctagtttattttctggattttataactacagcttcttagaatctggaccaaaagttggggtctgtttgggggagcttctagctgctgcagcttctcccagaatcataagctcccccaaacagtccagcttttgctccagattctgagaagctgtagttgtagattccaaaaaatgaactagaatccagaagttgggaaacctaacttttacagattcttagaagctaactaccaaccagctgcttcttagaatcttaatctctctcaaacagaccattggacagtttgggagaagctgcaacatctagcagctcccctaaacatcccttgtatcttattgcccatagggatttcaagatttgccactcatatggccccatcgtcttgcttatacttatgcttaaattttaaaacttagttttacagatgattttatgtttttcttattatggtttattttacaatatttggctttgaaacgctaagaacacatataaaaattatatttataaattattttttattgctaataagtcgtacatataatcataagtataagcaaaataatggggctgtatagtttcttttttaggtttagccattagggtatctataatgggaccataatgtcttcacgtggagtcccaaatcctgaattttgtcaagtaatattgggagcgacaaaaatgctaaaacaggcagaagccgaatgtttcggtgggctatcagttatcagttcactttctgggagtggtccaaatgattttgaaggcccatccataactcaagatcctcatttgtgctgagttatggagttgagcaactatccatctactatcacatattcacatgttggatagtgggtcatataacctggcagagaactggcaagaggtcaagaaggagatgggaaggaattgttaatgggctttatttgatttttgcatttatgcatggattgggccagccttcttggagttgatgactcggagtgatccgtacaaaaatatctccatgggccgaataacaaaatcctttttaaataggaataagttcactttggtcccttaactagttactgaatctaaggaataagatcactttgactccctcaactgaccaccgaatctaaatcgtatccctcaactgcaataccagaaatctcgaccccccgaacttgcaaaaccggtgcaatttgactccctcagcggttttggggtggtttcgctgatgtggcgccacgtggcacctatgtggcgatattgaccgagtcttcggtcaacgtggcgttggcgtggcagtagaattaaaaaatatgcgtgggacccattagtcattcacacaaaaagaaatatgggcccactgacatgtggggcccacatgtcagtccttcctacttcctcctccctctctctctttctctcaatctctccctttcttcccattcggccggcgggcgggagggtagcgagagc

SEQ ID NO: 33947 - DNA, 297 bp, Oryza sativa
ggagtttttttttcctattctttgcatactatttattactccattctctagctgcacgtctcaaaattaaaaccaatgtcacaactcacaacatagtaaacagtcctgtatgaagttttattcaaggaatagttttaggaattcaggacagttttgcatttatcctgtatgagacgtggaaactgttgtttcttttgcttccaatgctttgtaggtttgttattctgacaatctcttcttttttctgaaactcagcttttgggccgatcattgttttgtcttggactgctccttagg

SEQ ID NO: 33948 - DNA, 415 bp, Oryza sativa
caaacattaggttaattccacccaatgacattcgaaaataaatgcaatagttgaatagaaacaatagctttaaacgggatcaacatgctcaaagggatgtttgggatctgtgtgacttgccttgctggccttggaactcttcaaaatcttctcctgcaaaaacggactctccggaaacgtcggaatctaaacagaaaggagcaaaatcaccaaaacagcacacaaacaagcatgaacagtacatgtggatatttttaacatgtagatctctattttagaaaaaattagaaacttgaaccaactaaattcgagctaagatgaattagttatgaattttcaaagattaaatcagattaaatcatttatttagattttaattgaattatgacgcaataatgaattatttttgaaaagg

SEQ ID NO: 33949 - DNA, 1105 bp, Oryza sativa
atgcccatgtagccaatcttgtgtggaaaaatgaagagtcacgcattaaatccgagaaagtcattaagatgataggttattggattgaaatatactatcaaaaataaaattttcagatttagaaattgttgatgtgaaaacacgaggcctgggagatcttcttaactccagtgcaggtccaaaattcgccttcgggtatgctagcgtgccagttgatttgatcctgcaatcaacaagaaacgaggacaaagaaaccgtggttaaatccataaccgatagctgatcggctaggtgccgatgacatatcatttatctttgagccgatgtcatatatgcatcgatcggcaatcattaataagtaagaaagaactaaatctactcgatcggctgtagatattaacgacatatagtccttatgtcgatatatacttaaatcaagtgattgggatagatcggtcgccatgccgagacagtataaatcacttagatcgaaatatatattaataatgagactatatgtgtttatagcatagccgatcagatagatctagcgtgtatcggctaatactccgataccactctatattaagatatcacagcaagtaaaatataccaaacgaaagcctaatatacttaaatgcgtcaagatcttagtacaaagggcggattcaacatgtcaataaggcatataagataaatgtagttaaatcaggtaagatcggctgaaaccccgatactaccctaatcgacaaccaaagccaggctagagattgagattctaatcacgactcataagatcaaactcaactaatgcagctataagtatgaaaagaaggacaatatctagacaatcaagccgttggatgtatcatagagtggtggatatcttatataatctaagccaacatcgatatttaacctaatcggctacattctactgacagatgttagccgattgtaggttagatagcgatattgccaaagattatgtgagatatatgataactttgacgaattacataaacaagcttagagtgtcataaagatggaagcactaatcccgagaacgcaagccgccataacaagttttacctcttgttgatga

SEQ ID NO: 33950 - DNA, 1488 bp, Oryza sativa
ccgactgctgctgtggcttggacatggcgacggcggccggactcgcccccttcctttcttgaggctcacccgcgtggtgtgctcctataacccttgatttgaagggaagtttggtgtccgtcggcgtcggctctgtcagtgtccgcgtccgatcgggtttggtagcgtaggaactgttgacttggagaagaaaggaggagagggagagacaaccacccatttccacatcttcaactatgttttacacacctcttcatcatcatattcataagtgttatcgtgatcaagaaaaaaaacatcattctttcttaaattaaaccttatcgatcaaaatattatgttagacatgcacgtgaggatgcaataatacaatttactcatgcacaaataaacaaacggatatgtaactatagcatttactcctacacacataaacggatagaaacgcaacacatttactcttacacatgtaaatggatagacaccagttagatgacaatcaatttgggaatacctcagcaattttagagagtgatcaaaatgggatggagggattactgtataattaattaattattagttaaaataaacttaaaaataaatcaatatatttattaaaaaaactttcatatgcattttctttcaaaaaacaaactatttaatgagttgggaagtgtggacatgaaaaacaagcaagtgaaagttaggaagaggtggtaaagaacaactatttgaaacaatgattaaaaagggaatgtataaggaaaaaaatataactatgggatgaattcaagtgcaaacactgaagattgtaaaatattgaagaaaatacatggattgattggaccacaagatgacaattatagagataatgtggttgttcattctgtagttttccaaaaggtctccctgactctcttatagagttcaacagaaaatggcaaccgccacactcatttgttctgtatttgtttccttgtcagtcatatttcgctatcatcacagtcgataactaacgttgaaccaacacggaaaatactaagagcaactaagctataagtcagtcattcatatagatcatgccatcgccatagccaccaaacccaacctacggggatgctggcacgagacgcgacaccaataggatacttccaatgcaatatccttgagaaggttgcaacatctagaatgccattggtgcaattcctggcatccagaacaaagaatttcatccgaagagttcactaccaagcactaatgaggaagaggccgagagggtgtcagaacatcacctccaagaagatgtgtgactctcacatgtgtcactatgtcggtgctcgagccacctcgccactgctccagatctaaatcgtgcatgccgctgttaacagtgaaatttggtaagcccggaatagttattggcttagagtcagcattggctttgaagtcctgagattagccgatgagaattgtcaagtcgtcagttgt

SEQ ID NO: 33951 - DNA, 1501 bp, Oryza sativa
ccacaacacgcgactacgacggctcgcctcctcgccaccttcgccgccggcttccctcctcgctgcctctgccaccggccgcaacgcgcgatgccgccggctcgccttctcgccgcccctgccaccggacacgacgcacgacgacgacggctcgcatcctcaccccttccgccgccggctcccctcctcgccgacgtgacgacaacgacgaacgcgccgacgcaacaacaaccgagtcgaggcgacgacgacggcgccgagtctacgactgccgcgacaacgatgacgacgacgtctgtggaggctgcgaatggaggaggagaggcggcggcttggctcctccctctcctatgtggggtggcggacagaggagagccgtcagccggagggggaggccggcggcggcgcccgtgggtaggggtggtggatttttttcatttgctgagatgattttcgcaggcgagcgatagtataccggcagtccttcccccgcctgcaaaaattgttttgggccatctggaaaaacgatttttctagtagtgacaatgaataatccaatcaattgcctaaaaaatccaatcatcaagtaattaagcttgcaagtaaaaagtacatgaatcggggttgcatcctgaaagaaaaaggaatcgatgatttagttgtccgctccagccggtaggagtagtgtagtacgaagaaaagatgaaataataaagcagaagctgcattctgcgagaaaacgggacagcgagatgtcatccacaaaaaagctttgctaactgccatcttctcttaattagcagagtggaataatgttgattagtttaagcttgagcctcagatggacatcgacatctcatattctcatgctttaatatgtggtaatggcattggtggtagtcatgaagctagaacactcttgcattgtgtggttttttttatgaatatataataaaatacgtacattgaaaactatgtcaaagtcttagaccacgagtaaaaaagaatccagggagcaggaggttcagatggtttgatttgctaaatatatgtagtagtacttcgttgacaataatactcgatcgtataaagggttaaaaggctattttggagaactgagacttactatatactccatccgtttcacaatataagtcattctagtatttcctatattcatattgatactaatgaatctagatatatatatctatttagaatgacttacattatgaaacggaggaagtatatacagctagcactgcatcatgggctcatggcaataaaagagctcgatcacatcgaccaagatacaaaatacacgaaaatctcatacactggaatggttatctggataacaaacttgcatgagttcgatcgatctggccagggtccaatgatcccatcgcattcgctagctagctagctaagcccatgtttatatgaaatccattttaagaagaaggcagcaactaccagctgaaacggtagttaatcacca

SEQ ID NO: 33952 - DNA, 1501 bp, Oryza sativa
ggcgaccggcggcgggagcggtcgatgacgatgtgggcggcgacgtggtcggcggcggcgggcctcaggccgcccagatctggaggcgtgggcgggcggcggcgcaactgggcagctggccggcgggagcggccggccagctagggtttcctttttttttgaattttatttttttcgcgattttttctttttgcatgcggtcgggcaaaagtccttttcgcccgcatggaaagactgggagcaccacctgtcccgaggcgccactggtttgacacacatcagcacgcatatctggagctactatggctcgcactcgcacatgtactgcccggacgacgacgtacacaggcacagcagctagctgcatattatctgcagaaatttcgtcgtccctgtcgccatcgctggcggtttggaaacatgtacagctcgtcgatcgtatcgtcgtacatactgactgttcgtttgcgcttggccggagccggagactgtccgtgccgcgtcaaccacgctaattaacgggcaaaacaaaaacgccaccttacgtacgtacctgctccgatattccgacctgtcgtcaacgagagacagagagaggaaggacgacgaagggcgcatgtcctgctcgtcgctcctgtgccgcgtccgtctcgttgcgccttgtgcccttcctcctcaggaatccggccggtggcccccattcctatgcgtgatattatctagtcccacctccgtttcagattataagactttctagtattacttacattcatatagatattaatgaatatagacacacatatatgtctagattcattaacatatatatgaatgtgggcaatgctagaaagtcttataatatgaaacagaggaagtactttctttctgctcaaaatatatactattatcatatacatcgcaaaaaaaataatattatcatattgtaataaatagacatagaacccagtatcataaatttatggtgtgttttgttcatggttaagattaggtaggatataacaattcatattttttgggatatatggtccaatttttatttggtgagttgatatggctatccaaatttttatagaacggataggaggaaaataataaactagtaagtaataataacatatgttaattattattagtttcaccataaactatactaattatatctccttgacattaattttgaaaagttattactaattaaaaaaaataattgtcgccaattaattactaatgatcaaaattaatatcctcattcggttaatttggccggatgcactcattcaacgtattttagaatatttcctcttcgaaccgtcctatagctacccttgttcaccaatcaaacaccttcaaaagttggattgctatcacctatctagggacatctttccaaccaaacacatctttacatgaaaatgatatgtctagattcatagtgttatattgtaagttagtattaagttattatattttaaaacacgga

SEQ ID NO: 33953 - DNA, 1501 bp, Oryza sativa
ctcctttgtaagaaactagaaagactcaatgctgcagacttctttaaaggatctatctcagatgttattccttcctttgtcagatctggcctatcaggagtatcttcaaattcaaatggcagaccctttggatcggctctctgatgagtatcataaatggtcctatatatggggcaatgacaggttctcttctcagaaaatttatgctacaaatttcatggatgtgcagtcccctgtatatctaaaatggatctggaagagtagctgcactatgaaggttaaggtttttggttggctccttctcattgatagattgaacactcgtgatatgcttgacagaaagttttatgctcctcaaggaagtgatttaacctgtgttctatgctcatttggagaaagagaaacccttgagcaccttttcttctcctgtcccttttgtactgatcgctgggagcaatttggtatagtctgaaatctctcctactcttttgagaatatgctaacacatgccaagaactcctatcaatcttcgcacttcctggaaaaggttctttatgcggcctggaatatttggaagtaacgaaataggttcatttttgagaatgttgtgccttctgttccttcctggatgtcgttcttaaagaatgatatgtcccttcttgtttttccgtctaagattagatgatagataagttttttttgttcctggctagacaatttgtaacttttgtaattctattttttaataaaatgttttaactgtgggggcttcccctacagtgttttcctaaaaaaaaaagaaaaggtctcggtgcttgacaacagattattatacttttattaacatattattatacgttattccccgcaaaaaaaacatattaacgtttttcactaaaaaaaaacttgcaactgttatttagcaatttcaaaaaaaaaatcttattaggaccagacctagttgaaaaattgtaaagaaacacttttatttcaacaaaaaacggattgaacttttacatccagaatacttttggtgcgactacgtggttatacctagacaccaggtacgtgcgaccacggcggcgaggtgaaatccgcagctcccccgccttgtcgtagctgagcccaaacacggtcacgtggagcacgcatccatcctccgcgcacagggcgtccgccatgtcgaggccacggcgaagcgcgcactcgacgaggcagaacacgccgtcgcccatgtacgcgagcgtggcgcccgagggatgccctacgtgcctcttggggtcctcgcgaagcagcgtctcctcggtgatcttggaaccgagcgcggcggccgatgccgcggcgccgcgagacgcgacgtcgcaggagcagaggcggccgtcgtcgtcgagcccgacccacgcgtccagatcgtcgacgtagtgtccctggccctggaacggcagcagccagtcgccgagcggcgtccacgctgccgcggccggacggcggcgggcgatgt

SEQ ID NO: 33954 - DNA, 1501 bp, Oryza sativa
ggtttgcaacccatgtatttacttgtcaaaaagctttgccaccaaccttcctcattttccaatctccagatccatttccctaacaacgctttgttcattgtttccaaatccaggatccccaggcccccttgatctttgggtgaacataccaccggccattgtaccagatgatattttcttatcccttgatcttcttgccacaaaaatctcctcctgtaaaaatccaatctctctctaactccttgtggcagtctgtagaaggatatcatgtaaaggggcacattgctaaggcttgaattgaataaaatcaatcttcctccaatagattgaagtttgccactttgccttgccagcatcccaatttgtgttccatttttgttctcagcgtttttccaattcatgtaacttttgttttcatgcttatgtatcattagcttatacatttttaatgtcatattattgtatggactgttttatgaataagtttattatatatatgtttaattgtagaagacaataaaaaataattttcattaccacatatatgtttctctttaacaggatatggcctttgctgaatcaatatggacctttatgccaggaaagaagggatcagttgttcaggggccaaacactagaactctaacaaatgctcatgatggtatcttggatgatattaattgtgctcagattgctgggaagcatgtgggagatcattccaattgtgctaatgtcatcaaggtagatatatgctataactttctattaattctttgtatcttttcaattttgatacatgttaactagtgccttttccataatgtctgttccacatgtattttcacgctttgatatgaatatttgagtacatagatttgaattatattataccatcttttcctccttagaaaacatagcatgttatggttaaaagtattgatgaaacttcctagctttccatttgaaccatgacaaactccccattccagagatgcgctttcaatgatttcagatggtcatgtatgttgttggattgcagtttattctttgtattgcagcatttcaaaaccgaattacatctgtgttcgctgcacgcagttgggaacctatctccagcgcacggaaaacggaacagtccattagcacgcggttaattaagtatttgctattttttttaaaaaatggatcaatatgattttttaagtaactttcgtatagaaatttttttgcaaaaaacacaccatttaatagtttaaaaagcgtgcgcgcggaacacaagggagatgagttaggaacccttcctaccgaactaagcacttctcaattttttgtatgaaattattttgatattccatacattgttgtatgtttcatgcatgcaggagaatccttgtttatcgtcttcaaaacattatgttggattctgttcagcggataggtccgctgggccatcatgtttcatttactctttcaggcctgacaatgaaaggctggagtcata

SEQ ID NO: 33955 - DNA, 1501 bp, Oryza sativa
cgacactcgacatccaataagaaggaagaccgattaacggaaatacactgcagattttgttaattacataacaaatgtataatcctggttttgttctctccaaggaaccaattctgatcctgggttagaacatggttttagattcttgtatgaacataagcaactctttgaccttgatcaagctatagcatgtgacctaatcaatcaagatacctatttgactttcataatatatttttccctatcacttgagcatgcatgcttttgaccatatatatgcaattaattatattttgtttggcacttgttctatcaagacgaatgcatcttatctacatatctgttgccctgtcgcttggttgtttggtgtggctacaatgatcaagtaaatagactttgatgatgcaagcatagtcgtttcaggcttgcagctagcaactggctaatcagcaaatgatgtacatagttgcatactactccctttgtcctaaattatagggcacctctttttaagaaaaattaagctcggtaacttttaactaataagcacactaaccatatatatgctaagtattatacatgttatttcacttatattcatattttaaagtactttcatgtaatattaatttcatatttgttaggaatataacatgaaatatattaatgcttaaagtatgtcattgaagaccgtgtaaaaaaaaatataggccttataatttaggacggatggagtatacagttgtaactcttaagcagatcgtcatcactaacaaaccaacagaatgacaagaatgcgcatagaaacacatgtttcaaacatggcattagagtaaaagtttataaattatgcaactctaagttttccatcaccctaagtatatcactagcatacatcatatttcatcttcactccagcctcagctcaaaagcttttgatcctaggggcattcttgtcttttttttaagaatttctctcattcagcaaattaccagtttttagagtgtcttttagccgtgacatgtttttacagtgtcttttagctgtaacacgtttttacaatatctaccagcaaattacactttttttaagagttctatagcaaattttgccacacaattattagtggaaagtagtagcgtactgtatttttcaaagggatatgaccagtagagcatatgaaattgtaactcatggtagttaatccctcattaaaatctatcagtacctatattaatagaacacttttcaagagatccgacgttaactaaagcatgcaaaattatatttcatggaagttaatgtcttaggagattctacgttaagtagaaagatctgaccgccaatcaagtattatatcatcaagatcatatatacattaattgatttaatctaccataaagaatggtgtgaatgttaaaagaggtgcctcttttgtagcgataactaaattaagtgggttccatctagacatcaattcatacccttgatttcttatat

SEQ ID NO: 33956 - DNA, 258 bp, Oryza sativa
cacgagctctcgtcgttgtgtcatcctgccgtctcactccgcaacaagtgccactccgcctctgcatcatcatcatggagaaggaacgagcacgagcaagcaactccgcaccggcgccaccaagatccaaatcacggagcaaatattaggggacatttaactttgggccacttttaagatgtgacaattaattattttgtcactcactatctatgacatgtgggtttagtgacaaatcatctatcaccatccgtaaga

SEQ ID NO: 33957 - DNA, 564 bp, Oryza sativa
taataattccaaatttttttaataagacgagtggtcaaacagtgcaaataaaaactcaaaatcccttatattatgggacggagggagtacctcctaaaaatacccttagtttagccgaaaggctacactcaaaactaacctgatgtatactaagaaagtaataaatgctcacaattcttcccaactatagagtaccattattattacatttactaaacaccataaaagaacaatacaactcttttttacaccaaaatttccccatattcccctatggccccacctgtcatccacacaaaagcccacctttcttcttatgggccttggggcccatataaattagaccccagtaccccaccccttcgccgtcatctctctctaacctcacgaaacctaacaagaagaagaagaagagaaattccggcaaggaagggagggagggagaagtcgttggtgcgggggagattgatttcgcgggagggaggggagctcgagaggcggtgattcggggagtcggcagggtggcgccgggtgcggcggcggcgggggcggccgtcgggggga

SEQ ID NO: 33958 - DNA, 1501 bp, Oryza sativa
cagccgccacaaagctgccgtgcctttttttcgaggggggagggtgagagacagagtgattgagagagagagagatagagttagggttgaactgctgctatatggacctatatgggctgttgtttagctttaggccttcagcccaccaagttagttgccgctatctaagggcccatttagcggctatagccagttaagagcagctaatagcgccatagaatgtgtagcggcaaattggacatatcttagcggttgcttctcctagcagctaatagccggagatttaaatccatgggcataataacatcttggcctctttgttgtatcctatgtgaagttttattactttgtcctggaagaataaaaatggctggcgacgactatgatttgttttggaggagactggtgttgtattgtagtcaaatatttacagaacaccagatatttggcaccactgatcccctccataccaggggtaacaaataggccaaccaaatctcatattgtaacaaaaacattagacggcgttagagaaaatggcatgataaaaaaaactgtgcacatcacttgcaacagttcatgttacattgtagaacatttagttgcaagtagaaaaggtatacatgagaggctagataggggagaagtcctatttataatcctaaattcttgcagaaagaaactcagcatcaatctagaattacaaaaccaaacatttacaaccctaaactctctatccggctcactttgtccccttagagcaaattcatgttacagccctcttatccagttcaaaaccttataatataactgtagtaatttatagtgtgtttttctactctttctttacagaagatatggtgccataaatagagttaaacacaaaagttattgtttggttgatttaaacacaaaagttatttgtggaattaccaaaccaccggagaacaacggacgttcgcccaaattattaagaaatatggataacgaaggatacaatagcaacaccaaggcgatatgaacaaggtttacaacatctatgattatcacgatatctgggtgggttttatcgttgaggtgtggtaaaggtaacagactgctataatgaccaagttcaaaagaatttaaataaaaaataatttttttgtagaatttatccatttttcttattttcgcttgtaactaggcttattgcagagaggggaaacctctctctgatctataaggttaaacctagctgtggtgcggttaatatatagtggacgcctcgtaaagatagcataaaacctgctccaaaatgcttaaatgcaggggtatgtaagcataattgtctttaagccttgtgttagttattccatttgagggcgggattggaggggatcgaggagggttaattctacaccttaatagatgtggaactattcccgccaaaaccccctctatttctttgtgggtggaattaaccaaaacaaggtcttaatgtttggtgtggattgattaa

SEQ ID NO: 33959 - DNA, 1501 bp, Oryza sativa
cgcgctgctcgccgccattactggcctagtctgtgaagttgtgcaggccgtatatgcggtcaagacctacaggcctacaatctagctaggccactgtgccatatgcctaccaactttgcgtagcctatcaagtaacaagtatgactctgttgatttttcgacgttttattcaaaatttttgtgcaaatataaaaatatttatgtcatgcttaaagaacatttgatgacgaatcaagtcacaataaaataaatgataattgcttaaattttttaaataagactaatggtcaaacgttggaaaaaagtcaacggcgtcatacattaaaatatgaagatagtagtatattattaactattctctccgtctcatattaaaaataagaccatttgattttttctttctcaaacttttcaaaatttaactaagtttatacataaatgaagaaactcttataacacctaattattttcactgtcataatttttataaatttaaccgcacttaagaaatagactagaaaaaaaaagtcaaaaagtcttgtacactagtgaaaaatgattttcctgaacgagcaccacagtaggttgctaacggaaaataagtgtctgcatttgctaaaatcgattcctattttcgcatacggttatgttgacgaaaaatccatgtgcggcttatggtgctaaatctttgttgacgcgaaatatgtcggcaaacacaatggcctaggagatctgcttagttccagtgcaattcctaaattttgatgagatgttggtgtcctagctagctagtttgatcctgcaactgataagatagataaattgacgatgatagagtcaatcagccaacaagccgatttagggatattaactgatgtcgatagggttttaaatgtccgatatagattttgacacttggataaataatgatataaaggcaatcggacaagcagtgagaacttgtaataatacaacaatataatctaatagaaaccaatcatccaatagcggtatgataaaataaatgttgatctgatggttaaagtatatatcgtctgggaatccaatgtcattaaatccaaattatcaagtaataaatgaaacctttgttgtaatcaactaaaaccaacttgtatataatccttataagtcgatgcaacattaagataaatcatcggctaaaacctcgatgcatgaaacaatgattgatgcctactgacttgaataaatctaatttacaaccacaaccctataggtcgaactcaatcgatgcagcataaggttgataattacctaatggatttaagcaagctgatatgacaccgttcagagtggtcaagcattaaatttaacaaaacagtaaaaccatcaaagaggaatttagcacctcgtataaccctccgatgaaacattagcatgaacctatatatcgacttaacaagacttgatttatcaataataataatatagtaggtcgaatctaaccgatgcagcacgagat

SEQ ID NO: 33960 - DNA, 1501 bp, Oryza sativa
taattgttgggggtcgaacctagggttgctcatattactcgcacttgctaatggattccaatcatgctaggggctaaagcttcttaatctttctattgtcatcgtggtctatttaggagttaaccaacatagcatttatgggatacatatatatttggctaatcagtggtttagtctatcaaatggctatggaaggattatggctatatatgcatctatctaaataggacggttatatactagaggttctgttgttagatggatttaggatcaatcaaataatgaatcatttgtattattatttaattgatggaggctttactttgattatgaacatattttacttgtcacaataaattataaaaggttaataattatccatgctttgtatgtgagatttgtttaggttaatcatattatggttacggattatctcttaatgaacaatcctaatttacagttgaactataattataattatatgaggtcaagatttataattagtatttatctaacatacatgtttgtcatatactccctctaatttaatatatgcaacatgcaaattaatactataccgtacactataatgggatgtatagtatatgtgtaagcaacaatatcttattattggatcatatatttgagtagttgctttttactgaaagctatgcaatacatgttgattttaagatggctctgtttggttaactaatggatgtcaaccgactatatatatatattctacttcacatgacattgtatcgactaacttttaagtggtccaaatacaactagctctgtgattattctcctaaaaaagttaaagattcatctatgtgcgtttatattttagttacaaaatatgaggctaaactttatgtaaataatttataagtcatggatttagttatatttggacatagactagtaaatggcactaatattttcctatatacccattaatttgaaggattgattataactaatttatgtggttgctacagtgacaaaacatattaaagataattatgccactgtacaatatccatttttatttattggcacactatttaggttaactattatctaatcatttgatattaattaattaataattataaatatattttattaaatagtgaattatataccattggaaagcttatgaatttagatgaatttaggatcaagtttcattcaaatcggagttaaaatgaataagttatgctagtgtaaagattcaaatttgaataattgtgaaacagtactgttcctatttcatttatttttattccataatttacattgactgacccgtgggaccggcctgccatggacacaacatatataagtgaattttcatagattttaatcatagggaccgcacatgtaagggacttaactaataaagatcaaggggaggattactatttactaatcacgtggggcccactctaacctctctcctccattctcttttctctctctcttgtctgtt

SEQ ID NO: 33961 - DNA, 1501 bp, Oryza sativa
gtgtcggatttgtcatcttcgatctcctgagcggctgcacccgccgttgccgagctctcaatgttgtacccgccaccacagagctcccaatgttgcacccgtcatcaccaagtttcctagcgacggatcctccatcgtggagctccttgaagccagatccgccacttcaatatgtggacactaccattaattgattctgctattaccatcgcctgaagccgtagggggcctccgtctccaccacccgaagcagtcgtcggtagaagctcgccgttgtcgcctccaccaccgcctcttgtccatgccgctcgaaggagagtagtggagatgagggagaagagagagagtgagagtagaaaggacttagagagaagtgagaagacgcagagaggtaggagagtaattgagaaacgtccagcgatcttccgggtagctccacaaggttagagagatgatgtgtgactggtcggtgctatatttttgcatatagattttttaagagatatgtctgtaaaaataaccctattttcgtaggtagaccacttaatacgcccgcatataaaaatcaaattttgtagacgggtctttattagacacctaaaatcattttgcatataaatattattttagccggtctgtagaaattaaaagggtatctctaaaaatcatttttatagtgaagaaagtactatatatcaaaagaaataaaagaactacaaatattaaatgggacgtactatacgtcttggccaacgtgttagggctgtcgatccgcgacaccacaacaatagaaccgaagcatatgaaatagtaccaagtactcccaccgtcctaaaagaagtgtagttttacgctgtttatgtgtaacatttgaccatccgtcttatttaaaaaaaaatatgattagtatttttttgttgttattagatgataaaacataaatagtattttatgtgtgactaatttttataatttttcaaataaaacggacggtcaaacattggatatggatattcacgagtgcgcttattttagaacagaggtagtacaacgtagctgctacaaactaggccccctttagttcctaaaattttttccccaaaaacatcacatcgaatatttggacacatgcataaaacattaaatgtagattaaaagaaaaaattaattgcacagttagggaagaaatcacgagacgaatcttttgagcctaattagtctatgattagccataagtgctacagtaacctacatgtgctaatgacggattaattagtctcaaaagattcatttcgtggttttcaagcgagttatgaaattagttttttcattcgtgtccaaaaaccccttccgacatccgatcaaacgtttgatgtgacacctaaaaattatcatttcgtgaactaaacaaacaggccctagacacagagctatccagattccagggccctagctagaacaaactagaactactaggtcgaccatgcatctcatcaatcga

SEQ ID NO: 33962 - DNA, 310 bp, Oryza sativa
cacaggttagaatttacccgagtcttcttaaagaaattctttctatacatgccactccatacccagtcggcctaaacatgccgtgtaggtatggggtatccataatctccacagtcagattcggcggtcaacaagcgcgcggcaatcgtcttcctcctcctttcttttttgcaagatttggtggccacaagcgtgccaccgtcgccgccattgcgctcccttttttcttttgtgtcgcactgtcgcccttaatcccctcctggccatcgccatccatcccctcaccaacaccatcggttttccctccagc

SEQ ID NO: 33963 - DNA, 1501 bp, Oryza sativa
ccatctgcagtgtgcacctttcaaaacatggaagcaaaggtaaagtgcaagcagataactttaaagcgaaatatataattggagagctttatatggctttgagtaggggtcgtacgtactgccttatatatcttttgcaagaaaatcctttagtttgtaccttggctgaatttttcgtccaacagatctacagcggtatagattgactaacacaccaaaatatatggagctaaccctaattgtgcttacctccaagcatggatttcaatttcgatttcgacgaaaatttcagccatttcggcaaaaccgaaatttccaaaatactcagcaagatatatacaaccatggttaaattataagatagtaagatacagtatgcattttttgacaaatcttaagcatatataaaatatatacttcataatgcaaacaaacaaccgattcaactcttagtataacatattaagtataagcaaataaaaaaaataatttggacgtttatcttcggcatgatgttctttttatagactttgcgtgatattatgttctgtcatgcaccatgggccggaatggcactatactatatatttactttgtttaaatcttgtcttagtagtgcatatcctttaggcttctctttttagcatagaacctttatgtccacttctatctaaccgatttcagaaaagaaaaggaagcacgtcgatccttgttgtaagaaaattaagttgtacgatgaaccaggaatagaggctggaaaaaggaacaatatataccaagtaggtagctggttaatttatacttcctccttttagggtctggttggatcaggtacaaaattttagtccctgtcacgtcgaatgtttgacactaattagaagtatcaaacgtagactaatgtgataaaacccattctaaagccctgaactaattcgcaagacaaatctattaattctaattaatccataattagattatatgatgttacaataaacatgtgctaattatgtattaattaggcttaaaaaatttgtctcgcaaattaactctcatttatgtaattagttttattattagtctacgtttaatacttatagttagtgtccaaacatccgatgtgacagtaactaaaatttagtcccgagatccaaacaccaccttattcatatatgacgcttcatataagtagaaagatgcaccatataattaagtagaaagatagactattatacaccattattaaaaatatgagaacgtgtaataatttggttatcacttactacggaactttttttttttgcaggcagggtgccctgcttacaactataaagacgcatttccacaggctccgacctaatacaacaaaataaatctaaattcaaaacgttatgtgttggtatatatgaataacatgaagaaataagctagattaaaaaaatggcctaaatctccctcctctctccaaaaatatatgtagaaattgacctacatgttaaactac

SEQ ID NO: 33964 - DNA, 1501 bp, Oryza sativa
acatatcacgtgtaagatcccgatgctaaccaaccaaaccatagttaaatataagttttatataagttatatcatagttacagtgtagttatattgtagttacagtatagtaacattgtagttacaatgtaattatatttcaattatagtatacttatatatgaaagtttttcactcaaaaattgcggcagttttttagatactatcatatttgtatgcaatatgaagattacacgagtgatcaaaacggaacattcaggtacatatatgtccatacatattcatatcatttatttgaaatttattatttctaaatatcacaaatatatgtccacatcatgatcttatattcagtaagaatttatttcttctaaaaaaaatccaacgacatttttttacacaagctttcaccgtatattgatccatttaccccagcaaagtcagcaacaggtaggttaggaaaggaggttgaataagaaatttgaggttggaaccaactgcaattaacaatctaacacatctactactactattaccacaataaaacatgtttcactgtcagttcataggttcactgtgaaccggcagtgttagaacaacactgccggttccgatcggtgagcagtgaatggtcctatcgacttcttgggcagatcacacggcagcctcacaacgtcgccggctcaacaggagcggagaaatttgattgaaattggaagtttgattgaaattgaaatgatgtgttggaaaagttggaagtttgtggataggaaaattttaatatgatagaaaaattgaaagtttgaagaaaaagtttggaagtaaactcggcctaagataatttaggcgtaagaaagatgaagaagaagattgctgtggccaatagcccagctggccaacagacagtagttaattgtagcatgcatggatatatatatatggattgcgactttaccttcggtactactattaaagttagacaatctgtatcaagtcgatcatacatatagatagatatgcatcacgcggactagctaattaatatctacgtcacatcgataataatcatatcgtttcgatttttcctatatctacctgattctggttttggatgcatgtaagcacaggagtcaatgatcgcgagtataacgacgacgtacgacgacgacctgtagtgattttggctctaagcactggactaataagctacaagccgaagacttaacaacggagagatactcacaaaatgacgcaccttgctatcgacgggtatgtcgtctaccactaaaagcacaacgccgttaaatcttagaaaattcgctcccacggggagtcgaacccaggacctcaggtgctactgagactcttgtaattactaggctacaggccctttcgcaacaacggagtgacttatgacgtacttcctcaggtcgttgcaatattcaggatgttttaataacttttggaatatatttaaatagtttgaagacactaaacaacg

SEQ ID NO: 33965 - DNA, 430 bp, Oryza sativa
acatgttcctattagactatgatgtaaatgacaagctaaaagcactgcaacagaaatgatttttgtaaacagctaaaatccatttccgcaaacggctaggtgactatagggatggacataaagctcgtggctcgttagctcgctcggctcgtaacaagctcggttcggctcggctcgtttgattttcctaacgagccgagctgtcatttcagcttgttagagataacaagccagctcgagctggctcgcgaactgctcgtgagcttaacgagctagagcaagtttgcagacatatttcctcacatgtatccccctcagcccatggccgaaatacagcccacttaggcggcccaattaaccgttcatatataagaagagaagaaaacctagctcagtctttcactctcctgatcccctttctcatcctaga

SEQ ID NO: 33966 - DNA, 617 bp, Oryza sativa
tcctatcctaggttgctacattataggacgaaaggagggtcatgtctaaattcgtagtcctagtatgggacctagattgttacattatgggacaaagggagtagcaaataatagtccttttggcctctatataaacagtcattgataatatgcctgcgactaacaatcgaattgggatccagtgcagtcacgatagggactgcaagttaacaattgcacacaacttcaaccatccatttttatgatcaacggttcatatctaaagctacagtacccatgtgaacagtattcaacgctacagtattactgctacagtactgtgaacagtaccgtgtgtgacctgagccacccgatttgtatatactgctactgcttaagctgcagtcacacaaatccctaacaatcatacaaactgcctatgatttaggcacctagcatgacctcttctgtatcatttgcaagtgtcctttagcactctggtctaggagatcataaataacacaaagatcataataagagaaacattttattaagctcaccgcatgcatgaggcaacggggacgatcgatgagctggcaaaaaaaaaatggcccatgtgggggccagatcgaccaaca

SEQ ID NO: 33967 - DNA, 445 bp, Oryza sativa
gcaactaagtgacttttaaatgctgtttactgcaaaacttaaccccgatattattatccccttgtaccccccttgcattaatcatgcatctgccggtgtggcttgctgagtactgtggttgtactcactcttgctcaatcttttccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatataatcgatataataaagatgtgccttttgtatcatgtttgtttggtgtaccccggcatttcctgggacggggattaatacactagcgttcgggaaaaggcaattttctcggtcgcgacacctcgttattatgccgaagaaca

SEQ ID NO: 33968 - DNA, 1501 bp, Oryza sativa
gtattttgggcccctggaatttcagtgacccctgaaattttataccacctctgatagttgaaccctggttatgacctataaggatggtttgaaatgaagcatggcatctgaatgttaaagatctacaaattgtgttctggatcacgattaccattggtcatctggtagtttagtgctttgattcgttgcctagtgccctggcttgtagttaattgactgttcaagttgttagtttgctgtcttttgtgattgcctatccaagtagttgcagggctagtgtaggggcctgggttgtgtcacttcagtcagttcaagggttgtccatttggaattatctcatgattggagtttagccccccaccttgatctgttcatcagtgccagctaatgtcaatccaaacattgtttgtttgtcatggaaagaacctggtttgtttttcatggaatgaatcttggaagtatacttaagtcaagaatagaccataccgatggcgagcacggacactaacagtagtatttatccttgcaaaaagaaaaaatgaacacattaggatctttcatatccatgaataagtattatttaccttttgctggtactagattgataggtctatcaacaagaatttctcttcttgtaaatgttgactgatgaatctctgaattgattttgcttgacaacctctcatttctttccaacccaggtatgtctgtgctgtgctgtgtccctttctagtgcgaggaaaactctagtatattctgaaagaacttgcaagcatggatctgattagagttgttgtagtcagtatgagcaatgcacatgagcaatctgcaggtaaggagaaaagaaatctcttatccagtcccttcactgggtttttttcatattttcagacttgctacagtgtctccagtgcccttttagtagttttaagggctaagcttctgcattgagataccaaaattgcagagattatggtaggcttgactgtttgaggaccatgaacagcctcccttgggggcactaaacaatggaaccatggttgcctttcttgcttgcaggcatgtatggccacttgatcctgtccgcggcgcggcgcatggtcctcaatcatggagcagcccctgggtactgtgcctcagcacccatcaagggtccatctatgatcacattgttaagtaagtgctcaccctccttaaccattatcataagcaatagaatatcaggggcatgcatttagacttggaagtgtctcctccaaggcaaaaaaagaaaataagtactgaaattgcatgtgaggtggtgggtggttatggtgcaagctctagagatatcctttggctcctctatataagcaaagattgcatcactgcagtctcattctctacccgcatatcggcattcgcctgaaggcaagcgagagagagagagagagagagagagagagagagagagagagcgctctgaaccttgattcgcattgcatttttcagtgttccactg

SEQ ID NO: 33969 - DNA, 1501 bp, Oryza sativa
ggcgtatctctcttaaaaaaaggtccaatccgtggctacaaaatctgcatactccctccgttccatataaacatttttttagcacagtgacaagtcaaacatttttaattttgactattaataaaaaaaataaaaaaaagatcaatcatgcaaaattgatgttactagatttatcattaaacaacttactatcataatatacaactttttttatttaaaacattttacttctatagatatcgttaatcaaagtagtatcttagagaccggatcagagtccaaaaattcttagggcctgtttagatccagggactaaaatttagttcctgtcacatcggatgtttgacactaattaaaaatattaaatgtagactaataataaaacatatctcataactatgtactaattcgtgagacgaacctattgaacctaattaattcatgattagtctatatgatgctacagtaaacatgtgctaattatagattatttaggcttaaaaaattagattaattggatccatgccactgcaactttgccaaattaaaaaaaatacaccactactattcccgatatctactgggtgccatatgtattttgcaaatttttaaccatgccactgtatacgtcttggacccagttggaccaggttttttcataccatatttttgtaaggaccaaaataccctcagtccatagaggatgacaagtaggacccaccttatcatacttgttttcatcctatcttatattttggtatggagggagtacatactttggtcaagatttatagcatccgtaactttggttcgaaatcttggcttttcctacgtcctacgacgactattcttttgtattcaaacttctaactttttcatcacatcaaatgtttggacatatgtatggagcattaaatatggacgaaaaaaaatcaattacacaatttgcatgtaaatcgcgagacgaatctgttgagcctaattacgccatgatttgataacatgatgctacattaaacaattgctaataacggattaattaagcttaataaattcgtctcgcagtttacaggtgaaatctgtaacttgttttgttattagtttacgtttaatacttcaaatgtgtatccgtatactttaaaaaaaatttgacacacagactaaagcgcagccaaacacagcctttaatttgttcttcgtcagagaaggggacagtgtggaggctgcatgcggatctccatgcacacgcgctgtacttcctcccaggcgaactgtagtagagtagctattcgctcgatcgatctatagctagcatcgatccgtggcgcggcgggcgatgcatgggcgaaaggtgctctcgatcgcacgagaaaaaagcaaggcgtgagcaagtaacatgggagcctgtactacctagcactatagattctactgccccatgtctgcatttctagtccggtgcgctgactcagtttatactttttttcattccttaaatccc

SEQ ID NO: 33970 - DNA, 1501 bp, Oryza sativa
ggctgagaaaagaacagtctgcctatctgggcgggtattctgaactatccgagtaatctgaggctcaaagcccatatcaaacatcctatcagcttcatccatcaccaagaatgtaactctccgaaggttagtaatctttccactgctggtgcaaaggatatcgatcatcctgcccggtgtacaaacaacaatttcagcgcccctctttagttcactgatctgctgggcaacacctgaacctccatagatagctacacagttgatgccaagcgacttcgcgaacttcttaatgtctgaatgtatctgcaccacgagctctctggtaggagccataatgagcccaatagggccatctccaggcacaacaggcggctggtctttgacatgcctgagcattggcaggacaaacgctagagtcttgcccgatccagtctttgcaattcctatacaatcacgcccactcattatgattggtaatgcctgtgcctgtataggcatcggcttctcaaaaccaagcttcttgatggtgtcaaggagcttgctggtcagcccactctgcacccatgtttttattggcttgggcacatctttcccatgtaccttgagctccagatttttcctgtaggtagccacttcctctcctgtcatcattgtgatatccttcacctcaatgtacaaattcttccggaatggctggtactcaattttggaatggtcaacaatagccagcttttctaccttcgtcttcttgacacgtttcatgaactcctcatcatcctcatctttcgatccaccctcatcgtcgtcgtcgtcatcataatcagagtccgaatcatccccttgcataattctccccattgccttcttttgccctttcttatcaccattactcacagcatcctttgcacttttaccattcttatcacccatgttggaagcaggcatgctctccattgatgccacagccgtctccagctttgcgacctccggcaacaccatggagctcatgaatgcatcgagcggatcaatctcatcctcctccataggagcagcaacatttgcatcattcacctcactcggcaaatcggcagtgatgccaccgtcatcttctgcattttggctatcctccttgtatccctcctcatcagactcctcaccatccagagtccacttcttcccggcattggaatcgccgtcggccccagcggccgcggcaggagtgccagcaccggccgccgcctcctgctcgcggcgcttcgcctcctcctcctccaaccgcttctgctcctgccactccttgacacggcggcggcggagctccatctcctcgtcgagccgcttcttctcctcctcaatcatcttctgacgccgcctctcggactcctcctcatccaccaccaccaccacctcctcctcctccatggcagccgccgcctccggctccgcgtcgccgcggtggtggtggtggtgcgaggaccggcggcggcgcttgcggtggcgg

SEQ ID NO: 33971 - DNA, 1501 bp, Oryza sativa
tacacggcacacctataaggtagctagtgtgctccttttcctcagacaacatgggtactctgcatgtgctcaataactcttaactatttgtgttaaatttctacctagtaatgaggaagcagttaacagaggcaactaaaaatgatagtgaggttatgatcaactcattggtcgagaccaaaatgttggttaacatgagacagcgcctgtgtgctacacgaccagcattgagacatctaatgtcacatgcttgactagcattcatacagaagattcaatgcttggtcagacaatgttgcatgtgctaattattatcaatcatatatattcataacacattaaatcaaggtcaaaactaaaatccagcagccttaatccaacttggcctcaaaaaagaaaaacgccaacttaatccaactatatgaaagatacttcagaaagtttaaacttagcaacagaaaggtaattactaatcaactcatgatagaaaataacaaagagacacacaaatgaaaacatgggagctctctacaagtacaagtggcaagcagcagacaggccctatataacaaagtgcccagtgttttgactgggaattagggagacatggaaattcagtaaagaacagagcatcaaacggctacattgtccacaagacaagaacactccaaccaaagcgtgcgcgcacacacaaaagctatttcctggtcatctagaataagtacactacaaagtacttttcagtcaaaaaagatatgctgattgcacggatgatcagtgcactcgtcccatctttcctagcagcttccgaacgtatcaagaggacatgaggagatctctaagatgcttgaacactggtttttaagaacttttgcaactctttaaccacacaatctaccgacaagaggatatactacagtactaaaacacattgttaattctgacaagtccaagaagatctgggggatgcaacaaaaccataattaattcctccaacgaaatcagatgggcaaattacagtgcagtgagatataccaagtatctccatggagaagaaaagcaagataagggaatagtttacgataccagcggcgcatgagcagcactgccagtgccagataccaagaaccttcatcggagccatgctgaaccactgaatctgcagatttctacacgtatgcaggtggcagcaggatgagctgtccgttatctgaaatgatcatatccatcaataaaatcaagctttttgtcggcgacaagaacaataagctacattcaggttcagagatttgtctccctagattaaagaaagcaaaggaaaactaaagtattagcacgattgcatgggagcagaggtgcgacatgctttgcctcctctctataaatcattagcctccttccaagttctgtaccacagcagcaagctccaaacgtaatcatcagagagcagagacacctacattcatcaccattgtagcttctgtttcatcaagcaaaactg

SEQ ID NO: 33972 - DNA, 1501 bp, Oryza sativa
taaggcgtagcacccccgtggtagttgtagtcggaccaccaacgtcgtgtcctcctccaaatcgaagtttatcctcgtctcatcgaaagatcgagaacccccgttgctgcatcaagtggtatcagagctcaagttgctcggtgagagatttttcaatcctttgtttttacctacagcccataaaaaaacctcaaaataggtcagatccaaaatcaccaaaacaagttgagcctttgttgttctacttagtttttgcttgctgagttttcggttgcatcgattggttgagttactggttctggtagtttagtcctttagagtttcatgttctgttgacaatttcgtcaccacaaacacttccaccatcacctctttcatcttcatcccgctgccaccatcatcaccatattcaccacgaatccaccttcatccgcaccaaattttcgtccaccacaaccaacagcaccctcatcactacatcagccacccccaaatgcatttattgctacctccaccaatagccaacccttttgcaactttgtaaagtgaattagcccttccaaagaaagcatttaagtgccctcacttttgacttgttggctgaaccaagtaactccaaccagcccatcattactccattgtgttgacatgttggctgaatgaaaagagaagaagttgttcctgttcctgctgttttgagtaatttcgaaattcattgggaaaaattttcagctttgaactagtttaaaaaaaggaagaagaaaaaggaaagaaaaaaaatcagaagtgaaaaacaaggagaagaagaaaagaaaaaaatagagaagaagttgttgctgttattttccttgtgttcttttggtgcaattttgagtggctacacttgtgagtaggttcgtctctctaacagggttttacctaggaccaacacaataccatcattgagcgattattcaacttgcttgattaatgtggttctagctgtaccttgacattacttgcagtcacctatagctccacaattttttatctactaccatcacaggatcgtgcttgttgtcggctctggtactactaaccattgttgttgttcttgctagttgccaacgccttttacatagcaaagtaagaacatgtaagaactcgtttgcacaagtttggtagaaatggagatggataacacctagctccaatagttgataggacatatctcttgtgaattgttgcttcctactccctccattccataatataaggcacaaccactttccttagatgttccataatataaggcatgcatgcaagcatgcaattaactatgacatcttctccattaaattattattttttaaatcctccactctcatgttatctaatcctattggatgcatgcattatatttattaggatgattcaaactacaagatgataataattatttttggtctttgggttaagggtggttgtgccttatattttagaatggagggagtattaacca

SEQ ID NO: 33973 - DNA, 601 bp, Oryza sativa
gtatacagggtgaggacaaggagagagtccagcacatctccactgtcaggttcttggacaggagcagaggcatggagaaacgcctgtttcaagagtcataaatatatatacaggtgagtttgattcgatcagcattatgcttatctttatccccaatatgaagttgcaagttagtgaaatttgaaaaaagaaaaaagaaaaaagaaaatgaattctgcttgtgccagattatatcttctgcatgtgttagttcttgcatatatattagatttccttgagaatcatacaggtttttattcatctgcaaacttaagatatttaaaggtgacaaagaggaacacttctataaccaaaaggttaactgattaattgcactcttatctcctttcttggttggaacttgaaaacttaatatgtgaatgtcgttacctttctttcattttgaataggccaagaagatccattgggcacaatgagcaggctaatggatagatgtttgaatgatgatgaaactgtaagctataggagaactgatcatattttatgtatcatcttatctttgtccgtgtaaactctaaatccaacaaaggtgatcgatgct

SEQ ID NO: 33974 - DNA, 1501 bp, Oryza sativa
taaagaacaatatcatttttgataaaacatttgcatcaccggagtaagcgctcttggaccttacagtgaatttagaggtattatttcttcaatagtatttgctaacgaaatattaaattcttactcataaattttttttcaagggtttcattatatgtctcggcttaggcttagccaaccaaatgcataaactaggaaactcaatttcttttttttaaactcttggagagcttttgtttctcatcaaacatgttttcataacatggttgataatttcataagatcatttgatgggctagatggttgtgaaaatttggatttgacatatgaaggacttcctagaaaaaaaaccctcaaaattagttcaatttatgtaaaatttcaaactttttcccaaaaggaggcccaatgagaacttgtatagtcctatcagacatggatgctgcttaaaaatttagcagagttagtcttggttgggaacctttccctccaacacgaaaatggagcagctcattaacacataattaattaagtactccctccgtattttaatgtatgacgccgttgactttttgaccaacgtttgactattcgttttattcaaattttttgtgcaaatatgaaaatatttatgtcatgcttaaaaaacatttgatgatgaattaagtcacaacgaaataaatgataattacataaattttttgaataagacgaacggtcaaacgttagataaaaaattaacggtgtcatacattaaaatatggaggtagtattaactaaaaccaacttgaaaaatagattagtatgattttaaaatagttttcctatatatatatattttaaaatatataccatttagtagtttaaaaaacgtgcacgtgaaaaaagagtagaagagatgggaaaacaaagaacgaaaaaaaaaccttaacattttctaaaaacctgatgaaaaatctgcaattttctcaaaactcatccaagggcaaaatagtcaaatcatcactattataattctcattaatctttctcttccacagttccactcctccctcactctctcccacagttagcatctcgccattcctccgatccccacctccaccaatggcgctctccatctccacgccgccgacctcctcctccctcctgccggcctccctccaggtacgccctcccgctccgccgcctcctcctctctccgacgagctctcatttgcccggttcggccgctcctcgcgcccgtttcacccgttcttggtcaccgccgccgcttcttcctcttcaggtcggcaggtggagctcgtcggcggcgatgtcggccaggcctgtggcctttagcctccggaggccggttcttgcggcccgtgtagccgccggcggcaacgcaccgtcttcctccgtggacggtaaggatgctggccttgtgcttgtcagttgtctccttcatggcttcctgtgtgatttgagttactgattttggtcagcttggttgtagagg

SEQ ID NO: 33975 - DNA, 1501 bp, Oryza sativa
cacctcattatattaataatgacccataaaaatccgaacaacgttcgcgattttcaattggctattcggttcaacctcaattacatttccatttgacccgatttgagcatcgtatgctcatgccatggactttttccggatccgggttctctcagagagaatcattagcaagaggcgacatagtgtcgacacatttattcccacttacacatttaaccagatctttgtcatttcccaaaacgatcgatccatggttgttccgtattcctagcaccatcatatgcgcgcatcgctaggaatgtcgtctccacgacgaccatcattatgaggtatatcaccttccaaaggtgaattctccaccaggagaatcagaggagtatgctcacatcttgtgagaactcttatgctttgactaagacccacggaccgtgttagcaggcgtccccgcagaacatgatcaaatgccataagtcttatgtggatacgatattattcccgggtctatccacatttaccacaatttggagcattactctatttaacaattatccaattgttcctcatatgattttgttggcaaaaactccgtgcaccaagcaaccaggagtatgaactaaacatacaagttcagctcatttagtgtgttcactcaaagaaatctccaggcattccaaaatgggcatttctctccccctaatgccgagatgtgtttcaatagcatactaccaatccccatatcgtggcataggattaaggaatttcacctcgatcacaaatgttctcccacgaatgtatgctacggtggtgatatatttgggaaatatttacgcactttaataggagagatttttcattatatgcagtgagcctggacatataccaatacagtggcatgaatattgtattcttccttcttccgaagggttatcctcaacctcctagttaggatatacaagtctgcaaaaaccaccattgctaccaaatgtatatgcaaccaacatgcaaatactttagccaaatgcactcgccatggattaatgctcacctagtgccattcaaactcacaatcgattctggatcgacgtgcattagacatcgcatgtcatatgcttaagaaggcaacctatggtggcaaaacgcattccgatgcgctcaacaaggagtatgatagcaaagtgcgcggccactagcctgctctgccaagcagatttttgtggtgcagagttgtgttaaagtccagctcgtctaatgcccaagtttgaccccaattactcataccaaactctagaattgggtcatagttaagtagcatgtattaggtacgatccacgagcgaattatcaaaccacatttgctaatgtcccctggacatagccatcgagagataatccatacctccgacaatggtaatattcacaataaaaccattatattcagacatatccacaaaaatagtggaatgtgtcggtgcaaccgtcgttggcataacgagctcaacgca

SEQ ID NO: 33976 - DNA, 181 bp, Oryza sativa
agactaagtggtatgctagatattttcagacttagctaagtggtagttctagtttaaattttttttgtggttggttgtattgtgatcctgagtgtgaaaaaacatccgaaaaaataaaataaaaattatctgtttgccagtgctccccagagaacacggaatgcagccggccgcgccagca

SEQ ID NO: 33977 - DNA, 1501 bp, Oryza sativa
aaatttgggttgaaatttttagaatttagttaattttatttttacttttcagtttaaaattgtaaacattttaggagaatttggtccttttttttttaaaaaaaagagttgttctcacttctcgtgtgggctttcttatgtgtgatttgcctgtggctggagaggaataggccatttgggtcacatctatgcaagtgtacaaaagctaccacatactctttttttttttttgataggaaccgaaactttattactgaggtggtccagccaaatcgctggtcaccaaacgctcaaggccaggtggagtaccggcccagctacaggggtctagtaaattacaacccaattttgccaactcatgcgctaccttattacattccctgagacagtaatgaaccgagaaagaaatgaaactgctagaaatgacattcttgatctccaaaatcacaccccccatggcggaaagattgaaagagttctcctggagtgcagatttcagcagcatcgagtctgtttcaagctcaatcttcatcatccccctttcacttgccgctcctacagccgctgcgcaagcaagaacctcagaatggaaagcatccatcaggtgattagctccgccagctccggcctgaaccaccactccattatgatcccagataacatatccccatccaccttgtttggtgctgcagtggaaagccccatccgaattgatcttcaggacatcaggaatgggttttctccattttgccgttctcctctccttcatcttttttttttttgaaaccgtattctcctctccttcatcttcccctctttccgattcaactttaaatattcctctcgctaaccttcattggatactgagccagctcggctcggctcgttctggctcggtatgttaacgagctgactcggctcggctcattatctcaacgagctaaaagcctaaaagtgcagctcagacttggctcgttagaaagctcgagctagctcgtttagctcgcgagcaaatggggacggaaagcgatttcgtcgcggccggcggctagcagtgcgcgtgaacaacaaggagaggggaggggactcacaagcataggacggggaagaaaacagcattgctcacgagcttgtccacccgtttcaagcgttttggaagtggatccagacagccatcaccgacgctggcgccggcatcagcttcggtttcgacggcttttggcggtacattcggtccttcttcgccagcgtcgtggccacgctcgccggcgcagctcacgagctcgtcgggtcgacggcaacaatggaagcatgcggccggccaacaggacctatgcatatgcgggcgggcggccggcatcagcacaagcgtgcgcaggcaagcgtccggtcggccgatgggcgagggagcgccgcgggatgggaaggacgacgacgcatcgctagcgctctaccgcgtacgcaagggaagcgcggcggcgctttgcggcggcgttgcgta

SEQ ID NO: 33978 - DNA, 1501 bp, Oryza sativa
gttattatgaacaaaatgccaagaaattatggagaagtgaatgggagagatgagcttgactccttttaagttgaggttgaagttaacccaacttaatgtcttgcccaaatacgatggcacttatattaccaatatggctctttgcctcccacgagaaattgatcatatcctaggcctagccatctatatgccacggggacaataatatggatggtaaataatcaatttgtgatcctaaagggtatcagtagtagcgtttcaaatcataggatgaaagtgactccaccttatatcgatgagtttgcttaggtttgctgtggtgcgcatggtgagaccatcaaatacttaaaatgtaaaaacaatatatacataggtatgccaataggtgatggcaaaagtgttcacgagaatttccaaaggtacaactaatgtggttgatttttttttaactattgtgatgcgaaagttcaaggtatctatatttttttcacatgatcgagcgatgttatttcgtacttgagatacttttgcatgggaagagatgtagtttagttgaaacaaacgatcggatttacttcaagatctagtctaccagatgttttagtaccgttgctgctactaagaaagcagtacatcgtattttctataactaagtacattttgttacttatttactgaggttgatgagctctactaataggcgagcacctggtgaaaaatgctggttgttgacgagatcttactcatataagttagtgttcaaatacataaatgcaaagttgaatcatacacatgtgtgagagtttttatgtgtgaatacaaaggtagcttgttgaaataattttgatattttgtttcaaccaaactctatctcctcctcttttatacatttccttatcacacaataacataggagtactatctattgagttacatgcactgatcagttcaacccaaaagcttaagttgatggagaaatacagacaattcactttatattccaacgctatgatttgtttcaattttgaaaatggcatgaaaggctaatctagcaataaacaaagccaagaaaaaagaagaaaaaaaacccatggtaattgcgctcacccaaaccccaacacatccgccgcgtctagggcttcctcgcgctcgccgccggccgccgccgtgaacatgggctccggcgacaaggccatgttacgaccccgatcgccggcggcgctgctcgccggagatccgatagaataggagtagagacgggaggaagaagagaacacgagaagcagaggaggggaatcttttcttttttcttcgatagttttggacgcggtatccccctcacacacgcgacacatactcctcaggtcccaccacttagtggcttacaggttacataaataaattacgcaatcttattgagaaaacgcctttcctctgtacgttttccacctctgctctgattcagcacagcgattgttgctcatcagacaaccgctgtgac

SEQ ID NO: 33979 - DNA, 1501 bp, Oryza sativa; identical to SEQ ID NO: 21675

SEQ ID NO: 33980 - DNA, 286 bp, Oryza sativa
gacatcgcgggcaccgtgttctgactctgagctagggtttcctcttcctccctctcgattcgattcgatgcgagttgtagaggcttaggctgctggaataaaataaaaagaaaatcagaagatgatgggccgggcctacccagacagagttaaagcccaaatccatcgccacctcttgtctctcaagagaaacggctccaagttcttttcctttttctacttactattattattatataatatatataaataatcctcacctacccgacaatctctctcccacccc

SEQ ID NO: 33981 - DNA, 1501 bp, Oryza sativa
tcctacagccgctgcgcaagcaagaacctcagaatggaaagcatccatcaggtgattagctccgccagctccggcctgaaccaccactccattatgatcccagataacatatccccatccaccttgtttggtgctgcagtggaaagccccatccgaattgatcttcaggacatcaggaatgggttttctccattttgccgttctcctctccttcatcttttttttttttgaaaccgtattctcctctccttcatcttcccctctttccgattcaactttaaatattcctctcgctaaccttcattggatactgagccagctcggctcggctcgttctggctcggtatgttaacgagctgactcggctcggctcattatctcaacgagctaaaagcctaaaagtgcagctcagacttggctcgttagaaagctcgagctagctcgtttagctcgcgagcaaatggggacggaaagcgatttcgtcgcggccggcggctagcagtgcgcgtgaacaacaaggagaggggaggggactcacaagcataggacggggaagaaaacagcattgctcacgagcttgtccacccgtttcaagcgttttggaagtggatccagacagccatcaccgacgctggcgccggcatcagcttcggtttcgacggcttttggcggtacattcggtccttcttcgccagcgtcgtggccacgctcgccggcgcagctcacgagctcgtcgggtcgacggcaacaatggaagcatgcggccggccaacaggacctatgcatatgcgggcgggcggccggcatcagcacaagcgtgcgcaggcaagcgtccggtcggccgatgggcgagggagcgccgcgggatgggaaggacgacgacgcatcgctagcgctctaccgcgtacgcaagggaagcgcggcggcgctttgcggcggcgttgcgtaatttgctatgtgcttgttttggagaaagtacaccgaaggtccctcaacttgtcaccgagttagaaaacgctccaaccgcaaaaccagatattcggggtctcttaactaatcaaaaccggcaaaatgggtctttcggtgattttgaccctggttttaacctacttggcggttgaataggcgtaggacccacgtgagctccacatgtcagcgtggccaagtgagcctctccctctttcccctccattctcttctcccccccctctctctctcttctctcctcttctcttcttttggctagccggccggcagttgaggagcaggccactgggcgaggcggcggcggcggcggccggtcgcgaatggcgtcggcgacgctgtgtcgccgccgtcggtgaagcggccccgcgcggccgggcgccgcggcgttgggcgcggaggcggaggcgaggccgtctcgcttcgtttaagtccctgtctcgggcggcgaggaaggtgaggacgaggttgacgtcgaccgccgcggggtcatcgccctccgtcttggcggtggcgc

SEQ ID NO: 33982 - DNA, 1501 bp, Oryza sativa
acatgtgtcttctcttgaacaagaagagtagttcgtagcttgttgtaacttggaggggaatagcccccaagcgcattgttgcaagcaaacataaaagccttcctgaaatatgggtttcttgcaacattgaaaggaatgcctacagaccaaaccaaatgtccaaatattagtcacatttgtaacacaaatatgagaatgtatgagttaataaaacgtactaaactctagtctaacctgctgtgtagaacattctcgcaatcaaagcatcaaggttggaacgagtatctgaattgaagctagactcaatagctgaaacagcccttctcttccccctactcgcgccctctgctggcagtgggatgtccttaggcaagttcctttcagcaactgctgcagctctagccatttcatcatgaagttgactaagaacatcgattgttacctttggacagggagctacaccattagatcccaccttcaagagatgtgctttaactcttgagtagctcccatgcataatattaccacaaagcctgcatctaaaccttacattccctccctggcctttacctgttttctccattaactcaacatacctccacaatggcttgttttcattgtcattgggaggaatcacacggcaagcattcaagaggttgcttgcccttgctggaccactagttcctcttgataaatcagtagcagaattaggagccggactaccactaggatggctagatgcactagcactagcacttgagcttccagttcgataatccatgggatctaacaaaaaaaaagatagtacttatactaagaaaagatgaagggcattgcattcttgcagatccactaaaactctaaacgaaataagaagagcattgcagtattgctctgctgcagtgcatagaatgctaaaagaggggatttattattcacctcaacaagggaacgaacaggaaaacagatcggcgacgacagtgttgtgccgacgtcacagtaggaggcggcgaggcgcagcccagtgcgcggcgccggcgcagctcggcggcggcgacggttgacgaggcagcccggcagcagcgacggcactggagcacgtgaggggcgttggtggtgacgctgttgggccagcatcggaggtggagagcagcgtggcggtgccggcgcagcccgtcggcggcaatggctgatggggcggcggcggcgctggagcgttggggaagagaggcgagagtgagagttgagaggcggcgcaggctgggtggatatgctccccacgcgcgcgcgggttttggtaccggcggaatattagggttaaacgtatcgggaccgtatcagaacgtatcggaaacgtattaggaattattttatttattttaaaatcaggataaataccgatacgtcctggacacgtatccgcccgtgtccgatacatgtccgtatccgatcgcgtgtcggacacagacacgcgcctgctttgccgtatcagtgcttcata

SEQ ID NO: 33983 - DNA, 1501 bp, Oryza sativa; identical to SEQ ID NO: 21672

SEQ ID NO: 33984 - DNA, 1501 bp, Oryza sativa
tccatgtactagcgcatagcgttgtcattggaattgaccctaaaatgggacacataatgtatggaaagaaatgtgcggaataagggttatgttccataatggaatccataaggtatacagatactctcttctactcgaaaggaacatggaagattcttattattaaaagcaaaacaaagtggataaccacaataaaagttagctatagggcaccaacaattggaaattaattaatacatgccacttaaatcttgatctataccatatatagttacatatcaatgctaattacttggcatataattatctctttaatgtgcatatataataattgattcgtcatactcatacataaaggccccagaggcacatgctcatccagttaaattactccctccgtttcaaaatgtttgacaccgttgactttttagcacgtgtttgaccattcgtcttattcaaaaaattttgtgaaatatgtaaaactatatgtgtacatgaaagtatatttaacaatgaatcaaatgatatgaaaagaataaataattacttaaattttttgaataagacgaatggtcaaacacatactaaaaagtcaacagtgtcaaacattttgaaacggagggagtataataagatacgacataaatatatgacttagtagataaccggcttgcggatctttttctaacatgacaggtgccagctaagtatgtaagtactatagtatcataccgtgtctttctccatattttatcaaacagaacatggtcgcacaaatttggcataagagagaatattgctgctataattaaaaaagaaatattatcttgtaataagtatggaatagtagtatcacttaatagaatatggaatattctcctacagtaaacatgtaatatattctcttatataagaaaatattgacataaagtgcataagcatgttgtaatttcattacttaatgaaatcaaccccattatccaaaaaagcaaataatccttccgtttcataccatatataagacgttttgaatttctaaaattttaacttattaaagtttgacctaatttataggaaaaatattgtttatagcatcagattggttttattaaatttaacattgaatatattctctgatagtttccttatttatgttaaaaatataaaatgacttataaaaaattaaaataatttataatataaaacagatgtggtattatatccaagaaacactcacaaatcaatcaaatactactaggtgtactcctaacgtacaaacataaatgtacaagtacgcgtagttgtttaaaaattgagaagacgagggggtttactgcgagaaggcaaaacagaaggaaaaaaaaaacagcgaaactctactggagtcgcgagcagcgtactctcctccaacctccttcccacttctcaacctcgcctcgccatctccgcgccgcggcccagatccctccggcgagcgccgccgccgccaccgcctccgcca

SEQ ID NO: 33985 - DNA, 1501 bp, Oryza sativa
aatatttcaatctaaatgatttcatcatttctccattatacaatatatatctcgcagcaaagcgtgagacattatttagttcatatggtatgactgaaacaaaaagtaggagtagtatagttactaaaccaaaataataatccacaggtttcagtgttaatttaggtaagtatcactgtatcatcagccgctgttagtatctgacgagatgtcatcatcaaattcaaaagcaaaggggaacaacaaatacagtagaaaattaatcttttctccgacgaaaaaccaacccaaatcaagaaaaattcgtagcaaaatctccttgatgctaccactactactatttgccggtctaagctaagctttctctcagtcagtctacaattattattatactactatatcaaatccaagactgctttttgtctaatcttctttttctttggtcaaccaagggcatgggggccccactatatctttccattaggctaaagttataaaagaagcagcagcagctataactataaaatctccctccatttttagtctacctttcatagaggaacaacgaaagatcaagagagagagagagaggcgaaatcaaggcccttttcttttcttgcgatttccaccatcgccgcccaaagcaaaagattagataagcttaatccccacaaaattataaggattgttagacaggaggagtaatcgatcagagaggggagagggaagagagatcgatcgatgaagtcgccgttgctgaggctgaagggcttcggccaccaccagcagcacagggagaggaagtcgcggcagccgcagccgcagccgacgccggccaagctcgacgagctcgccgacgccgcccaggtgcgcgagtccatcgacttattgattaattgattgatttattgatttcttcctctcctcctcccatctatctcctgttttttttttttttttgggatttctgtgatcaaatcggcgtcaaaatcggatcttgggaggagccctatgcgaaattgcgatttttagccaccccccgcgttgttttccaggtggagtgcgctgttctttggttggtgcactcgtttattgattaggtgtggatgctcaaaatgattttactactagtagtattttggttattcaatgcggctggaggaacagagctcgaactgtttaaatagaaattgatccatcaattttcgtttttaattattttctgatggtcattggtggtcgtttagaataatcaaagctttgaacttgccccgtgttgattcaagcgtgcagaaggactaaacttttatttaatccaaaccagggtgtgaataaccgccggaaaccgcgcggttaccgcggttaccgcccgtaccgcgggggtacggttacccgtaccgcgcggtacggtttaataaaattcatccaaatttaaaaatttaaaaaaaaagaaaaaaatcaaaaaaaatagtgaaggtagtgcttgatttatagtgtttta

SEQ ID NO: 33986 - DNA, 1501 bp, Oryza sativa
catgtcactctggaagctacaagttgtgggtaagctcgaagtggaaatgattgttcaagctaatgttgaaacctgagagggcaatcttggtcactagcgtgctcagaaagagcagaatgtttgaagatatcatgccccttgtttttaacattcggtacttctaagcatttctctttggtacttcagatatatatggtgatttgttccatacatttctaatgtgcaaccaaaagttttcaaagctgttaggtgtcatgtcagattgtccttaaaaaatggatgttaagcacagtatacatcaagaaaataaagggggatttaatacgtgtgtctgtcaatgaggatcatccacaaagattcgatgagctttagatcccttcttttagaatcctttagcctctcattagacgtttttgaaaaatatcttgattcaaatgctttgagccggtttggattgggctcatgtagctctctgtttgactgtcaagcaataccagagccatttggattgttgagatctgtctatcaacaatgataacaacctaattaagagcaccaaaccacagacttccttgttgattcaaacaataccgcactttcgatgcaggtggacactgaatgcatgccagtgatgatcttgtttttttggtttaattctagtgtttatgagaggtgtaatagttgacagttcctctttgcctactctacagaagagccctaaattttgttctttcttgttctgactttttttcatagttttaaggatatactcaaggacaataaaacatagccggaggtatacctaaacagcaccctgattcttccattagattgctccaatcccttttcttttcacctttttttatcaataccaactccgttgattgcatttttaatctggcatgctagaaggtgccaagaacttgaactattttgccttacatgatagtagaataaacacaaaagtttgtctgcaagaaaataaatataccaaatcctaacagaaatgcttgcatagaaacaacgtttgttgaatatttaactgttgtaatgcttacctttgaattggagcctactgcaagtaacctctactgcggtggtttgttgtttctaacacgaagtggacagggtgaaaaaaaggctcagggatccaatacaaaagtgggccacttactagtggaaattgccaccagtctccatgacaactgacattatatattgccattcaaccaaatgaaaatggaggaccttggaacagtagattcccattgtcatgctgccactaatctgattgtgtcacttgtgcgattgatggagttcaccttccatcttatgcacctaatcttatattcaggtacatattaaaatattttcccatcagttagtacttagtggggtctcttaatcaccataacctgttgctgctctttctctctcctctcatcaggacaagtataaaaagcgaagcttttctcaactcccattcagacaagagagaagc

SEQ ID NO: 33987 - DNA, 411 bp, Oryza sativa
catcttaggtatcaaccccttctaataaaaattgctggaaacaaaatgtatgtgtgtccatattgtactagcgcatcacaaaaaatagattccaaccacaaacaaaaaagtttcatgagatgagtaactaacctgttaattttaacagctcaggtatcaaacatgactccccccatccgcttcagcctcactacctgtaaaccctagaacacaaatgtagatagggagctgaatcagtaagttgcaaagttggggtgcgagaagacataggaaatgggacttagaaattaagatgaatcagatacctgcagttttgagtctgctgcacgagaggggattgcgcgtgaaggatctcgccaccgatgcagcgccatcagcgtggggagaggggagaaatcagccagagcacga

SEQ ID NO: 33988 - DNA, 354 bp, Oryza sativa
ttagattatgagaatttaaaaaaaaatcgagtttcccagctctcgatctttaatttattttctagattctataactataactcatcaaaatcttaaaaaaaagctttttttttttgaaaacttcttattttaagagaaattgttagagagttttttattttaagaaaagctatagctgcagaagctccctgaacacacccaagaaaagagagaaagaaacaaccttgtgacacctgcttctgcttggcctttacctataaatccagagccccctctccacccttcgtcttgcccaaccaaaccaacaaaccagcagcaagaaaagaaaagaaaaaaaaggagaagacagtgaga

SEQ ID NO: 33989 - DNA, 1501 bp, Oryza sativa
taaatgttgtgtagaaaccatatctcatgcgagacatggtttcattatcttttctcatttatttatttgccacatcatttttcattttaggtagcagtttatttaatgttatggacactatcctagttattgggttggaaatggccttatatcatctttgatgaacattacaaacattgaatttcatctaaagtcgattagaatgactgtcgtgaaataggccaggccggtcgactcttggccatgccaaggtggccgtctcgacatggcttaagcgaattgaaggctagaaattcatatgatttctcttctaaaattatacgtgtgatgtgtagcatttctggaggtgactagggattggtcgcccgatccaaatcttcgaaaaatcggacgctgacgttagcacctgttttacgtgcaaaactattttaaactgatttttctcttaaattatttatctaaatcatgatccgattgcaccattaaattcgttgcaattaaatcttcaaaacaaggccacatatggatatattccgatgaaaaaaaatagcttattattgattttttttaaatgttgcacgatgtttcaccaggtatatcggaattgtttcactaagtagatcgaaaatgtttcacccgtttaaatctggtgttgtttcaccttatataaaaacaatgtttcagcaaatagcgaaagaatatttcagttcactataatatttgatccatacatagtgaaatattataagtacactaggtgaaatatttttcggtggaataaaaaataaaatgaaatcccttaatagggggtttccaaaatatgtgggtttttttggttgcaatggagtatttcagtttgtaacattagaactatacatagtgaaatattgtgaatacactagatgaaatatttttggtggaaaaaataaaacaaattcccttaataggaggtatccaaaggatttttttcaatggcaggtgaaagtagaggatgcggtgggacctagggcctgcattcacgcatgtggaggggggaggggcacgcgggggagcgccagatcgggctcccctgcgccagtcgcccggattaaagtaatttcgagcatttttagaaaaaaaaagcccgattgtgtggaatgcgccggtaataaacaaggtctcgtaatttctcctatcttcaacatttgctttgttacgtttttgactaactacattttctagaagagttttatggagtattacgaacgattacacataaaatcctataaaattttccaacgaaaatatttttttttcagaccttgtacaaacgcatacacatataaatatcttctccgtttccaggcttccagcccacaacctgacagccgcggcgagacaagtcaagattcaaaccaacccaacccaacccaaccgccgtcaccgacgacgaccaccaccaccatggcggccaaggcggcgttccccgcgccggccggcgacgagccggcgatcggcatcc

SEQ ID NO: 33990 - DNA, 1501 bp, Oryza sativa
taaccactcccagcaacctcaaacctcctagtgagagaaagaaacctcgctgcacaatctctccctcctagacagagaaaacctcttcttcttcagagttgagagagcaccaaagctggaagaaacggaacataacaagctcgcagctggtactagaagcaagtttcactcggagagcagaggagaggagaggagaggagaggagcaacagcagcagctagcgtgggcattggtgcgggagccgaaatcaaatccaaaagccgagacttttcaccacgcacccaaaccaaaccgcggcacgctgaccgggccagacattctctcccctttttcttttaccacctcctccgcttcgatccggagggtggagctagtgcttacattatcggttgatcactaaattttgatcctcatcagtattacggttttcgataaattttaatcgattttaataaatttcgattaaatttactgtttaatcttcgaaattctaatcaaaacttaattccgagccgtatcaaaatatcaaaatttcgtaaaattcgaccgatttttactgaaattatgaacttgggtagagcaggagcagcagcagcagcaaagggggtggctttagcggagagcgaccggagaggagagagcagctgagcaggggctcgtgttggtagccgtgcacgtacggtacccaacactgtttccaatctttctttttttcttttttacctctgtccctcctcaaagtgagaactatctcgatctcctcccctccacgctcactctgctgctgctactgctgcgagggtagcatagcagtaacttcttttttccataggagtgtttgctcggtgtatgtaggctgtggattgtggaaaagttgggggttaggagaaaattagtagtttgaaaaaaatttagtaatttatatgtgtagaaaagttttcgatgtgatgtgatatgagaaaagtcgagaatttaggaaattaaatagggccgtagtccagttttagtttcacccgctgtgaagaacactgcaaaaaatgcacgcattttgctctcttctggttcaaatatgagatttttaggtcctatttaaaccaaaatttcttagaaccggatatttctaactctataaatctatagttaccttaatacggagtaacatttagaaaattatttttatttctattttagaagaaatataaaattttaaaacgctatattataacacacaaactttaaatccaacgtgaattaagatctggagttatatcaaacaagattttagtttgcattcagtgcttaacgaatattatcaggaggcggttgcaacggtagtagtacttgttacagtcaaattttaattttaaaatatatttaaattgattttagctattttacaccacggtttattttctagacatttactttaattgataatagataaatatatctataaattattttttattcttttacttatttttcactgcttttcagccat

SEQ ID NO: 33991 - DNA, 1501 bp, Oryza sativa
acggggtcgtgctccttgagctcttgacagggcgcaaatcattggacaagtccaggccagtcagggagcagacattggcagactgggcattcccaatgctgatacagaagaagaaggttcttggcatagtagaccccaggctcgccgaggactacccggtgaaggcagtccagaagacggcgatgctggcctaccattgcctcaaccgcaaccccaaggctaggccgttgatgcgcgacattgtcgccaccttggagcctcttcagcagatggaggaggatcccagtatcagtttggttagtggcactgaagtgtgagagcttcatcttgttcagacttcagagaaacaaagatgccatatcaccatatgtttgatcatagtagctaattgagtgcttggtctgtatatagtaggtaattgagttttgctaagaaggtatatgtaatatagtatcattttaggtttgtttgtgtatctaatgtttgacatgggaagtggttttttacccttcgaggagatgtcctcttatcttatgtacctttaccttttataaactaggtgaaaccccgcgcattgctgcgggaatttagtatgataacaaaaaaaataacgtgtaagatagctagataacatcagattaagtaaattaatatggtttatgataatttaaatttaaatagtatgtaaatggtgattgaaacgtaaaaagtaaggtggtatgattttatggaagaaaaaaagtagggagatagtttggactgtagattaatcatctaaaggctaaaaccaattgatgtgatatgacttaattagaggaaaaaaggagaaagataatttggaccatagattaatcatttaagcactaactaagtgaggatgaactatataagtatataagatatacattaaaacattatgtgaattatgttggatgataatttaacatgtttatatttgaaaagctcttaaattataataactataaaaatatagcatgtttgcataatgtttaaatgtgatgatttgttagtggatgatgatgtatcatcttgttaattagtggatgatgatgtgccatcttgttagtgaatgatgatgtgacatctttgcatgttaagtttaaggagttagtgggggataactttatagtaagataggatacaatacaaattgttattaaaatttattaaaatttgacaatataacttatattgacataacctccataaaaaatgaagtccgaacttcatacacaaagccagaaataaaaacgacagatatgatagtgaatagggcaagcacttttcatagtatatatttaatctttttttttcatggtgtgtaaaatcacttttccatttgatgcgccaatttttcagaatgtgtttgacaggccatatataatgtgtttgacactatatagttgttgacaatgctgctcagggaatgttttgctttacaattgacaaacggcatcaagcaaaggcatttcacacatta

SEQ ID NO: 33992 - DNA, 1501 bp, Oryza sativa
ctatagaaacagaagaaaatggtttgtatatgaaatccaatcctatttttaatatttattgttacaaaatataattccataaatgtaaataggatctaagagttttataacaaatccaattttaactaactgcgctgggaaatcttgtcgttcaagcaatcaaaagatctatcctaagagcacatgaggaagaaaaaagatgtgctctcatcgcttggagcttgttgccgtaactaattaaaatttaaatccaaacttaattttaaatgattctagactatttttcatcattttctcttttcttcagccttggtttttttaccactaagaaaatgaatatacaaaatcctaccctaaaatcattttccgttgcattgtttattttttttgtcaaccgaagccaacaatcttttctttacttatagcttgtctggggagaaaatgggaaatctgtccatgttgaataaaacaatataatacaatagttccttcatccacaaatataaaaagtatttctagatacttttcggagagactaaggaaaatgaaaaaaaaaatgttgatgctccacattaaatgagggttatacggttggtgatgggagagtgattggtgagacaaatactgtgcttcctcttgcttgaaatatttctgaccatgttccctatgctgttaaaattgatacaagaattccaaagtacccaatctttagatttgaaaacattggggttgaaatggagggattttctgatcttgtcagcagggttttgtctgtggatcctggttttgataatccagctaagtgcatcagttttaagctaaaatttttaaggaaaagtctgttgaagtggagtaaaaatttgtcaaagttaactactcttctagttaactgtaataatgtgttgaactttttggacttgatagaggaacaaaggcccttgggtatatattaatggaatttcaaagagattatcaagttgcagacgataaagcttctagaattcaagaagctatactggaaaaaaaaagatgtacaaacagatggatgttgttaggagaggagaacactaaattcttccagtctattgccacaaaaagatttagattgaattccatctctcagatttatgatcaatctggtcaagtggtttctttgcatgaccaaaaggcaagtcttttcttccaaagctttaagaacagaatggggatctcttcttctccctcaatggcctttaatcccttatccaattaatttggattgtctggtagatcagttctctacccaagaggttgacaacttaattaagataattcccctagagaaggcccctggttcagatgggtttaatgggttctttctaaagaaatattagcctatcatttctcaagatttctacaggctggcagcccatttccatgcttttttctactgatttgcagcctcttaacagctcttacattactttagtgcctaagaaaatccttccagaaactgtgaatg

SEQ ID NO: 33993 - DNA, 1501 bp, Oryza sativa
ttttttacggactacggaactttttttctagcgcgttttcttttgcgatttttttctgacattttttccttcacgcgttttttaaaccgtttttattttctcgcgcattttttattttttaatatatggtagaaacttctctttttaaatagttatattagattagattagagataaagaagagatataaacggactactaaaatgataaatataaattagactttttttcaccgcgcttttttccgcccttttttttatcgtgcatttttttacgaatggttttttttcaccactttattatagtgtcggacctttctaggtataataggattcgattttttttaccgcgtcacatataattcctttttctttggaatcggacagttttttttaaaaaaaaatgctttttttactgattcgtttcgtttttttgccccgtattatttttggatcggatagatttgtttttttttgtcctttttttcgctcttttttttggatcggacatttttttctcctttttttttgatcagacgtttttttatatgtgtttttttgctcggttttttttgcccggttcatattttttggatcggacatcttttttttggatcggacatttttttttctcccggttttttcgctcggttttttcgctcagtttttttgacggacgatggaagcacctcttattttttaagtagtagagattaggtttttttggaaccagcccagttgagatcaacacttgcatttacggttaattattctttcattggtagtttggtagacgacatactcgtcgatagtgaggtatccgtggagacttcatcaatctcgagatatgatggtccagtctttcgaaggtgtttataaggataggatgtgtgtatgtacgtctccacatgggtgagcgtacacatgttgtgggcacttgtatttgtgttgtgttttctagaagaaaagtacttattgttttagctttgtcacgagtcaaacattactaatgtttaccatcaattcttagaagtttgtatagtttaatattgtaaaatttatgtttttagattaactatgagaaatatatttgtaaccatgagttattcacatgttaattttttttaggaatcgattgttaaagttagaaaaatttgacttaaaaaaaagggtgaatagctaatacggtcctgaagcgaacaatttagtccatgaggttttaaatcgtctgaacaagtcatccaaattaattatttaggttaacataatccttcgacccacaaaatatgccacgtaagtatgccaagtcattctcccatgaaactgtgtgaaatggctattcaccctaaaaaacaactaaaacgtaaagtagtatgaaaaaggagtaatctgcaccactgatgagctttaatatctgtgctgacgtactaagtactagagtaactttttaatctgcaacactgatcagctttaatatccgtgcagttttttttttcccagtg

SEQ ID NO: 33994 - DNA, 310 bp, Oryza sativa
ttaatctgatattttagagcaactttcatatagaaagttttcacacgaaacataccgtttagcagtttgaaaagcgtgccacgagtataaaaagtttatctccatgttgttggagaaacgaacaagaccatactaatcttttgtggtacatgcattgagattgtcaagtacttgtacagaggccgtgtttacccctaacttctaattttccatcacatcatatcatattcaaaaattttctacacacataaactttaaactttttttttccaaacttccaactttcctcgaacttccaacttttttcaga

SEQ ID NO: 33995 - DNA, 1501 bp, Oryza sativa
cttttctttgatattttgtaggtgaaggctactctcatgagtaatagattttgagatgttaatctgttaattagcatgacaatgatatcatactattttgatgatatgccaactgtgagttgctgcaagcagcattcgaacctaaacaaaatatcccctagatgtcacaccaaagtatgctcactctagtcaattaacttctttcacaccagccacagacgaatctgtcagcaccctcaaggtgcaaatagtcatacaaaatccaaagacaatccgaatttatacatcctagcagccggtgtcgacataattaggactagcacaaaatggacagccaagaagaagtgcaacaccagctggagctcacacaatccaatcacctagaatttagccttatttaagcactggtgagatcaaaattgggcaacctaatagcgcactacccacaaacatacagagctcagcaccactactctcacaggcaatcagtcgaacacttggcgggcgcattaagattaatctcaagcagacagcccacaccgatccaaatagaagtatatattgtttggtcacaccgacatgcttatttgttcactaatgtcgtggtttagcattcgatcaaacgagaaactgttcctatacaatgcaacaagcaattcacatttcacattgtgttgctgagccccaaggggacatggacacctcccctagtcagagaactccaaagactaatctaatagagtgacaggatcaccaacctaatctagtagataattcaagatgtaactatatgatgcacatgtaggaacagcctaactgtaactgcctctagtggcctagtgggtgcaggccccattgtgctgtatctggagccacatttcttgatcataaactaaggcaaagattaggctaacctgggcatgacaattgtctggacatgaagaagaggatggagggagacagtgacacccccaaattggacaaagagcagatgttttgtacctaatgggatgaggaggaaaggagcagaactcatcaaatggtggtgctagttggtgatggctttggtgggtgttgggcttggaagattggcactggtccaggtctctctctctctctctctctcatcctcatgcccagccagaacagcggccaagtccaagaaaaatttccactagaacacaaactcttgcggcgattgcaacctctcctctcccccctggagaaaaaagtctttttttggggattgcaaacctggcactgtgattcagacatccacttggccctccatcaacaaaggttaatcatcaccaggaaaagaaaggaagaaagaaagaaagcgaatgctgctactgctactaccacaaggaggggtgaaaaaggagggatttttattcttctagcagcaaagaaatggggattagtgcagtcataagtcttacctgtggccgcagttactgagtaggagtagtgattagtgggtggtgatgggcaccactag

SEQ ID NO: 33996 - DNA, 1501 bp, Oryza sativa
tagagacatgtgtgatgatgatgatgtaactgggtttctttctttctgttgtcgtttttttttctgaatgttgtttgtgatgtaataggatctttgtccattgaaaccatgtccattatcatgatgagaatatgaacccagtgtcttttgaatgaattccatgacatcgatcatgcagacacacacagcttgatgcacaataaagaagcttatgcacaagagattcagcctcttctgaatccaacaatgattttgtcactgatcagcgggcaggcagtctggtccttgatccaacacaattgaattctctggcctcttattatttatgcaaactgttttttgcagacagtgaggaagccattgccagctgaatcatgcctatgtgcaacgctgaggtgatagatactagattcatactagatttgatttgctcatatgcacatctggctaatacattacacaaatgaagagattagttagggatttggttggattggattggattggattggctgcttccctgtgctggttcagtgatccctgtcccccaacctggcaaagcaggatgcagacatgcaggttggagcagttgttgcctcctgccatcagcctcccggaccaaatccagatttgaaatgcagcattaacttatgctcaaaatcagtagaaaaatcatgttcggtcataaatatttcacgttttaaataagattcggtcaaacatttttaaaactttaaccatcaataacttttcaagtacgtacttagtttaaatagtttaaaaactaaaaaaaatggtatttcaagatttttcttaaaagttagtacactatcatagtagtaccataaacttattcctttctctttcttttcttttgaaatcatatacttattattcttctgtaagattgaccgagttttgttttaaacattaaatatttatgaccagacggagtattttctttttctcttagatcccattagcaacgtgccaatgttagctcgagagatattcgataagaaaaagaatcaatgctaaatttctagtaagcttataagtttattatcactcgtcaacttcaggatgtgttcagaaggcaaggtttcccctcttgacacggaatcaaagcaagcgatcagagcgagattaattaagtattattgaaaaatggattaatataattttttaagtaaattttctatagaaaacttttaaaaaaatatatatcgtttagcagcttaaaaaatgtgcgcgtggaaaatgatggatgtcagttaggaaagaagggggaagagcacagggagggcctctcaccgttctccatccatgcgaactctcgcaattacgttttccgcctttagagtcctgttacgtaaaaccgaaaaaccgccttcacgctacccagtacagtgagctcccctctccctctctcactctaccaaactgcagaggagaggagaatggcgatcgctctccgattagcggccgcgccgctccgcct

SEQ ID NO: 33997 - DNA, 171 bp, Oryza sativa
tcctctccttttccacacgcacgcttttaaaactgctaaattgtacatttttaaaaaaagtttttatacgaatgttgcttaaaaaattatatttgtccttttttttaaaaaaaaagaaaatatttaattaatcacacgttaatggccggcttcgttttccgtgcgcacagc

SEQ ID NO: 33998 - DNA, 1501 bp, Oryza sativa
tggaaatcaaaaaggtgtagaaccggcatcttttaggttcgtagaataaaaaaaagccggctcgatgcatcggctccatcgatcgagccgacgcatcgagccgagcagtcccccctcccacatccgcaacaaaaattttttggcaacattcatctcacaaaataaatcactgaatcacatttgaatcagtgaatcaaacatttgaatcatgcaacattcatctcataaacaaatctggcaatattcatctcacatcaaacatcattgaatcactgaatcaaacatttgaatcaggcagccgcaagcgaaggagacggttgggggtgctcaccgtcgcctgtgaggggcccgccgccgtcgttgccgctgcctaccccccgccgtatctggcggaggggagggctccaccgccgccgctgcctcctctcccgccggatctggcggaggggaggtcgctgctgctgccgcccatgagccatgccacttgccgccgcagccacctccccttctaccgccgccgccgccgcctcccctcccgccggatctggcggaggggagggcgcggtcgccgctaccgcctccgccagctagtcgctagcagtgcgggggagagagaagagagcgagacgagaagaagagagcgtgacgagagagaagggagagagcgagacgatcgaaccttatccaatgctcgtctcgtcgtggtggggcgcaccggtcggctcatccgatgccggccagctcggctcgatttacataggtgttggttttttttaaaaaaaacagcacctataatatattataggtgtcagtttttaattaatcgacacctataatatattaaatgtgctgttttttagaaaaccgacacaaagtataatagatgctgatttttattttagaaccgacacctataattacttaaaggtgcctttttttttgcgatttcaacctacaaaggtgggaaaaagcctatagatgccggttttagcactaccggcacctatagtgacgacatctatttgattttttttgtaatgtcccatttctcgtcggcactcggcagtgtcaccggcgagctccaagcccactcggatcttggcctggaagcgcgggttggggggaagaatggggaggatttcggaggagcagcagagaggggaccgcatcgcactttctttttcgggcgtgagaaacccagaccctagctatatgaggggcaaaaccttgcaaggcacgggacccacctcctttctcctccacgtcggtcggtgttcagcaacgaggtaactcaccacatcgtggcactgtgaaaggccttagcagtttagcacgtggcatttatatcaaacatgcatgtactactcccttcggacggaaataaatgacgtttcagacagcaaaacgaacttacacttggcatcatttcattgttggaaatgataaataatagtgacgggagggagtaataaattactagttgttattcgttaattgaaac

SEQ ID NO: 33999 - DNA, 1501 bp, Oryza sativa
cagttatcctacatattgctaatagattatatgcaggttttcctcaatgccgtgttatatttaagctaaagtccatatatcgtcctaaactttagtatacttggaaagctgaaatagaataaaattgaccaatgagctaaagcaactgacaaatctgttggctaaagacagtttttacatatgtccacaaggtaccagtagataagcatctgtttttgtgagaccatccaaagattagaaacagaaggcaacttttggctactgggtgcagtaggcagccttacacgtgtacacctccctgcaggttcttcgtatcaattagaaaaaaaacatctttctttttggcccttttgatccatctaagcttcaagagacatgtctgccaggtcatttgttctttcattaggtgcaacagtttttgtttcagcatggcggcacaacactgcataaaaaaattataaaaacaataatatacagaatatcacagatttttacattttagaatttttgtgaatgattaggtggagcagttttttgtttcaaacatggcagcacaacactgcataaaaacaaatttataaaaaaaaacaataacatgaaaataatataaagacagctttttacattttagaattttgtaaattattaggtgcaaaggcggagccaaaaacactttaaaaattttttgattgaagaaggccaaagtgttacttttttgaaaatttgcgaaacctattgccgtaaaaattcgaagccatttgggagaccaagcccctcctcgcctcctgccgtctctaccccggtgcaacagtttttgtttcaacattgcagcaaaacactgcataaaagaagtaaatacgcagaatatcacagctttttacaattatgaatcttgtaaaaaaaattataaagcaaggaaatagaacaacactgtttccaattaaaacacctcccgtatagcccttgtactatcttgtcagatttgtctgtttcacgtctgcaacgaacagaaagatgcaattaccaaaaaccaaagtgttaaacaacctaaaaaaagtcgtcctttttttttctgcaattaaacccagagatgttttgtagctagcgtgacacaaactgaacaagctggccatgcatgtatatctctattaaaaaaaacatagtgtcatcatagtcatatcataggctaatcttgtaatgttaaccttatttttgtcagaccaaaaaaaaagctaattaaccttgtaagtattagtccttttttaagaaaaagttaagcaagttttggtttaactaattaaattaattaattaggtataaatgtaattaagcacatcggctcaaggctgcttctttctcctctcctataagaagcagcagcaatggcgtctctactcggactcctcttctcttctcttctcttctcagagcgctgcgaggcaaggaggcgagcaagaagcggcggcgaggttgccatggacgaggcggaggcggcggcggc

SEQ ID NO: 34000 - DNA, 571 bp, Oryza sativa
agtaaatagctggtttggagtatgtctgttgttcacagtaggctagccatgaattcagattagaccttactagtaaaattttggatttctagaagatcctgtgcaacttgctgtgtaccctattttcgtagtgcataatcattttttctgcgatggatacaatacggaaaatttagccttaaaggacctttaggactaaaagttctacctgaaagacctatacagattagacattatgtggtagaggcctttggtttatttccacccatcatattagacatggtaacaggcaatatgtgctaactggtaacatatgtaactgtaatcacaacatttgggacttgagagtgcttatgctttgttcaagttcaaagagaagccctttcaaacagggaaattacatgaactttttacaatagcttgttagtgacagttgtccttagtaatcaactttttctttgttccctttcttaccacataatggtctgattaccagtttgttcaccctgttaagcatataacatgtatgatcaacatatgaaccatttgttaacggtttggtcatttcaga

SEQ ID NO: 34001 - DNA, 446 bp, Oryza sativa
tttttttttaaaaaaaaataatacaaggttgtatcaggacagctaatactggtctagacattagcaagccaatacacctagtcaatcttatcacatggcatatttgcccaagcaacagataataatgagaaatgttcagcgctctccgatccatcagtttgggcaagatataacaatggtcctgctgattcacctgctatcaggctatggcattcctgggttaatagtactgttacactgaacagaaatagatgacttctaattatcatttagttggaaataaaagctccggttaagcgggccttcgaagagtcagtatataaagctgctgagcttcctgccataaaaccccttaattttcttcatgcatttatccaactaacatgaactatatatgcaacaagtgcttgcacacaaacactacactgtccatgtaagaagtttga

SEQ ID NO: 34002 - DNA, 1501 bp, Oryza sativa
cctagggaatgtatatcacataggaatgcacaaatttgagttatacttttcagagcattaaaattagagggaccatggtacatttaggtggtgtttaaatctccttaacataaagatgaatataaagattaaatatttcacgcaaaataaggaggtaataacgtgtgattaattgagttttaattattacaaacttgaaaaatggattaatatgatattttagaacaactttcatatagaaagttttcgcacgaaatgcaccgtttagcagtttgaaaagcgtgccacttttatccaaaagtttatccacttttttcagtaaattaatctgcagtgtggtgtgtggatgaagtatgatgtcatgttatcatactgtttttatcatgtatttcctatatgcatcgaatttcattgaaaatgataatttatatgtatattgtagattaatcaaagataaagataatgtatgtgtacttgcttgaacagaaagatatgcaacttaggtcaaaataggtggtccaatgtacaattcactctagaaataattatacgatagtactgcaggtgctttttctgatcaacacggactcatctaaatatttgaggcattaatggagtcgccaaccatcttgatagaaaactctaaagcaagatgggttttgaagattaaacctgctaccggagccgatttagagatgtaaaccggtctctaggttgatttaggtcaatatggagttaatcacccatctcatgggtgaatcggaaggtttacgagacaaacctacaaaggttatcgtactctcgtagcgaaggcaggcgatttatgatgaaaatcgagaaaaatagatgaaactaggataaagtaaaagacatgactgaaagtaagtaatgtaaaagaatgattcgatagggtaggtttgaattgaattggccatagcccttataaagagatcggtcttgccttctacatgatcctctccatgtcttactcgggggatagactaattagaactcgaataataccttaccaagtaaggaaacctaagacccgataaaattgaactcggagtcggactcagccggtctaaccgaccatatgctgccggtatgaccaacactatgccggcggttagaccggccccgtgaaggaaaccgtgacatttccaaatttggctatatttttctattttcgttcttggtgtctgttgggtgttaacaagtacttcaaaaataaataatgtggctaattgtacataaaagtctagctaattcttgtaaactatattgtttaatatttcatatgctgtaaattttaaaaaattctcatacatttaactaaaggtctttatttttgtttcgttccgagactccaaattgtgaggatcggctacttgctccttgggttgggtgagtgtatagtagtccttgggttgggttttgtggacccatagctaagtatggtacaaattgagcagtatgtttgaaataaatgttcagaaac

SEQ ID NO: 34003 - DNA, 1501 bp, Oryza sativa
tcaaacaccgttccaacatcacaagtaaatctaaatgaaggaatcctgtgagaaaacatgagcagattatgaatgtggacttgtaataactgctctctcccactcctcacgtgcctctggaaaacgcttctatatccatctacctttaccaattgtgcgacagtgcagcctgagccttttaaataactgttaagaatttctacaacataaaaggtgcttttcttccgcatcccagggtcattgcaccacccaatgtcccaatcactgtagattgcccatacctccccttcctggggataaactttaagatgatgattccaattgtcagaagatatctgatgacataacatagttggacaagttaccgatattttacattcatccgcaataaaaattccacaaacaaatggcaagcttgcactaaaccacctgttctcgtcatgggattgtggggatggtttgaaccatgaaacatataagtgctctttgtcagccacaatcttgttaatccgtgcatatctgcgagggaacttctcccagtcatatgctgcccaaatctgaccagcagcgaaattcactatctccctatcattctcaaagttatgaacgtcatattgtgtaatagagcaaagctcgtcttctctgttatccaatggatcagtaaacctgtcatccaaatctacatgtggcgatgacacacaatgcacatccttttcgcacacactcttttgcttcttgtcaacatggttctcatcaggtaactgaaaaccatcatcagctagaaagcatgaatcagtcctcttagttttggaagagctagcaacatttgaacaatcgcccacatccaaacatgatctgtcagtctgttgagcatatgaaggcacattgtttgagatgccagccaccgcattacagtctgcctcaaggctgcttaatctacccagttctgcattcggataatcatgagttgatctatcagcagcgcaaatccctttcgtttgtaaaatgtcttcgcaccacagctcaacatttgccaccgtagaatcataccgcaccttcttcgccggatcagacagcacggcgtacgcatcgttgacgagccggagggcagcctcggcgccgggcaggtcgtccctgaccggctccacctggcgcacgatgctcctgtactgcgcgtcgatcttggcagcgtcgtcgcgggggaggacctggaggatcctgtaccaatccacgccgcgcccgcggccgaggccggggcggcgcgcccgcgtctcggcggcggcgcagaggacctcgagcacggagagcatctcgaaggcgtcgtccagcctagggttggtctggagcgtctcgagcagcagcgtcctcgcgccggcgtagtcctccccgcgcatcttcgccgcgatcgcctccctccccgccgccgcctcggcgtcgccgcccatcccctccccgccgccgccgcctcagaatcctccgcgagcacaccacctgtgagacg

SEQ ID NO: 34004 - DNA, 1501 bp, Oryza sativa
aatccgagaaaactccagagagtataattaaccatggagaatttaataaaaattaaatccatccatgctttatatttaggaaattttatttcccacatttaacttcactagtaaattaatgaacgtttaatataaattctattaataatttattaaataatttataaatcctgaaacgaaaatcaggatgtgacagtttggttaaatattgaagcctaaaggtaaatattcattatttctcgcttcgtttaactcttggttgttgatttgaattgtcgtgtgctgcacgtatgcatgtaaaatacgctatgggtgttgtttttagggataattctttttatctcttttgtgtctattgttggatgaaatgctaaatttgcgttaatgttttcttcgatctacgtcatggccattagtcaaattaatgcttgtcaaactatgttaaggccacgaaaatatccattgatagtttgatttatctcaaatttatgttaagggtgcccatcgatccgctagaggaggtggaagcggttttgcttgatttttcttgggttttggttgaagattaaagcctacaaggtaaatattcagaatttctcaccccgattcacacccgctcgttgaattgaactgccatgcagtaatacatgtaaaatgcactagtcattaatttgtatggatccataagtcattcgtagatctgttctcgggtgttatgctaaatttgaattaatggtttattccatctatgccatcgtcattaatgtttcacattagccaaatattatttcggattgacaaaaaatagaatttttttaatatttttgttagccatgactatctaattaaggtgacgtgggtgtgtgcaaaaacctctattttgtcgtagggtaaaatggtcattcctagttgtttttattctaatgtgcttgtaaatgatgaaatcttcattgtttttttccttcatggtttgtaataaatgataataaccgcaggtacccactggatataatggatctagaatggataactatagcggatcgtgactctgtggagtatttcaggggagtaacggctctcgttgccacgtccaccagcacaaacttagtcgatgcaccagaatatatttggtgtccatgccatgattgtaagaaagacagacaacttccagctcagcgggtccattcacatatccttacaaggggttttatggacaatttccttagcgaggagaatcaaggtgagggaagtgctggcaactgtcatgggcatgatgcggatgtaggctacgaggaggaggaggaccaaacatgtgtcgatcacggtgaacctaatctagatcagatgttgcgcgacggggagagatttgacactgatgatagggaatatcacaagttcacaaccatggtgaaggactccaaaactccaatttacaatggatgtaaggcagagcacagcaagctccaagtggtcctatcgctgcttcacttgaaggcgagca

SEQ ID NO: 34005 - DNA, 920 bp, Oryza sativa
ccccccgaccctcacgcttagactccgttcttttcttttatcttaattttcattagtattcttttaaactgttaaataacatatttcgtatgaaaacttttttatatataaaggttaccttaaaatatcagataagtctaggtttttcaagtttttaatagttaaaatttaattaatctgtattgttttttctaatactgattgtaatcttataattttcttgttatactaatatatcgccctatatagtaccggttctttttcgataagaaaaagacaaagggggaggtggtaaaggaggtgagagagcaggaaaggtgagacagcgttgttctcatctgtgtctctgggaagggaggaataaagtggtcatgatgcatgtggtactcatctcctacttgtgcattggagagggagagagagtgtgtgtgatgagaggagctagacaagggaaccttttgctgggtttggcagaagggggaatctgtgcaggaggggggccaaggacagtgttttggggctgtatgcccagcccccagctgagctgcaccacctacaactgcagctgccttgctagctaacaaagcctatgcacagcagggacagcatgcaacaccaaaacactccatacgagagagagcgatagagggagatagagaggggagggagtgttaaatagcattagtagcattgctaattaggctaagagcatctccaacagcttctccaaatcccactctccaaatacccatatagccaactctccatctgatttgactagttaaactcgttgcttgctccatcagtctctttatctaccatctccattataaatctatgacaaatgggacccacatgtcagcctatgctattcctaccccctacttttcccctttctcttttctcaccatttttctaga

SEQ ID NO: 34006 - DNA, 1501 bp, Oryza sativa
aatgcgtgcattttttgcagtgttcttcacagcgggtgaaactaaaactggactacggccctatttaatttcctaaattctcgacttttctcatatcacatcacatcgaaaacttttctacacatataaattactaaatttttttcaaactactaattttctcctaacccccaacttttccacaatccacagcctacatacaccgagcaaacactcctatggaaaaaagaagttactgctatgctaccctcgcagcagtagcagcagcagagtgagcgtggaggggaggagatcgagatagttctcactttgaggagggacagaggtaaaaaagaaaaaaagaaagattggaaacagtgttgggtaccgtacgtgcacggctaccaacacgagcccctgctcagctgctctctcctctccggtcgctctccgctaaagccaccccctttgctgctgctgctgctcctgctctacccaagttcataatttcagtaaaaatcggtcgaattttacgaaattttgatattttgatacggctcggaattaagttttgattagaatttcgaagattaaacagtaaatttaatcgaaatttattaaaatcgattaaaatttatcgaaaaccgtaatactgatgaggatcaaaatttagtgatcaaccgataatgtaagcactagctccaccctccggatcgaagcggaggaggtggtaaaagaaaaaggggagagaatgtctggcccggtcagcgtgccgcggtttggtttgggtgcgtggtgaaaagtctcggcttttggatttgatttcggctcccgcaccaatgcccacgctagctgctgctgttgctcctctcctctcctctcctctcctctgctctccgagtgaaacttgcttctagtaccagctgcgagcttgttatgttccgtttcttccagctttggtgctctctcaactctgaagaagaagaggttttctctgtctaggagggagagattgtgcagcgaggtttctttctctcactaggaggtttgaggttgctgggagtggttacgaagctaattaggagctttgccgctttggttgagtttcttggtgagaggtgaggagagcgtgagcgagctcgctctcagtctcacgccttttgtgttgtgttgtggaggaggagaaaggaggcggttttttgttgtttctgtcagcgttttctcgtcaggtacagcctactatacttctttcgagttcatataccgtgctgctctcgaattcggaagcccttttttttctgctatcttgcgaagctcctgtgtgcaaagtcgaaaaagtttgccgaagatgaagtcttgctgaagctgccctgctttgcagctgcagtttcttgtcagtttccatggatgagtagcatgaacaagacgcgagcagaaaatggcatcttcaaccagtggaggaactcgagctcacccatttgatcctgttccttgagcattctatctcccaaaggagcaatcg

SEQ ID NO: 34007 - DNA, 443 bp, Oryza sativa
tcggcaatggtaactcggctgtcaacaatgagcggtctcttcaagactgccacattacttgagtagcacacgaatctggacatggcgattcgtttcatctggagatatggtaacgtcgcttcggtcggcgagcgtaattagcgcgcgcacgatatgatctatctcgactgccacaaccgcatatccacctcatgcgccgcaagcgggcgaataggattagtggaagcgtgggtgcgagaaacgagggggcgaaatagagggcgcgagaagcgaggagccgggcacagcgttggcaagagtataaaggcactgaagatggaatctgtttccttcctttcgccattattccccttgttttcgccgcttgcgccctaactccttctttcctgtgccctaccttcgccacacgcgctcgctcttaatcttctcttcctccggcgcca

SEQ ID NO: 34008 - DNA, 1501 bp, Oryza sativa
gtcaaacggtggttagctagcgtatacattactagtatgtacgtgcatacatgtctcggcgtacatacgtacgtcgtcgtcgcaagtgcagcgccgccacacacagtgtgaactaacctacgtaagagctgacctggatgcatgggtttctgtgacgcaacacgtgtcttgtctgtgtgccagttgtcaaaatcaaccttaagggtgtgtcctgtcgtatcggaagagaaagtatatactacggccctgtttagttcacactaaacttccctcaaactcctaacttttcatcacatcacatcacatccaaaactttcctacttacataaacttcccacttttttttccaatctaccaactttctccaaacttctcccaatttcagaaactaaaacacaacctacgtatcatattggaggttttagatatatagtctatagttcaaggtggcccttcatcatatatctggtgacggagaggcacaaagttcaaggttaattaagctaataagagcttaaatattttcacaaattacaaagtatttttcaagattataatggggattatgaagctaggtgtggggcccaagctatagctgccccatgcatgtttctgcccctgattatattgttaaatgtgccacttaggttaaagctactgtacatggcattccttctcaatgcacagtggtttgaaggggaaaaaaaccaccatgatgatttatggaagagaactactggcataaccactactacacaaactagataggtattggttgggaacctagcatagatgtcaaattttccaaccggcacaaaggtgctggctccaaaaccggcacctttgaggtccaaaaatacaaacaaagaaaaaagctcgtagctgccgtcttcaccccaaaaaaagcggctcaatgcatcggctcaaagcatcgagcagctccccttcacccgatatcacccaacatttaattcatagaattaatcggcatcaagaactacccaaagaacatcaactcaaacacaaaacacaaagaacatggagaggatggatgacggcctccatggagaggatggagcagcagacgagcagcacatcgggtcccatcttgcatagctcgtcggcggtggcgaagaagcagatcccacagcacgtccgaaggcgccacccgccaccgccgcctcccctcccgccgtcgcccacaatcgcacgtcgctattgtcgcctcccctcccaacggatctggcagaggggaggggcgccgcctgcctcccaccgtcacctcccctcccgacagatctggcggaggggagggcttcacccgccaccacacgccactgcgcctgagagagagagagagagagagaaagagagagagagagagatgggagaggatgcggtggagaggataaggacatacaagagataaggaggagaggatatggatgacaaggtgcggtgtggtgcggttcgactccgctcaatataggggtgtcggttc

SEQ ID NO: 34009 - DNA, 1501 bp, Oryza sativa
aaccagctataaacatattttaaaaaggtaaagagagagaagtagtatcacggactccaatacgtaatgtgtgtatgataggtgggaccggatattaatagtatagtaagcaactattatatgaattggctataaataatttagagctaatagttggctatactattaaacttgttcttgcttttagtactagtgctctgttttaacaccactgctgccaatagttttactgataccgattcttcatgtctcagtagccatcaataccagcggcttgacaaaatttaactctacaaagataaaacgcaccttcaataatgcggtagagtggagttttccatcatggttgtacacacgaatcctggtgcagtaactctgtgtttaagcgcgcaatactacaactaattaagaagtcttttgagctactccaccggacaattatcgtggactaattttttgatgcctccatttattataaaagtactatttctattgtagtactgcttagggctaaacacactttaaccgtttatcgctttatcaaattttaaaagttctataagttttttctcttaaaactataataaaatttggcaaaaggcatgaaagtaaacaaaaccaacactaaaatgtgcttaaattttcgtatggttgattcggtgaacaagtccttgttaacttgatctcagcatactagtatcacttatctcctcctgtggcatacatgttagggtgacacaccactgcttgcccgtgtgttacgcaacagagaagagagacaagatagtagtaaaagaaaaagaaaatatcctatatactccagcaaggggagcagcgtgtgtgcacgtagcacgcacagcagtaggtgcgcgaagcaatggggcatcgtccaagccaaaaaaaaaagaaaaaaaaagaaaaaaagaaaagctgtccgtaggtgagggtgtgaggcgagagacggtgctgcatccaccaccccgctgcgcccgctgccgctgcagcctggtcagccagccagacagcccgcacccacgcggacagggcccaccacgaaccaaaccggcccggttcggttcacagccacacgccgcggcccggtttatttctcttgatttatttaattggtttaacttctttttaatactaatgttttagcgtgtggttttttggtgtactccctacaaagagaccaccaccaatccggctaccccatcccccctcctctttctctcctcttctcctctccacaaaaacatttctactgcttgctcgtctagtattccccacctccctttccttgccttcctcgctgcctcctcctcttcctcctccgtctccgctagggtttccgcgccgccgccgccccgatccgagatgccgccggccgccatggctccccctcccccgccgcagggctcctccacaggtacgcgcgcgcgcgacccgccccgcgcggtcagatctggtcaacacagctctcctcgcttgcgagcttcgt

SEQ ID NO: 34010 - DNA, 232 bp, Oryza sativa
ttttttaagtaagacaacataatccaaaattccaaaatctagagtagattaacagtgtgagcaccagctcaatcgatggtgatagtgagatccccacaattgggtccggaaagcactaaaaacagcgattgtcacataataagttacctaatggaagtaatgttagcaggtatcccttcatttgatatgatcacaacaaaacaaaagcttaagatcatggagcatattttta

SEQ ID NO: 34011 - DNA, 1501 bp, Oryza sativa
aaaaaaatcctttggatacctcctattaagggaatttgttttattttttccaccaaaaatatttcatctagtgtattcacaatatttcactatgtatagttctaatgttacaaactgaaatactccattgcaaccaaaaaaacccacatattttggaaaccccctattaagggatttcattttattttttattccaccgaaaaatatttcacctagtgtacttataatatttcactatgtatggatcaaatattatagtgaactgaaatattctttcgctatttgctgaaacattgtttttatataaggtgaaacaacaccagatttaaacgggtgaaacattttcgatctacttagtgaaacaattccgatatacctggtgaaacatcgtgcaacatttaaaaaaaatcaataataagctattttttttcatcggaatatatccatatgtggccttgttttgaagatttaattgcaacgaatttaatggtgcaatcggatcatgatttagataaataatttaagagaaaaatcagtttaaaatagttttgcacgtaaaacaggtgctaacgtcagcgtccgatttttcgaagatttggatcgggcgaccaatccctagtcacctccagaaatgctacacatcacacgtataattttagaagagaaatcatatgaatttctagccttcaattcgcttaagccatgtcgagacggccaccttggcatggccaagagtcgaccggcctggcctatttcacgacagtcattctaatcgactttagatgaaattcaatgtttgtaatgttcatcaaagatgatataaggccatttccaacccaataactaggatagtgtccataacattaaataaactgctacctaaaatgaaaaatgatgtggcaaataaataaatgagaaaagataatgaaaccatgtctcgcatgagatatggtttctacacaacatttaagacattatgtgagataagtaacattaaatttaagtatggaatagtggtgtttgcattaaaagagtaatgtcagtttatgaaaactatgttagtgtcttgtgttggaaatagcctaagacatcaaatgagtccgctcactaaaggagtgctggtcgttgggaccacgtgtccaggcttggcccggcccatcctatttgcctggccgacctgcgcgccctttttccacaattatattatctagatacgacgatacagatacggatacgccatcttcctaataataaagatacggggatacgcgtatatatatataaataaaaataaaaaaaataaatcgtaaactaggcaattagcaatttagcatagcagagcatgccaacaccaagtcaccaaccattagattcatctcaccaaaatacaaataatataaggctaaaccagtgcatatgtaagtgcaagatttcaaatagtacgcaaatcacaaattaatagttcatcaacatgcatagtttcacacatcacaaccagttc

SEQ ID NO: 34012 - DNA, 1501 bp, Oryza sativa
aatattccctccgttccaaaatataagcatttcttgtccagatacatagcaagaattgcttatattttgaaacaaaaggagtagctcccaagtgcgttaatcttgagcactaaagcatgcttaagcatataagtatcaagggccaattgcataattgccactagtgcaaaggcttaacaatcatggtcaaaatttgactaaccgtggcttgttgaccactagggcttggaaatgaggttgggcaaagttcctccttaacgcggccaggaaacgtctgcaatgtgggtgttgatgggtggaagctagccgatgatggtccagtaagcgaagagctaggagcagactcaagttcattgtgaagatcgttaatcctctgcaggagctccttcaagtactcaattgcatcaccaaggatagaagctctgtccatctgtcacaaaggagaagaaaactggtaatgagatgataaactatagatattaacatgaaacgagtcagacatagttggcattaagaacactttgacataaattgttttgtactgctacactaaaaaacggcacatcgtacatggcgctgaattgttagactgcaacttgtcataatatcccaagaactgtagtacatcaggtctttctttattgttcaaaaccatcttgatcgctgtgaaggaaagtagtaagttcttcacacgaaaggactgcagagaactgaatatgcacttcgcatgccgaaacttccaaagtgaacgacttttttcaaggaaaccaacaaaagttaaagacaaaacatccaacacgaagaactacaaaaaaaaaacagaaagaaaagggggaaaagaatttgtgagttatctggtatctggtcactttcaactacatcttgtgcatggcactgtgttaatcatgcatcactaaatctggccatggatcagaatcaaagttccccataatatgtgtaatctcaagctacgacaaattataaagtcctagaaaaaagacattgaagtataatttcagaactgaaattaccataactgaactgtaaaacaaccatccagcaagctgaataggaactcctcatgttaccatgtgaacatgacaaggtatgacatagatctaatgaaaaaaggatgtttttttggatctgaagtggagccaattcaagaattcagcaccaaaattggaaccaatttcagtgacaaatatcatgacaaacacactcctacaggacctacaccagtatacatcactcaagaactgaaacatgttgccaaaactgaaattagaaaagtagaaatagaaaatgctgattaatttaattaataagatacagtctagtagaaactggagctgctgattaattaaataattagcaatgaacagtgaaaaaatagaaatgaggtcattaatcaccttgctgatcttgggcaccacggagcgcagcatgtagaggcggtcgttgagcttcttcctgcgccgccgctccgccatgaggttct

SEQ ID NO: 34013 - DNA, 1501 bp, Oryza sativa
gtcattcacagtttctggaaggattttcttaggcactaaagtaatgtaagagctgttaagaggctgcaaatcagtagaaaaaagcatggaaatgggctgccagcctgtagaaatcttgagaaatgataggctaatatttctttagaaagaacccattaaacccatctgaaccaggggccttctctaggggaattatcttaattaagttgtcaacctcttgggtagagaactgatctaccagacaatccaaattaattggataagggattaaaggccattgagggagaagaagagatccccattctgttcttaaagctttggaagaaaagacttgccttttggtcatgcaaagaaaccacttgaccagattgatcataaatctgagagatggaattcaatctaaatctttttgtggcaatagactggaagaatttagtgttctcctctcctaacaacatccatctgtttgtacatctttttttttccagtatagcttcttgaattctagaagctttatcgtctgcaacttgataatctctttgaaattccattaatatatacccaagggcctttgttcctctatcaagtccaaaaagttcaacacattattacagttaactagaagagtagttaactttgacaaatttttactccacttcaacagacttttccttaaaaattttagcttaaaactgatgcacttagctggattatcaaaaccaggatccacagacaaaaccctgctgacaagatcagaaaatccctccatttcaaccccaatgttttcaaatctaaagattgggtactttggaattcttgtatcaattttaacagcatagggaacatggtcagaaatatttcaagcaagaggaagcacagtatttgtctcaccaatcactctcccatcaccaaccgtataaccctcatttaatgtggagcatcaacattttttttttcattttccttagtctctccgaaaagtatctagaaatactttttatatttgtggatgaaggaactattgtattatattgttttattcaacatggacagatttcccattttctccccagacaagctataagtaaagaaaagattgttggcttcggttgacaaaaaaaataaacaatgcaacggaaaatgattttagggtaggattttgtatattcattttcttagtggtaaaaaaaccaaggctgaagaaaagagaaaatgatgaaaaatagtctagaatcatttaaaattaagtttggatttaaattttaattagttacggcaacaagctccaagcgatgagagcacatcttttttcttcctcatgtgctcttaggatagatcttttgattgcttgaacgacaagatttcccagcgcagttagttaaaattggatttgttataaaactcttagatcctatttacatttatggaattatattttgtaacaataaatattaaaaataggattggatttcatatacaaaccattttcttctgtttctat

SEQ ID NO: 34014 - DNA, 217 bp, Oryza sativa
atagcattctatttccaggaattatttaggcttggctctgcaatgtatttccttccagcctacttggtgcatgaggtcatgaaatatggtcttcaaattgaattatagatgaattgtgatgctgatattccttgtttttcttttcctttttcttcacagggatcttccgtcggatagtatggtattgtgctggacacactgttgactttcgtctcta

SEQ ID NO: 34015 - DNA, 1501 bp, Oryza sativa
accgctgtgatttgtttataagtttttagggacagcctattcacccccccccctctaggcttcatcagtgcgttcatcggggatgattgatttgagatctgtggacgggaatggagtgaaatcaatatattacaaacaatgaagaaaagaaaaaaaaataaaggagcaaccggatctagcccggctccatctttagtcctaaaaagggcttcatctttagtcccggttggtaacgtcaaccgggactaaagatagatttttactcctgattatttcacccgggactaaagatagcgatttttagtctcggattcgtagtcagggtgttactaaccgagagtaaaaaaccacttctccaccggtgaaatatatgatggtgtcaatgcctgatcacaagagaaatttcttcattctgtaccgtacttttagggtgattggtagagagtcagtcattagttcgttcatctgactccgaatgcatacatgcatgcaggatccactatgtatatatatttgtttcaattaacgaataacaactagtaatttattactccctcccgtcactattatttatcatttccaacaatgaaatgatgccaagtgtaagttcgttttgctgtctgaaacgtcatttatttccgtccgaagggagtagtacatgcatgtttgatataaatgccacgtgctaaactgctaaggcctttcacagtgccacgatgtggtgagttacctcgttgctgaacaccgaccgacgtggaggagaaaggaggtgggtcccgtgccttgcaaggttttgcccctcatatagctagggtctgggtttctcacgcccgaaaaagaaagtgcgatgcggtcccctctctgctgctcctccgaaatcctccccattcttccccccaacccgcgcttccaggccaagatccgagtgggcttggagctcgccggtgacactgccgagtgccgacgagaaatgggacattacaaaaaaaatcaaatagatgtcgtcactataggtgccggtagtgctaaaaccggcatctataggctttttcccacctttgtaggttgaaatcgcaaaaaaaaaggcacctttaagtaattataggtgtcggttctaaaataaaaatcagcatctattatactttgtgtcggttttctaaaaaacagcacatttaatatattataggtgtcgattaattaaaaactgacacctataatatattataggtgctgttttttttaaaaaaaaccaacacctatgtaaatcgagccgagctggccggcatcggatgagccgaccggtgcgccccaccacgacgagacgagcattggataaggttcgatcgtctcgctctctcccttctctctcgtcacgctctcttcttctcgtctcgctctcttctctctcccccgcactgctagcgactagctggcggaggcggtagcggcgaccgcgccctcccctccgccagatccggcgggaggggaggcggcggcggcg

SEQ ID NO: 34016 - DNA, 1501 bp, Oryza sativa
cactaaattgctaaaccctaaaagccagcactaccactcgtcacgaggccatcaaccccatccatcatgctgcctctacctccgatccatccccatcgcgtgtcgcgtcgcgggcatccacagcgtcggcgccgcctccggccagcccacctccgttgtggccccgacgagcaccgccatccgcctccgccacggcccgacgagagccgccgtccacctcgcgccacctccagccatcccgcctccgccgcagccccgatgatcgccgccgtccgcctcgcgccgcctccagctggccgccgcggccctgacgagtgccgccgtccacatcggcgctgcctccagctaggccgcctccaccgcggccccgactagcgccgttgtccgcggcgcacctggcgagcagcggcgtggccttcaccagtgcttgccgctgagccggtgaacttctccagtgatttcggtcagaccgagactgagactgaaaaaactgagaccgaatttgccggtcctgagttttttcggatgaaattcggtgctgagttttcaatgactgaaatgaccaaaaaaccgaagactgagaccgaatttttcagtcagaccgaacgcccacccctagcactagatctagctacggaagtaccggatgcgggcacgacggtgccggatccgccacctccttcgctggggagtgggtgcgttgtcgccacctccggtctccggtcaccacacgtcatgccgcctctcccatgccagagacagggcgccgctgcaattaaacctagccacctctatctcggcccgtcgtccggttctccagcgacaccctctggcagcagcgatcgaggtgggaagaggggggcgacgggggctagggtttcgcccctgagccgcccacgcgtgggcgatacgagagcctgttagttttttgttttatcttgtttatacgttatatgaatatagtattgtaaaattttgaagaatagatgtgtgttggtttattgtttggggtgctagatgaatttttattgttgcaaagtttcttttttttttgcaaattttagggtgtatatagatttttttcatgtcctggctactgtagctgaatggaagttgttttgcttgaataggacaatgtaggacaatggagagcgagccagctcctgcgcacagaagagtaggaccgcacaaactgataaggttgcacctgaatgcttatggaaccagcatcaatttaccggcaccattgagggtagtcattggtaccggttctacaccattgaggttacaccaatgacctcatcattggtgcctattataatttaatactagcactataggggtgcaccctttttaatttttctaagtgcgaaaaaacccaaaaaaatattttgcattttattagacgtcaaccacaatcacactttacttcccccaagtcatattatttttttaacccatattctttggaatgtactccctccgtcccgttaagtgcaac

SEQ ID NO: 34017 - DNA, 1501 bp, Oryza sativa
agatgagcttgggttgtttcccctccatagacaatttttccttgcagtatcaatagctttggctacagaaacagacaactgtagggaacacatgtaataagttgggattgaagataagacatagataattaaagtgagcattccaccctgtggcaaaaaaaagagaactagctatcaatcttctctcaactctgtcgaccaaaggagcaaagtccacaactcttggcctagttgttcccatgggcaaacccaagtgggtgaaaggcattgtaccaatagagcacccaagtaagccaacaaagagcttagcattctcttgggggagattgattggatataagctcgaattatgataatgatagttcaccttgagtccaattgactgagcaaaagagttaagcaaagctttgaaacaaaatacttccctctaagatgctttaagaagaaccaaagtatcatcagcatactgaatcacaggaaaacccttgccatcttgttcattaattggtttggacagcagacgcagagaaaaggctctgttgataactctttgcaacagcttagcaccaagaacaaaaagcaagggggaaagggggtccccctgtctaactcctctcctacatttgaaagaatttccaggaacaccattgagcagaacagaagtatgagatggagaaaacaccatctgaacccattgcaaccacttgttattgaaacccatgctttgcatgatagaaaggagcacagagtgctcaatagaatcaaaggccttttcaaaatcaagcttcagcaggattatctccctcttggattgatgacactgatgaatatattcaaaagaccatgctaagcaatcttgtattgttttgcctctaataaaaccatattggttttcatgaacaagcttgagcataataccctggagacgatttgccatcaatttaattaaaattttcaaactgacccccaccagagagataggcctaaagtcattcacagtttctggaaggattttcttaggcactaaagtaatgtaagagctgttaagaggctgcaaatcagtagaaaaaagcatggaaatgggctgccagcctgtagaaatcttgagaaatgataggctaatatttctttagaaagaacccattaaacccatctgaaccaggggccttctctaggggaattatcttaattaagttgtcaacctcttgggtagagaactgatctaccagacaatccaaattaattggataagggattaaaggccattgagggagaagaagagatccccattctgttcttaaagctttggaagaaaagacttgccttttggtcatgcaaagaaaccacttgaccagattgatcataaatctgagagatggaattcaatctaaatctttttgtggcaatagactggaagaatttagtgttctcctctcctaacaacatccatctgtttgtacatctttttttttccagtatagcttcttgaattctagaagct

SEQ ID NO: 34018 - DNA, 257 bp, Oryza sativa
tattacgctcctcaccgacccgaacctgtatacatcgcccgtgtcttgtgtgtttcctgtctcgcgagccttccacatacagagagcttagaatctcaccctgagtccccggccgaactggcaaagggggcctgtgcggtctcccactgaggagccccacgctccgtcatctggcgcgccaggtaggggactctgcgagggattttctgagctctcgcactctttcgtgtgcgccaagcttttcctgttcagcccaa

SEQ ID NO: 34019 - DNA, 1501 bp, Oryza sativa
tagttacatttttagtgtatctatatgagagaagctttcctagactactgctgctcatttatagtctaagccatcaattcattttcatgtgccataaatcatgagcaattttgccatccaacagttcgtacctcgaggtaccaaaaaattgtagtacctcgaggtaccaaatgttgaatggtaaaaagactcataaatcatacataggagatgctctgttgcaatttatacattggatttactcatatttatctcatgcaaaagcttttgcattatttttctttttggatcgcaacattcaaatgtgctaactgctaagttatgtcttgatacaaatgttgcagcttgatgattgtgatgacagctatgcaaaattactgacaagttcatcagactttacattaaaatcatacaatatcctacggctcctgcacatgttattccatctttagttccgaaggtaaattccttcttaaacacagtcaaatcttacaagcaatatccttgccatgaatattaccgttaatatcatggtttccatttccacaatgatccacagatgaaaaaaaaagagcatctcatatacatgttgacattctatttgtttgtaaatgatcttttgctctattcaaggataaaattatcattcataaaagtacatattgcccttcatatatgacatttcttattctaaattcatctgatgctttagttcacgaagaatcatgtgaagatgctctttatttgtattatacaccatataaaaaacaaatcattaagattaattcttatatttgtcaattatcaggatagctatggattcttcattctttcctatggcatgtgtgctggctacatattgatgtcagtgatgatgagtttgcaagaaatctgatctgtctttcaactcaacgtcacatagtaagagagtcaatactggtaataaaatcatagatggaatcaagctacctaggttaacagccaattgagcatagatagtccattgttcatcatagacttgcagccaatcacctgtatatatcatactttgtcatgtttgtacttccaagtaaaatcatgtcacctccatgttttttctacttaggtatttatcttctaggtttataggatggaatatttctcgaatacacttttgtctatgtaaattacaggtgttctgtatagaaaattttcccatcagaaatctttatggttgttcatatgttaaatattttgttttgcttaagcaccccgcggcaacgcgcggggtcctggctagctgtatgggtatcacgatgcgttgaaatgacgtgacggtcgcgatctgctgctgaagatggaactgaactgactggagtagaaagacctaacggcgaggcaacagatcttgtttggggcacctaaggcctcgtttagttgtggaaaaattttaggtttaattgcatatatcagatatacggactattagaaagtgagttataaaggctgtgtgttgacgagt

SEQ ID NO: 34020 - DNA, 1501 bp, Oryza sativa
gtttcattacttactcaaatgtttcaattaagtttctaaaatgttttagaaaaatataacatttttttttgaaggggagaaaaatgtaacatttagaaaatactgactgcaacaacaacaaccactgtataattaagccccaacgaatgaaacatcacaaagaaatcatatgaaaaaatatttcaaaaatacttgacattacttaagcgtgttcatatcatatatgaaaattcagttgagagcgttaaaacaccataaaataatttctgaaaaagatttcttacgcttcagggatacgaatccactgggtagggaatcaaaatgcacttcattcattcttgtccacccgttgcccagcccagactgcttaggcccacatgttgaaggcccacctatgccgatctcctggaactccggcatcctcgccagtagccgccgctcccaccgtccaacgaaaggaagcgggcggccggcgctcggcggcgctcggcaggcatggcgatcggatgggatgggatcggatcggcgcagggccaaggcccgagggtcgcatcctgcgactcctgtgagttcgtgggctatgctcgctcgctcttctcctgaggtaaatcaatcaaggctagctgcaaagctcttgtgaaagaatcatcatgttcgttttaccgatcttgggattgtgctcgtgtgagcttcggtagtttccacttacatgtttttttgttctctagttttgcagagatctagttgtcagttgcagatttacggtcaccttgttgcaattttttttcgaacggtcagtgcgttatcaacgttttatatagagaagtgtctcattttaatgagaaaacgtaaccccaattttccataattaattgtaattttttttcaatcggtcaggctgttactgacgttttatataaaaaagaagtgtcctattttaagtaaaaaaggaaccatcacccagtttttcctaattaactataccttgttgcaaattgcagaaaaaatattccgtatatagtatttagtatagattatatcggtaagcattgacatccccacacaatatggacacagttcttttaactatgatttcagtttactatgcttccacaaactcgtcgaccatagtccatatgacacagttggaatctatgatttcagtttactatgtttccaccgactcatcgaccatatcctacacggttggaatcctggagatggttatattaattagaaagtcggctgttggttgcttatttcaattctgtgacccattgcgtaatgtacaacagtacaagccagcacaaattattgtctggtttagccaaagaatctggacacaacaatttgatcatatagcactcctactccaaagaacatgccaaatgcaattgcgaagacaaacttgtcaatgtactgctttgtggggattgtggagactggagctgctcctgctgaattgcagcggtgcaaaagcatagggctgcatagcttcggg

SEQ ID NO: 34021 - DNA, 1501 bp, Oryza sativa
atttaacttcactagtaaattaatgaacgtttaatataaattctattaataatttattaaataatttataaatcctgaaacgaaaatcaggatgtgacaaatctaccccccttacaaagaatctcatcccgagattcggaacggctagaaagaaaaaggcataggtaaactacagtctatcttttattccacaactccaataattattctaaggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcataacaattgaaacacacccgatgctcccttccattactgttatcttcttgagactgatcctgctgaaatgacactgattgagtagcttgctcatcattgtcttcattgcttgcattagtctctgagttgatctcaccactgatgcccaactgttgtgactgttgttgtgactgttcttgacctgcagaaaaagattcaccaatttggagtggcttgatacgctgcctctggctactaccttgtgcctcctgggatacagtcattttccttttacggttatccatcttgttcttcttgtcttccagtcgaattgctttatcaaccaactcctgaaaatcctcatagtcatgagagatcaacataactgacagttcatccttcggaccttccaagaatttctcttgcctttcctcgtcagtacgcacatcttctggagcatagcgagccagacgattgaactcatgaagatactctgccacggtacgatccttttgcttcaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaactaggttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttggcggcataggttctaagataggttccaaacttcactctatctgaacacttaagattcgactatcatcttcttattcctcgatccacttgacttgcagaagttgacaacatcgacgtcttcgagtttctccatcaagattaacgactactcaagttgaaagaggaagggggaagaacgacaaaacgatttgcaaagaattctagataaggaagaaaggaaaattttcacaaattatgttttcggaagatttgtcctt

SEQ ID NO: 34022 - DNA, 319 bp, Oryza sativa
ttgcatcaccttgtactactaaatgagaaatggtaccataatcttttggtacttttatttgtttcccaatgtgctaagaaaggagatttaggctgctttatatacatattgaaatattataatttagtttctgtagtttcatgtgtttctgcatgccatcaagaattccgacattttcaatgttatgtgcagtccttggcaagtatatatatatgctatagttgtcacagatcttgtagattttcagtcttgtttttgttagttctttctcagaagattttgtgaaccatctaaccatcgtttttctgttcgttgcaga

SEQ ID NO: 34023 - DNA, 411 bp, Oryza sativa
taagcaatcataactaatatctagctgaaccaatatataaagcccaactagtcaagttataataacccaaggtatcaaggaataaagtaatcaatgcaaattggcgataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagc

SEQ ID NO: 34024 - DNA, 1501 bp, Oryza sativa
taaatacttgtagttatttgaaatttacttttcgtatgatctgtttcctatcaattaaaacaagttctatagtacggagtattaagtgttaattgatgactgaagggctatcccattctgctctagatctaggaacggtattccctccgttttataatataagactttctagtgtatgtgtctagattcattagcatttatatgaacgtatgttagaaagtcttatattgtgaaacggatgaagtaaatagttaaatgtcctcgagtccctaactttggagtcatcctacacgaatgacaaaagcaagattgtactccaatccattatctgtccgtgcacgaatatacaaaatcccgttcacgtaagtgcaagttttataaaaaaggaggttgttgcatctaattttgaccacatcatcaactaataaatatagaggtaatatatacaatatatcacatctatactaattctaatacactagcctcaatgtttgtttgcccaatctactcttcctctctctccttttgtcttgaattttgtgtaatggttgcctcttgcatgagaggtggctgcttatctctctcatctcttctctcctccacctcaccattttagcttatgtggcacctaggagattgtgcttggatgtttatagtatttgccctaatccccgtatagatagttcataaacaaaatctatataaaaaattccccagattagtctctaccaccatgtcaacgcatcgagccgaaatgagccgatctcgaaaccgtgaaccgctgctccctggaatcctgctgctttcaaccttttcgtgtcacctggaactaaaagccaccacgtatgcaaaagatctctgccaagatcacgaaaccattcaccgatgcaccggctggccgcgccgggaagcgcgcgtggacgccgggagagcacggtggccacagccacagacacagcccgaaccgcacgtacgcaaaacgcaagccgcggatcggagagcgacatgtccactgcaacggtgcatctccccacgcacgcacgcacgcacatggacggctcctgttgcgagcatactactagtaggagtagtatatacaagtgcccctcgtgtagcatcaggggctcagaaaactaaccgaaacgatgatgatgtgtgtagaagtacatgatgtcgaccgatgggaaccatgtgccgcacatcccttgatgctgtagctgggtgagaggtagagacagaatggcatggcgttgcaatgtgctggaccggaaattactctcgccagtcgcctctgatgatccatcgaccactcattcagatatatttttttttgtaataaaaactccatcggattagaaacatgtagctaagcgtacgtgccaccctggacagagctaaaacaaacgatagattcccagggagcatggttaagagttactgttaagaccattagaatttgtacaaatcctgtctgtttgtcccggggtctcgtggcacctca

SEQ ID NO: 34025 - DNA, 1501 bp, Oryza sativa
gatttatccagtctgcaccaatttgagaaaacaatatttcaaccatgagtcattcccactttctatgcaaaagcagaagcaaactgcccagtgacttgcttgggtttgctctattctatgctgtgtttagcctcttccagaagaatttttttttactattttaaatttttattatttcaccagccgcggttggtatggctgttttttcttgcctctagaaagtttttttttttgccactagtgtggccaacgtggcaaaacattactatcacgccaatcagactggtgtggcaaaataacattactatcacgccaatcagactggtgtggcaaaataacgttgacacgttagatagagcggcatggtaacattgtttcaccgtgctaacatggctaaaaggtatagatttagaaaggtttacttttaaaattaaaaattaaaaagatttaaataataataataattctacaaccagctcctccacagaccaggagacgacgatggcctaacctgtcctgcaatttgctgttcggtgaacttccactggaagagttggtgtcctgactaatctaacgacagttgatcttcccatgaacagcttcaatggcacaactccagaaagcatctacgcatgcaaacttcagtaactaatttccatacaaacttcgtagaaaacaatgaaggtgaaccagaatacttctattatactagtagtactcgtagatagcactatagcagtacaacacacaagcaagtccatgaaggctcagcctttactaggaagttgaaggctcaaagtttgttcaaccttgcaaacgcaagcgcattccagcagcagcacgcaacacatggttatttagatctgcatcggttacactttcagtattgatccaactaaccatctcaaggaaacataaaaagagtagaatgtaaccaacaaaacacaggtcaatctttcaattgctgtgaaggccaagaacagtcaacagtcgcgagttggggacgaattcaaaatgcaactgctggataggttgttaagatcagcagcagtgtacgtcatacaaaaatagataaatcaaaggaaatcagtgtaggcttatagactttggaccatgactctgcttcaggagtgaaggaatggaagtttaacaaatcatctcaagtagactagtgtgtctcaagtggccaagtgtatggataaatatactttttaagtgcaagtatttccgtcaaacaatgtgagtctaacacatcatgctgaaagcaaataatagatcgaatttacaaaccatacctaagcatagcactaagccagtgagaggcagcagtagcaaacgcgtaggtcaacattccatcagcttattgttcttcgcctgtttggtgcgtttaggcaatgctattctttctctctgcaaggaatttagcaatgttattcgacaatatatagctcaaggactgtattttttttgcacaggataccagcttatattggcaaaccat

SEQ ID NO: 34026 - DNA, 260 bp, Oryza sativa
cctattcctcttcctattccattggtaacttacatcaattactcctaattgattgttggttgatggttgtgtagtggaggatggttcatggctagttgatgacaattagttgctctattcctcttcctattccatgactcttactcttcatcttccattcctcttataaaatgagaatggatttgatctcccgcgagaacagtcagacacactttcatccattttccaatgttgttgttgctacggtaatcccatcccga

SEQ ID NO: 34027 - DNA, 593 bp, Oryza sativa
cccacatgtacaacagcagtatgccagtatatatggcttcgtaagctggcttgaaacaacattaattggccgtacaagaaccaaacaaattggcagtaacaaagcctctctgcgcccatcaatggcaacatgaagatacgtacgtactctctagtcaacagcgtgtagagacttacagtagcggtacgaggaaacaaaggcgcaaatgtctcttttcccttgaagaaatgatcaaatgaatcaaggcaagcaaactctatacgttttcatttcagggtttcaaagcttaatcatcgccttcattttctatatatgtttatatcaacttttcttttacaaaaagagagtactgaaatcaaccgggtcagacacgcgctgctataccaaaaggattccaaagaattgcttgtgtgttgacgacgctaggatctttgatggcgtcaacaagaccccgatagaggtcgcttaattggggtattgccatggaaaaatggtgcgcgtgacgaacggccggtcggaggcattgtaatcgaagagatcttggacgagctgtgaatccggctgatgttgccaggcacatttcatgtgtgata

SEQ ID NO: 34028 - DNA, 1501 bp, Oryza sativa
cttatgtatgagtgggccaagaactcagaattgacacgacaaaccgggccaaaattcacaagtctgcagagaagaacaacggaggaggccgccagccaaaaatgggctggattgggccggccccaggttcggccgaatcctcctcagcgccatccgatccagggctttgcctggacggtgtggattagcccccaatgacggttggagggtatttccgaccattccaaccgtcacaaccgtcattgggaggctataaaaggagttgctcttctcacttcagtcacacatgtcaagcaagagctctcatattctctcaagttagtttagtagtctcaagctagtggaataggaatagagtagaaatcaggagtccggaagtcttcggaagagtttgggtatggctctagtaattttcctttcctcttttgtaagctttgtacttttattagagtattcttctttatatatttatggtatcgaaatactttccgagtatatgaatgccaacttttcattatgttcatgttatactgaatatgttgctaggttatctgggagatgctttggtgcgggtataatgtttgcgtatgcaattatactctatgtcatgacgatgatattagagtagtatctggtagtttagacgtggtgtctagattatgggatatcattatttggggttatatgctgcggatgagaggtgggcccactactacaaaaaggcaaataggtgtcgccactataggtgccggcacacttaaaaccggcacctataatgtcttgcccacccatacgcccacccccatgctccacatattcaaaaaccggcacctttatatccaaataggtgccggtttcattttaaaaccggcacctaaaacctgtgtcagagaaaggtgccggttctagaccctaaaccggcacctttaatcttctccctcccacctaacctatgccggtttttagacaatgtgccaattctcaacccaaaaccggcaccattgtttcactaatgcttttcatcccgacggtgggtcctacacaaaggtgccggttcttggtatgacaagtcaaaggtgccggatctcagcccaaatccggcacctttaatattctccctcccacactagccgttggtgggcccaacacaaaggtgccggttttttgtatgtgaagacaaaggtgccagtttttggtctagaactggcacctttgttccgatagtgcttttcatgcctcacacaaaggtgccgttgttggatcgagaaccggcacctttcttccaatagtgcttttcatgccccacacaaaggtgccggttaggaagacaaaggtgccggttttgggtctagaaccagcacctttgttccgacagttgtacttatactccatcccttgccactcgagctgattgagcaagaagagagcggtgcctctccttcttgcctgattagctagaggaggggaggagggtttgctccattttttttgtggcgtttgt

SEQ ID NO: 34029 - DNA, 1501 bp, Oryza sativa
gtacgcgtgcgacgccgtgccggccaccgccgacgcgaggctcgccgtcccgatgatgcacccgccgcgccccgcggccaccatcacccgcgccgcgtgcttcgtgcccaggaacgggcccgtcaggttcacggccagcacgcggtcaaagtcggccttggtgctctccaggatgctgtggcacgccgcgccgccgatcccggcgttgttgaacatgacgtccagcttcccgtacctcgccacggcgtggtccaccgcggccgcgacgtcgtcctcgctcgtcacgtcgcaccgcacgtagctggcggtggcgctcccgagctcggcgcacagtcgcgcccccgcctcgtcctggatgtcggcgaccacgacttgcgccccgtgcttcacgaacagccgcgccgtgcactccccgatgccgctcgcgccgccggtgatcagcgccaccttgcccaccaacctacaccaacgtacacacgataacatggcagagttacgtgtaagatcaccgacaagctcatgcatcgcacacaacacgcgggaaaaaaaattaaaccgttgtgatctcactttcttgcagactcatgaacgtcgccgtagctgctacccgccatggccaccgcgagatgagaaatcgttagctctctcgatctgcgactctctgagtaagttagtttggcctgagacttgatctcttttatagtagtagagccggctactgatcagctagtttacacaactacggcaaattgtgtggttcggcatctccaacagacagattcccagcggaagatgacacggcgcatcggcgccggcttggaccttgtggtggaggctgactgtgcgagtatatgattttgcttagtagttgacggaatgcaggagctgtttagatttagatttagccaaaactggccgccccacgtcgtcgctagcggcgtgtgccattttttttaagagggtagctatacgggatcttgttgctacaggatactttaagtgattcatcccttactttttttttataggtgagattccacatggtgaatatgtgctcccttccggtacctggtaccacgtaccataatcgcgatacctatctgattcctttaactcctttcctttcttctgtataggtaagatttcacgtggtgaacatgtgctccctcctagtacctgataccacataccataggcgcgatacctatccgattcctcctcggtatcgcgcgtgcgatacctcatcgctggcaccgctcctctgcagtcggagcagcacaatataggctggtacatgatacctgatacctgatacctagtacctggtacctagtacctgatatctagtaactagtatctagtacctgatacctagtaactagtacctgatacctagtatctgatacctgataccagtatggcactagttgcatggtgtgtagtacctggtacctatggaattggagagattcacaaggatgggacaggggaatcgatacta

SEQ ID NO: 34030 - DNA, 1501 bp, Oryza sativa
ctaagccacacttgtgccaccatgccttaactagcctatacttagttatagcaaggttaggcatcaaccaaacatccgtggatgcctgcccggatggggattagattaggattagattagattgggttgtttctctctctacgtatgggctggctggttggctgatttttcagttcgaaccatttaagcctattatctattcttacttataaaagagccatcactcctactaccaactcttaatttttcttttaaggaaaaaaacatatggggctaaagggccgacatgttaactactcccaccatcactctacttttttggaagaaaaaatattagtatgataaagaaaaggtcaacatgtgattaacaataacaattaagatatgctaataatattttaatgataattttaaataattaaaatcccattgcaatgtacaggtaatatgctagtgaaaaataatcaaggtagtatgctatactacttacaagtggaaaactcaggtttgaagaacaatatttgatgggttaattggatccatgccaatacaaatatgtcaaattaaaaaaatatcactactattcgcgatatcggctagatgccactagaatttaggaaaattagaaccgtgccaatccgtcgtattttccatccatttttccggtcatcccccgttatttctatcgttgccgtcctgtactcctgtgccatctccgagaccacgcaaccgtaacaaggagcaaactggaggtgatggcagcggcggaggagcagcccgagcaggtgtccaggcgggtggcgggcgccgtgccggcggaggcgagcccacacggtcgcgtcggagtcgagccctggcggtggtggcccagccggtgaggacggcggggccggagcagatgtcggggacgccggcgacgaggagctcaagaccgggaccagggacatgacctgatggcgaggaagatggcccaagatcggcggctgctgtgctgcttgacgacgacgatgacgaacggcctggccgaagagatcgagatcgatctctcctaagacaagcacgatgacgacgagggagctcggcggcggcgaaggagctcggcggtgagggaacttggtgacggtggggcttccggcgccttggccggaggcggcgggcacttcctcggcggcatagctcggcgacggcgacgggcggcgccggcgccttctcctgctcctcgtcgtcgccggcacggaggcgtccgcgtctgccgccctcccccctcgcttccgcgcgcgcgtccgacgactccgttccaccgcgaaccccgccaggcccagccacgactgccgccggcctgtcctccgcccgtgccggccgtcgcgccagctccccatcatcttctccgttttgtcgcgtgcgcctcatcggcttcgactccggtggtcgagctgctcacgcgcgtccgggggatggtgcctccggcgctgggcgaagggcttcctgggcggtggatgat

SEQ ID NO: 34031 - DNA, 426 bp, Oryza sativa
aaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacacaaacgccacaaaaaaaatggagcaaaccctcctcccctcctctagc

SEQ ID NO: 34032 - DNA, 1501 bp, Oryza sativa
gatatgaaaaattacatgctatttatgctacctattttatagtaatgctcttattgatctgtttgtgttacatgtttattggtaagatgtccatggattgcaacgaaacatttagttttatggagattatatttttcatgattaggcgtccatacaattaagaatgaactatggaatatgcatgaagttgaaaaaacaggctatttctgattttcaggaggtcaattgtgaccatgctaggtgggacgtgaaagggcggacggatgatttctcgactaataagaagtaaatgtgtgcaatatagtaatatttctatacaacaaaaagtgtgctatttacttcgtttgaagttcgtattgtctacaagttggctgatatattccgtgtgtttgaccactttaaatacttcaattacgttcaactaaagaaatatggttatagttatatttatcatcaacgtacttcgattatattgtgcagaatttaaaatatttacatatctattacaagaaaaaatatttgtgaaattttaaatagcgttaatcatatatgtttgaccggtttctacaacattatatttataataacactatagtattattgaatcatttttgtaatgaattcgagaagcacggtggcatggtgttttagtcgtgccatacccaaggtcctagcctctcctcttctcccgcgacaccacaccgctgtcgccactccgcttagcgatgatgacaatgctttgcattgcttaagatccgttccctaagcgaatcacgtatatttttatatttttttggaattgtgtattcatgatattttttttcctcacgcggatgtacttttaatatgattttactgatgctgaagattttctaatggtcctttttaatgtgggttaagagttttgtgtgagtgtggtgtatgtgcgtgtatgcgtctttcatgtaaatcaaaaataaaataaaatttagacgaatttataccatttcatttttgtctcaacaaatgttttcttagaatgttttagagggaaatgtatgtaagggctagttggtttgaagccgaaatttgccataccaaaatattggtattttgaatagtaattttgtcaatgtttggtttaccaccaatacttcctaatactacacattaccaatagtattttcaatatttggattaagtctattttgcctccctcatctcttgtccttggtcgaatcgcatacctcaaccacaaaaccgagtataatgcctcccccatcttcgaaaaccggtgcaaatcaactccctcgttagttttgggagcagtttcacttggtccaagtgtgctaacgtggcacccggtcatcaaagaaaccgaaaatagaagcgggtcccacgtataaccacaagggtaaacataaaaaatagtggggcccacttgtaagccccagttctccttctctgattcctcctcccttctctctctctcaagcaaagctcacatgcactctggcgccgg

SEQ ID NO: 34033 - DNA, 1501 bp, Oryza sativa
tcttggggaggcttaattgttgctatcgccctccgcttcaggtgtccatttgaattattcgtcgtttctttcgtatttaattgccatttgctgatttgcctctttatttcggtgggttttatggtaataaaggtgtggttcctttatcatcaaatttgaggtgttctgggttttctttggttcttttttggagcactggatttgtgtgctcttgtaaatcaaatagagtttgtggtttggttcgtattttacacaatcgagttgtgtttttattttagtttgtatcgaaatatttgcatacttgtttctagttccttcaggcttcagttctcttcattattataaaaaaaaatttggtcctttcgtccataatttttttcacaattccatttttgaatgtatgagcttgaattatgtgacttttcagtttgagcttgggattgtcaccttttcatggacgggaccaacaaccatggagcactgatggacgattggatgcttccctcacccagtccaagaacactcatgtcgagtttcttgaacgaagaattcagctccggtcccttttcagacattttctgtgataatggcagtaacaaacatcaggatggacttgggaagagcaaagctttcatcgattcaagccgggaagaaactgctcagctagcaaaaaagtttgaatcaaacctttttggtgccaaccagaaatcaagctcaaatggctgtctgtcagagaggatggctgcaaggacaggttttggtgtcctgaaaattgatacatctcgtgtcggttattctacaccgattcggtctccggtgacgatcccgcccggtgtgagtccaagggaacttcttgagtcgccggtttttcttccgaacgccattgtaagtgacttcctcacctcaatcagtatttgctctgtgtaatgttcagttactctactcatgtggtttatatggaggatatatttgtcagtaaatggtgaaatctaaaccaagatacctattataaaaaatattctaacgcaagatacagcatctttaatttctcttatgtctctgcagcttcgtataattagtggaattttggagaagaaagtgactatatatgttgatgactgattaatcttaatgtcatggttttgatttatgcaggcacaaccttctcctaccactggcaaactgccatttttgatgcatagtaatgttaaaccatcgatccctaaaaaaactgaagatgaaacacgccatgatcgtgtattcttctttcaacccattttgggatctaagccaccaacttgtccagttgcagagaaggtagttttctcaaacaatgtggttctattccctatttactgcaaatctgtaatcactgctcgcctgctcggcgcagttagttttactgttccagcaaatctgacgagcaaaatcaaattatcagtgttatttatgcattggtctgatgatatttatacttttcagggtttcagtgttaatcatc

SEQ ID NO: 34034 - DNA, 1501 bp, Oryza sativa
tacagggtcgcacgcttaatgggccggactaaggggattggatggagatccaatatgagcatacttcgtatagggatccaaataggagtcttacgggccttggaggcccgagtgatggatcctatatattcgtgaggggtgtgaccggtggaggcattgcatcacgtgagaaaccctagccgtcacttccctccccgagcaaaaccctagccgcgcgcgggtgctagcacatctgcgcgtggcgtttcgtccctgtatgtgtggataccggtagaggcgccgctggtttgcggtgctgatcagcgtaggagtacggcaaggagaacgcacgaggaggagaaggtcgagccggtgcgatcgactacttcctctacaacgacgcgtgctacttcgcgagagtttcttcgacttctcagtgtcttcttccgctgcgcagcgcgtcgagtggtaacgatatatgatctaatacttgcttggttcctggtttatgcgatagaaatgtttgatttatgctatcgtagcttacgcttatcccaacagtggtatcagagccgccttgtatagtttatgatctagatcattgcatatagttgatatgcgggtgtagtagatgagatctattatgttgtatatgagttcttaggtgatcggaacatgagatgaaccgatagccgcatgggttgatgagatgaaccgatagtcgcatgggttggtgacttcactggaatgtctagtactcaccaaggctgagcgcgattgtgttcatcggatagtccgatgtccactggaaccgtacgccaatgagaaaaaatgagccagtgagattgactcggtttcggcataattcgattacgccgttaaggttttcacatggcgaatcgtagatgagatctatgtaccccgtgacatggtaggatagattccctcagatctatgtaccgccgtgtgcgttgccccttagatttcgcttggggtttttatatctatcttactttactgctgttgtatatttgatatgacatggtaggatagattccctcagaaaaattaagtgtgatttatgctcttccagtaattgcacctaatacggttgtgatcataagtgatgggtttgtcatagcaaagtgtcactttttatcatgataaaataggatagatgtcggacatctatgtgcggagattattggtttacttgacaaggttattaaaacagttttggaccttggggcataggttgggttggacatggagatgtcaccccaacagcacaagagtcacatatgatgtgattagcaaggtgttgcttacctattttgatagttgtctagctatgatgccaaagctcactagacactaataaaatgaggatcttgactcactatgttactagagggaattttgtttcacaatacatagtggaagtatcttttgttaaattgtttaatgaaaggttaaatgtaaacatgatgctgattttgcatacatatatttctattgtaga

SEQ ID NO: 34035 - DNA, 1501 bp, Oryza sativa
tgtacttctacacacatcatcatcgtttcggttagttttctgagcccctgatgctacacgaggggcacttgtatatactactcctactagtagtatgctcgcaacaggagccgtccatgtgcgtgcgtgcgtgcgtggggagatgcaccgttgcagtggacatgtcgctctccgatccgcggcttgcgttttgcgtacgtgcggttcgggctgtgtctgtggctgtggccaccgtgctctcccggcgtccacgcgcgcttcccggcgcggccagccggtgcatcggtgaatggtttcgtgatcttggcagagatcttttgcatacgtggtggcttttagttccaggtgacacgaaaaggttgaaagcagcaggattccagggagcagcggttcacggtttcgagatcggctcatttcggctcgatgcgttgacatggtggtagagactaatctggggaattttttatatagattttgtttatgaactatctatacggggattagggcaaatactataaacatccaagcacaatctcctaggtgccacataagctaaaatggtgaggtggaggagagaagagatgagagagataagcagccacctctcatgcaagaggcaaccattacacaaaattcaagacaaaaggagagagaggaagagtagattgggcaaacaaacattgaggctagtgtattagaattagtatagatgtgatatattgtatatattacctctatatttattagttgatgatgtggtcaaaattagatgcaacaacctccttttttataaaacttgcacttacgtgaacgggattttgtatattcgtgcacggacagataatggattggagtacaatcttgcttttgtcattcgtgtaggatgactccaaagttagggactcgaggacatttaactatttacttcatccgtttcacaatataagactttctaacatacgttcatataaatgctaatgaatctagacacatacactagaaagtcttatattataaaacggagggaataccgttcctagatctagagcagaatgggatagcccttcagtcatcaattaacacttaatactccgtactatagaacttgttttaattgataggaaacagatcatacgaaaagtaaatttcaaataactacaagtatttattaaaactataaatttcaaataactataactattttactaaaactattagtttagtacaactttggccgtgtttagttttaaagtttttcttcaaacctttaactttttcatcacatcaaaacttttctacacacataaattttcaacttttccgtcacatcgttccaatttcaaccaaattttcaattttaccgtgaactaaacacagcctttagctaaatatttcacggaactgcaacaatagtgtatgactttatcaaaaagcttacattattcacctgaaaagttttgagtacatatatcatacacacatgcaatactttatatcaggg

SEQ ID NO: 34036 - DNA, 1501 bp, Oryza sativa; identical to SEQ ID NO: 33942

SEQ ID NO: 34037 - DNA, 1501 bp, Oryza sativa
ggtcgtcgtgtgcctcctggagctcgtccccttcgccgagatcaacaccgcaccactcgcgcgtcgcctgcaacggagagctcattcgccagcgaggtctagcggactgctctcgctgacctagtcgtcgaactcggtggcttggccgcctccattgtagtcctcgtcctctggcggacttcgcctcgccatcgctgccgccatccaccggtcactaccaattgctatccacctgaagagagagaaaaggaagagggaggagaaagggtagctgacacgtgggcccaaaattttttgtattgttttacgcacttacatgtgggtccatttagatttgtttttattttagtgccatgcatgcgccacgtcgattccacgtaggataaagaccaagtcaatccgccacgtagtccgaaaccactgggggagtcgatttgcaacaattttaaaagttgggggatgagttatacccggttttacggttgagaaatgcaattcaactagagtcatgagttgtgggaatcaaaatagacttatttcctcctttgcatgttgttttggatacgctgggctggcttacggggcagctttaacgggtgtggtttataagccgaagacacgttaaaaacgaaaagtaattttagtgtaggattttataattttttaaatcataatacaaacacaagcgcttatataaatatattcatactcacctctataaactcatacacgtacaaatgtcctattgatgtgagcacatttgaaaagacctgcatatctagatattcacgaaatcactatagacgtcttgttaccgattggtatgtttcatactactgaaagaataattaagtatatttgtaattatatcgtctaaaaaacattgttgataaataaaaggtaatgaaagaaaaatacttgatcgaattaattatgttctggtatgcacaacagctgtgaagtactttgagatactagaattcaaattttaatacatattatagggttgtttattttgaaatggagcggaggtagtgcccacgcaggtacatttttagtaacaattcagtgaggttaactgatttatcattagtcctctatatattatcatgtgttggggaacagtacatatactggtaatatatgggtttgggatgcaactgctacgtgtgtagtcgttttttcaaacatattttatatagtaataatcaaagaaaagttacttttgttcttgaatttaaaattgtctgggccagctcaaacaaataagggccaatggtccaattataattagatatgcatatcttcaacaattaggtctctttatccaattgtacagcgatacttggagagttcgtaggtaccgttggaatgaattatccgcctttccctatcagcttaagcttttgggttgaactggtcagtacatgcaacttaatatggtatcagagccagaggtctcgagttcgaattctggctggcgcgcaattaaataaaataa

SEQ ID NO: 34038 - DNA, 1501 bp, Oryza sativa
tccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtatccgctccatgaacttaaatcctcatgcactctaggcgtccatgtttctagcagtgtgaggagttctggcgctcccgggaaagagaagtctcacacatattaaattatggttcaagttaagttctctctctctcacactcatggcagtcctaccaatggcgacaccgatgtagggcacgcctctcggccctacctcaacggctatcccatcgtagcgcacctgcctcacttaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccaaataccacccaaatcctccgtccgccccagtcgaaaacaattgtttaattttatttctcctttcacaaatcatgtcatcaacatcatggcaatgtggcgctcatgtctccacatgccgcatctcaattaccttcccaaaagtaattgcccaagcatcatttgataaatatgagtatgcatgattctagaatagcatttctaagcaattgtcataattgactagggactcatacgtaaacatggttacgaaggaataaggggcaaacaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttggccttcacttggatccgcaactccctcgggctctatagttatgtgcgaaaattgatttgaattcggttagaattcaaataaaaatccaaataaatccaaatggaagtcgaacgcgtaagtcgattcttttatattaactttactattcgcgaactagggcaaacccaatttcgatttttatatcctaaactattttgcgggtataaatattttgttatcataagtttttaatttaatctacccgagcattatatccatataataggttggaaatttctatcacaagctaaatatcggacggaatcctaaaattatcttataatattatacgattaaattttagtctaggattaaacgactaaatataatatacgtctaaaattcctagtgattaaatccgaatttctaccgtgaatcaattacttatagagattacccaaaataatctataatag

SEQ ID NO: 34039 - DNA, 966 bp, Oryza sativa
ccttataatattggacaaaccaaagggtcatttatcccctgtagttgtggacagagggagtacttacataagcattttaaatttgcaatgcactcttcgcctaatcggtgcgagtaataaccaaagttaaccaacttagcacgagaggtgacgtgtcatccgaccaaccgctttggcctctaccgctagtacttctcttaccactccattcatcactgtttcggcctttcgagcaaaggcccagcttggaaaattatggttagacaaataggccgctgaacaagaaaaatgttcactttaggtctctcttctaataattagttttaaaagataagggatgttttatatccggttttatgattaacgaacacaatttaaactcgatgcttagctgagggatctaaaataaactttatctgccaaacaaccaacggtttgctaattgatggctaatcttgtggtatctgggccgggccattggctgatccaacgttggcccactaatcacactgcgccggcctcagcctcgccgccgccggcggccaccgaagatatcagccatgctccggcggtgaactgataagtagccaggttttggctcaaagatgaaaatgtgttccttgtctgtagcgtttttaccccccctgagaatattcttgaatcgccaaacaattttcattaatattaattagcattcgcactgtcaaaacgtttcaaggggcctacgtttaaccacacaccaatagtttttttttcgcaaacgcgcaaaatagatattacacatcagtatattagaagaaaatagagttgttgttacacaatgcagccgaccagactggtcgttgccagttacaaggaaaggatttcgaacccaaaaaagagtaaaaactaaaagctgttgcttctatctagcgggagggggtggcggaggaggaggagcttcctaatctccaaataggtccccaa

SEQ ID NO: 34040 - DNA, 182 bp, Oryza sativa
ctcggggggactaagaggagggcgaacacatcaccttcgggcccgacgtccctcgggggtgccaggccacgtgtgcgattgtgtctgcctcaaacctctagtcatgatactcctgatcccatgtcaccgacagacggcgtgaagatcagcgaaattgagccacaagaaaccttcctcggcca

SEQ ID NO: 34041 - DNA, 1501 bp, Oryza sativa
cactaaactaaaggaggatcactcctgctaccacatggacaataaacaaattaaaacggcactgaaataccgaattcagctacacacgaaagaagaaaatatctactctagtagcaacttgcaagctttaattccttctcccttaattaacccttcccctttatatatatatatatatatatatatatatatatatatataaactgaaacttgcaatctcctctgcacatattctcagggttcagcctaaataaaaccgagaaaagaaggtgctcctttgtgctctcgtgatgaatctgtcgtgtccatcacgtatagcaggaataaaccaatcgtcttatcctttaacccgtcgtggaacagaatcacgatttcttctttattggacaaacagaatcgcatacgaagtgacgacgaaaagcggaaccaccagaacgatcgatgcatccgcatgatgtggctgatacgaatgatatcacttgacacactcgaccaacggctagctaggcagcgagcggcgatcgacgagcgcgcgcaagcaacggcacagacgcacgcacgcgttgcgcgggcggatgctgcaggagttcgctgcagattgggcgggcgaagccgtggtaaaagctagtactacccaccagctgttccaaaccatctggacgacaccacttgtcaagttgtattgccacgatggcggctttgaacgattgcacgtacgcgaacgcacaacgtcgactcgggctctgttagttttcacgtaaaaacttttcactatgtgacattgaatgtttagacacatgcatagagtattcaatataaaaaagacataattacatagattgtgtgtaaattgcgagacggattttttaagcctaattgctccatgatttgacaatgtggtgctacagtaaacatttgctaatgatggattaattagacttaataaatttatctcgcagtttacagacggaatctataatttattttattattagtctatatttaatacttcaaatatatgttcatatatctgatgtgacacgtcaaaaattttcacctaacatctgtatgaacacagaacacagcctcggtcaaagagaaaaaacgaggcacggagggtaaaaaaggaaaaggggaaaaatcgtggcagaaaggacaggtgaaaaaacggaaacagcgctgtcctgatgtgttcgttcgttggttcgttctcgtagttgtagcagcagagggaagcgtctgtctgcgtcgggtgcgtgcctttggaccggaatatcctggaggataaaccatccgatccgcggggacggtggcagcaaattggcaaatgcgcgcgatggctggccatggcgaacgcatccccaccccgaatattccccattcccgcttccttcctttctccaacgacccacacccaacactcgatccctttccccttcccccgccttgttataaattaggctcggctcccgcttcctcgcgtcgcgtcgcgtcgcgtcac

SEQ ID NO: 34042 - DNA, 1501 bp, Oryza sativa
tcactgagtcactgggtggtttgttgcattgatcatctttataacttgataaagcaataagttaagcaagcattgttcatctttacaacatcaccctttttggatcaccacattccagctctcctgcttttgttatttacactaaagcaaaggatgatcaaagaagcaaacaattcagttttttttttttggaaaagcaagaaacttccttacttgtaagcattgcaatgccactgaaaagtaccagcagtttatggatgctaatgccatcactaatcatccaccagaagcaaatgcaatctactcctactcccccagaaaacaaacaacagagagccaggacagaaaggggcagctcctatctggccagcttttatttagctgttcttcttttggatttactatctttttattttctccagatgaaagcctgaaaacagtagtgagccctctctgtcctctactcaatcctcatcaacagctgccacccatgatttcattatctttttactttccccacattttatatagccactctcctccttaactcccctcctactctcctccattccttcactgccttcacttccctgctcagctcagcagctcaggtcagtctcctcagcattgtttcagctgcaatgccatgctcagaatctcttctcttaattttttggtttccatgagttccagtatgatgtttcatgggttggtcgtcttggaggcagccatttgtttagggcgcatttggatctgttcctcgcagttcttggcccgaggaaagaacagatctttgcgcctctcttgagcttggcgtctcttcttggtgctctgcgtttatgttccttcaggttgaagggaaatgctaatgcaaagcttagcacttaactgttcttggctcccaaattccagagatttggatgcttccagtggtgctgagatctgcaggatgtagtagtaggagtactgtttttgttcttgtgttagattatgtggtctcctgatttggttggtggcacctaacagttgaagtagtagtataatgcagttgtcaattcggactagatcgagtcttgaaagtgccccatcttgtgcatttgtctctcttggtgacagggaaagggccattaatttgtgctaaatttcagtaatctgaaaactctgctctaggagctagaaagatctgaacaataatgagcctggttaaaattctcaatgttcagaattaccacgaactgtagtaatctgaagcacaagaagttggttttctggcatttcagaatacagaacaacattacagatctcttgtatgttgatttgaacttaagtactctactaaatgtgttcagtaaacactgtagaattcacaagattaagagtaattctattcagcagttacagacttgtgctccagaaacgcatgacaaaaaaaattcagtgctgaatgcttcacttcactgttcttgcgtgacatcagggacttcgaggatgatggaatcca

SEQ ID NO: 34043 - DNA, 362 bp, Oryza sativa
aagaattccatacttgctcaaccacagtattaatatcttctctcatgagccaactattctcaaatttaaacagaggagatagccacttttctccctcaacattgatcaaaagaggagtgtggtcagagtaaattctctctaagacccttccacatgccaaagggaacttaatctcccatttatcattaaaaagaattctgtccaatttttcaagagttacactttgtttgttattagcccaagtgaattttttcccttccaaggccatctctctcaagtttgcattctcaattatagaattgaacataagactccatttattcacccctcccctcttgtttttttcattctcttgtctcagg

SEQ ID NO: 34044 - DNA, 1501 bp, Oryza sativa
tataactaagtataggctagttaaggcatggtggcacaagtgtggcttagaaatagttggccataagtgtagcatgcttagctcaaaatttgagagtatgacatgtgggtcccaaggctaagaaattgtggcatggcataattgcggtagcgaaagaaacacatacctaagatattgtggcataactaaagtgtggcgtgccaatgtgtggcaaccaaccaaacacgcttgctgctcgctgacgcgctttccattggcgctttgctcacgccccctgcgctgcacagtggtgcctccacccaccttcgtctattactcatggcatgctagcgcgcggcacaatagatgtggtccaggtggtctttccctttctcgtttttgcggtaaggagagttccttttccttttctaaataaggattatatttttgggcctttgagcacttgagctagcgtgtagcactcataaatcttgggggctttggatttggatgttagatgtattttctttcttttttttggggggggggggtggggggcggttcagttaactcagaaatcgtggtgtcgtgcggcaacctcatcagcgcttgctcgatggatgacagacgaggaaaaggattggaggtggacatcaggggaacgaagtagactcctgtttgggccttcaacatgtgctatacgaaacacaagctgggaaggcgttttgttgacgaatgaaatcataattgtgacaaacagaaaattacaaattttttaagtaggttagattagattttatgggggaaattttggttttgccattgaattctctaattgacaatttaacatgcaaacccagtaccccctggcagtgagatattcattgtgctgaaataaggtgaggggctaaggccggcactactgggtagcagatataagttacttgtttacccattatccttttgttcccacaagcatatacggtttatgttccttcatttacttttgcttatacttggtttgtctttctaacggatctggttcacttgcagacattatgcttcttacggagttataaacatgtcagacatttcagcactaagctacttgaaggttagaaactcaacatttgttagtttggaatcctgacaacctcttagtttgttcaaacctttattttaggtgttcatggatgctcactgccaacttggtaatgatcagagcgagcaaacttcattgtcattgtgtgcctgtgctgtaaaagttgattatttggcacatccttgctctctatggtttggaattgtcactacactttactaaattcatagttcttaacaaaaatgtggcatgtaattcatatgtagcggacgatatttcctttcaaatgcttctccttatcaaccttggactagatcatttgcttcaaagaatggtaaggtacagaaaccctatagatgatataatgtttacaaatttctaccagttaaatgcttaatcaatttttttcttcctttaagg

SEQ ID NO: 34045 - DNA, 339 bp, Oryza sativa
gtattgataatcgtattcgatttttaaaatctcaatgataataaaaaggagaagcagcgagcggggtgtataagagtatagttgcagagccaccgacggttgacgggacttctagaaaataaaaaatgaattccaacgatagttatgttcgatttttagaatcacaatgacaataaagaagtaggtggcgaacatgctgtagaggggcatagtggcatcgtttgataggacttctaaaaattataaaaaatgaaactataagttatgttcgattttaaaatctcaatgacaataaagaatgaattccaacgatagttatgttcgattttaaaatctcaa

SEQ ID NO: 34046 - DNA, 500 bp, Oryza sativa
cggaggaatacccgtactgagctattgccatcagcggcccacctctcatccgcagcatataaccccaaataatgatatcctgtaatctagacaccacgtctaaactaccagatactactctaatatcatcgtcatgacatagagtaattgcatacacaaacattatacctgcaccaaagcatctcccagataagcagcagtatattcagtataacatgaacataatataaagtaggcattcatatactcggaaagtatttcaataccataaatgtataaagaagagtattctaataaaagtacaaagcttacaaaagaggaaaggaaagctactagagtcatacccgaactcttccgaaggcttccggactcctgatttctactctattcttattccactagctagatactactaaactaaacttgagagaatatgagagagctattgcttgaggtgtgtgagtgaagtgagaagagcaactccttttatagcctcccaa

SEQ ID NO: 34047 - DNA, 974 bp, Oryza sativa
cgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaagggaatcggtccttaagtgcgagagcgggaaaccgtacacccggtatgttcgccggtccgcggttttggaaattcatttagttcgcaagcaccgacccaggtgtcgggttttccaagtctgttgtaaaactccagttttacccaagttgttactcagattttaagtttgaaggcgaccgtcgatactcgcacagagtgcacgaatatcgaggcgcaactgggtggttacaaggggacatggtataacagttaacaaaggaaggatcaaatgtaacaaattaggtaggtctgccaatctgccttgcagacgggacaacagattaagtgtgatcctatcaatgcataatatttcggaagcaatataattaaattctaaatagaggctcaagatgttcaaaggtggctggccttgctcgagatccggagcttgatcctcgaaattctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggtgggaagatattgaatttctaagattattggatttttggtctaaaggaaaaaggatttatttaaatccttttttggaaaagaaaaagaaaagaagggagggagggaatatagacttttctcggacggctagggcgcggcctaagagaaatggagcggtctggccgagctaaa

SEQ ID NO: 34048 - DNA, 164 bp, Oryza sativa
cgttaacgtgaaatgcaatatatatatatatatatatatatatacatgtatatatatatatacatgtatatatatgtatatacatgtatatatatgtatatatatatatatatatatatatgttacttcgcatttatcctaatacattttttttatcttgcaga

SEQ ID NO: 34049 - DNA, 1501 bp, Oryza sativa
ataggagccacaaggtccacatccgccacctccagatctaaatcgaggagtagaggatgggaaggcaaagcatgaggaaattctgcaagttgctgaggagaaggggaagcaggggaaggacacgctgaaaactgaagggaggaaggaagcgggtccaaatttgcaggaaacaagtgctaagatggattctatcagttcaggattggaagcaaagccaaattagcaacaaaatcgagatgagtccaaacattaggttggtgaatcccattcccagcagaggattttctgttctaaatgcaggagttacagtcatttgtctagagattgcaaattgtcagtgttctgtatgatctgtgcaaaagagactcataggacagaggattgctttaggaagaatcagaagaaacctgtagctaaagtagtgggatgtgctgccccaggtctggctgtgtgctgattcagagtgctaagggtatagtgcaaaaagaacatgttaaccctttggctattgtgacaattatgtgggtaggtgatcttactgagcaggctttggaggaaggattcactcaacacttcaagtggaactggacttggaaggccaggatgcaggagaaagggttgttccatatgagattcctaaataagatgaaattggatgagttagctgaatttgactcaattagagtaaaaggaacatctgtacatgtgaaagtgaagaaatggactcaagaagctgaggcagtggggaggttacatgaagtgtgggtgactgtggagggggtacctgatgaaatgaaggattacgaccctctacatgaagtgggttctaatctaggacctgtgatagaagtggatatggtagctttaaagacaaaggatgtggttagaattagagtaggaatgatgacattaaaaagcttgcctctgaccatgactctgatgacacctaagttgctggtttacaaagctcatttcaagttggagcagattgtggagttgggatggtttagagattgtgcacaggaaaagagagttgtggaggtggaggagcaaaatgaacctggcaacataaatcacatgcagaggaataagaaaccaagaaaagaagaagctgcatcaaacatgagagttttggaaaaggcaggggacaagaagaaagccatagttgtggaagaggattcagacaatgaaagtgctcaagcagaattggtgaagctcaaacagatggagatagatagggagatggctctgagagtacaactagaagaacattttaaagtcaagcagattcaacttgataaagatgtagcaggagggatgatagagggtggaatcagagaagaagcacaggctggggaggaggaaaatgagaaaacaaagaagacacaagaagggatggcagataaaagtggtactagccagagagtggaaaatgacagtgaggaggtgatttatgatgaagatgaaccaagagtgcaactggtggggagtgaggagaaca

SEQ ID NO: 34050 - DNA, 529 bp, Oryza sativa
gctagcttgcgtagcaagagatgcccgtgttagatttaattgggtaattgatccattaaatcaattaaatcaaataaattccaaggctcattatgctaggaattcatgtgtattcattcttttatgggatatcaatgggatgaagagttttgagaattaatccatttgattagggaattgataacttatatcaattagtcctaattgatggatggttgatggttgtgtagtggaggatggttcatggctagttgatgacaattagttgctctattcctcttcctattccattggtaacttacatcaattactcctaattgattgttggttgatggttgtgtagtggaggatggttcatggctagttgatgacaattagttgctctattcctcttcctattccatgactcttactcttcatcttccattcctcttataaaatgagaatggatttgatctcccgcgagaacagtcagacacactttcatccattttccaatgttgttgttgctacggtaatcccatcccga

SEQ ID NO: 34051 - DNA, 541 bp, Oryza sativa
tatgtcatacttaaagaacatttggtgataaatcaagtcgcattgaaataaatgataattacataaattttttgaataagacgaaaggtcaaacgtttgtcaaaaagtcaacggtgtcatacattaaaatacggagggagtattatgcataagccagaggtagtgttggtattgtagcctctcttgcgctgtctatatttgcctcgtgggttcttgctatcatttcttccaactaaagaggagggatgggtgtacaagcaaccataactaccacgaactgaaatattataaggagtgaagatatgtcttgctctagcttaaatatgtcataccgatagataaaactgaatttgtaaagcatggaatttgtatatctttatttttacaggtggagctttggattggagtatttgagacatgattttattgtccttttaggaatgttgcttgtatagtaacactaaaaaacaaatagaaattattttcaactgtattatacatgtgtggctaatcaaacacacattttaaattttaactcagg

SEQ ID NO: 34052 - DNA, 1501 bp, Oryza sativa
tccattccggtccatgtgtctatggcgatcggccttctagcctgggtgatcaaggccattgacaagaagcatcgtgccttcttgtggacgggcacggactcggctcacggtgggcagtgtcgggtttcttggacgaatgtctgtcgtcccagagctttcggtgggttgggaattcctgaccttaggttggcaggtttttccctgcgtgttcgctggctttggctccaacgctcagggcatccctactgggatagcctgaaggccccagccgagcgagccgtctctgacatgtttgaggcgtccaccttcttcgtaccaggtgatggtgagtcgattcttttctggtctgaccaatcgatctgtggccgctcggtagcttccttggctccggatctcctcttcgctgtgcccccgcgtctgcatggttcgcgcaaggttgcttctggcctagcaaacaacgcctggatttctgacatccgcggcgccctcattgtcccggtcatctcccaatttcttcttgtttgggatgcggtgctccacattcaacttacgccgggtgtcggggatcgtcttttctggcgttggacgagtgactagcgctactcggcgcgttcggcgtaccaggcgttcttctttggccagcactcctttgcttgtgccgatcttctctggcacgcgaagggccctgctaagtgcaaattcttcctctggtttgcatttcagtagcgctgttggacggctgatctcctccagaagcgcggcattgatagccactcggcctgccccttttgcgctcaagagcttgagacggcgaaccacatcctccttgactgcgtgttcgctcatcaggtctggttacgggtgttgtcgtctactggctgggctgccctctctcccctccgtggcagctggctacaggattggtggccatcttctagggcttgtttacctgatcatctctgtgccagcttcgactccgtagtcctcctagtctcatggcaactgtggaagaaacgtaactccagggtttttgactctgtgctctctttggtcgcagtggtcctagagtccatcctttcagaggccggatgtggtcattagcggctgtcgcttcctttggggaattgttgagagcgtagagtggctctgccccctctcgctgtttggagtagagttaccgtcgtttcgagttcctttcctttctttgttttttatctttatttttcttccttccttgtcataggccggtctggctgagtgcgtcgtgtatcaaaattctattcttctaatatattgacgtgtaatccttttgcgcgttcgcgaaaaaaaaaatcttaaatcttgtagaattttcgatcaaatgcaactactaaccgctacttacaacataatagtataattgtaatgcactatgcaacccggaactgatagtgaatgtctcccgtccacccatccaaccctcatcctctgtaggcaagaactgacgctaataacattttat

SEQ ID NO: 34053 - DNA, 1501 bp, Oryza sativa
agaaagctttagctccaggaggttcctgctgccgtgctataaaaattggcccatgttttcttctgcggagtagctagcttgttctcccagaccctccctctgcaaaatgtgatacttctagtataataaatttaaatatacttatatctaaatttattgtaagatgtcacattttgtcataggttaattttttcatgtgacataaagagtatgttcccttttttaacagaaatggtctatggcccagcctgctaaagatagagattaagtatatgtatgtcaaactaaaaaactattagtaagtgaattagatttaattattttaaatttaaaaatgcgtttgtctaatattatagagaaattactatataaaaagttttttaacatttagcagtttaaaagcgtgcgaataaaattcaagataaaatctatatgctcgataatcttctttttattcttaatcagaaaagatatcgtcagtgattttaattttttttaaagagaatgtatgtcttctccaaatgaccaaaagatcaatatgacttccatttcactgtaattatgtctaaaaatctctttcctaaatttctttttgagattatttgatgaagacttatcaattaaaaacttatttccttccaatagatggtctatatttaattccctaaaataaaaggtggacctcccttcatccgtgccttattagatcgtgtcatctggctccgtgatcgcccatctagcgtcaccatcctgctcgtcttctcgagtggcagtttctcttaagagacggaaattgggatcgagaacaatatctgacttgtggagagcgagaatataaaggaaaagggaatgctgagttttgagagggagagtagggaattgttgtagtagttttttcgattaaattcctcaaaatcataattgggaatggagtagaatgattctctgagcataaaaaaacagctccaacagatcctctactctcctacccgagttttggagttcccttctcccgattcctcgctccgtttatatgcgggcgcggaacttgctcctaatctcgcactcccgtctctctccttccatgcctgcgcgtgggagatagcgatctttctacgtgtgtaagaaaaaaatagaattttctattgatagtttaacagaattgcctatttttaagttttggggattgaatttaggctatctgttaaagggaggagttttttcacttcctattttcatttaggaaaccaaaaacaattttttgggaaagattataggtaatctgttggtcgtcatctcaaaaatctatcccaaaattttagttatgggaatcctaaataaaatttgaggtcataaattttttatctctcgaagagattggttaagattggtttcccaaaaactaaaaggacgttcgctcacgtgattgggagccaaagtgcatccctagatgtggagaacaacaattgcgggatagaaaatagaaaatattgggaatgtg

SEQ ID NO: 34054 - DNA, 239 bp, Oryza sativa
gggccaacaacttttaaacggccacccgggccaacaaccttcaaacggccacccgggcctagctgatcccatcagctgcagattttccaaacatcgatcccctttccacaacagcaaatttcacaaggcagtagtcaaacaaaactacgctaggaatcacctcacatccgcccatgaccgtgggcacggctgttcgaacagtttgttaacctctgcagaggtggtacactttacccaca

SEQ ID NO: 34055 - DNA, 289 bp, Oryza sativa
aatatgaaagatcatattttgaaaaagagatggttccgaccaaggagtgagatgaggttttaacttttgacgtcttcgtgaagacgagtgaatttggttgacacaggagccatattaatattttcttcacaaggctttctccattggaaatggtagaattgtttggttatcatacggaaatgtagctctaaccagagttcccattcaattataaattatttctggttcaattgtatattttattttgttgccatcctgtaaccaccacctctgtttatcctgaaccagg

SEQ ID NO: 34056 - DNA, 573 bp, Oryza sativa
gcggcggcgacattcacgctgctcctcactgggctcctactgtggtgagaactgagaatgggatagatctgctgagttaaacctatgtctttctttacactaggtgggtaatttgattgtggtttctgtaatttaattttttattttttattttttttacttctctctcttggtgatttatgtatcgatcaggtataagaaaaaattgtaccaaactgtaaaacatgggcaagtaataagcaccagtacagttgtactactacaaatagatggatctgctgattaaattttttcgtgccaaagaaatactatatgttcactttggatcatctggttgtgtgtcggtaacaatgtgcagccacatgtcatttcaagccagcttgtctctttacaaatgatagattgttctgcaaatttttaccggtgattgctttgcatcagcaattcagccagcaacttctgaacagataatgtttctgatctgagcagcaactaataggcactttgatctgagttagtcagaaggatcaacactgtttcttctttatcgttttatttatggtttaatcaaga

SEQ ID NO: 34057 - DNA, 306 bp, Oryza sativa
ccgaccccctcggggggactaagaggagggcgaacacatcaccctcgggcccgacgtccctcgggggtgccaggccacgtgtgcgattgtgtctgcctcaaacctccagtcatgatactcctgatcccatgtcaccgacagtagcccccggcgttatgccagggcgatcgccctctttaagggaaacggtcgggcatgacgccactcctaaggcctggtgacaggtgggaccggtctccacaattgggcagaaacccaacggtcacaaaccacgcacatcggcaatggtaactcggctgtcaacaa

SEQ ID NO: 34058 - DNA, 1501 bp, Oryza sativa
cgacagcccagtcgaaccggcctctacctgttttggagctctccttttttttttcctatcttggataagagcatcaccaatagcatcttaatatccggtaatttaaggatttgtattgtcaaaaatcttttccaactaattccctaatcacattcccaatattttctattttctatcccgcaattgttgttctccacatctagggatgcactttggctcccaatcacgtgagcgaacgtccttttagtttttgggaaaccaatcttaaccaatctcttcgagagataaaaaatttatgacctcaaattttatttaggattcccataactaaaattttgggatagatttttgagatgacgaccaacagattacctataatctttcccaaaaaattgtttttggtttcctaaatgaaaataggaagtgaaaaaactcctccctttaacagatagcctaaattcaatccccaaaacttaaaaataggcaattctgttaaactatcaatagaaaattctatttttttcttacacacgtagaaagatcgctatctcccacgcgcaggcatggaaggagagagacgggagtgcgagattaggagcaagttccgcgcccgcatataaacggagcgaggaatcgggagaagggaactccaaaactcgggtaggagagtagaggatctgttggagctgtttttttatgctcagagaatcattctactccattcccaattatgattttgaggaatttaatcgaaaaaactactacaacaattccctactctccctctcaaaactcagcattcccttttcctttatattctcgctctccacaagtcagatattgttctcgatcccaatttccgtctcttaagagaaactgccactcgagaagacgagcaggatggtgacgctagatgggcgatcacggagccagatgacacgatctaataaggcacggatgaagggaggtccaccttttattttagggaattaaatatagaccatctattggaaggaaataagtttttaattgataagtcttcatcaaataatctcaaaaagaaatttaggaaagagatttttagacataattacagtgaaatggaagtcatattgatcttttggtcatttggagaagacatacattctctttaaaaaaaattaaaatcactgacgatatcttttctgattaagaataaaaagaagattatcgagcatatagattttatcttgaattttattcgcacgcttttaaactgctaaatgttaaaaaactttttatatagtaatttctctataatattagacaaacgcatttttaaatttaaaataattaaatctaattcacttactaatagttttttagtttgacatacatatacttaatctctatctttagcaggctgggccatagaccatttctgttaaaaaagggaacatactctttatgtcacatgaaaaaattaacctatgacaaaatgtgacatcttacaataaattta

SEQ ID NO: 34059 - DNA, 233 bp, Oryza sativa
cttcagtgcctttatactcttgccaacgctgtgcccggctcctcgcttctcgcgccctctatttcgccccctcgtttctcgcacccacgcttccactaatcctattcgcccgcttgcggcgcatgaggtggatatgcggttgtggcagtcgagatagatcatatcgtgcgcgcgctaattacgctcgccgaccgaagcgacgttaccatatctccagatgaaacgaatcgcca

SEQ ID NO: 34060 - DNA, 1501 bp, Oryza sativa
tctcaggagttggcatctgggtatgcaattgggaactctcgttgattagagtgcagatggtgggaatatccactgaccggccaagctgctacaagataaaagcatgaaaggataatagctaggtggaggctcctttggtcaaaagaggagctcttttgagtggtggaggatatccgcttctggagaatccccattggctaaagaaaagtatttgtctctctatgtgatcctgattaaacctcatcctatattcttgtttgctatatttacccaatagaaaatttatgtggctttcagtacatgttacagtagaaattttctgcaagttggagatgtctgcccttggatttatgcagacaaacaaagggtttgtttttgagtatggaaaaaagggtttgcttttcaggcatgtaaaggtgtcattaattaatggtgtaacaatgcgattatctattaagtaactccctccgttcctaaatataagcgattttatttggatgtgacatattctaataaaatgaatctaaatattaagcctgtccagatttgttgtatcaggatatatcacatttaaccaaaatcatttatatttaaagacggagggagtattacacagctctcctgcacattcgagaaaaaaactgtcaagttatcattgctactttttactaggagaccgattaagaataaaaaaagctatcaaatatgtgaagactagatctaaaaaaatatctaaatgtataaaaataattactagatatacgtataaacatgaaatatattcccaccaaatcttaagtttagtctcaactttatcaaaaaggaacgaaaaagacaaatttatggtgtcatgttactgtccagaaatttatctttttatcctccaaataaagttgagttcacaattaagatttgatgggaatgtattttatgtctatacctatctatctctactaatgtttttacaaatttagataacttttaggttcggtttttaagggttttttacttttttgatgatttcactacatattttctcatacaagatataccatcactactggagaaaccttctttgcccggtcagccaaaaaccacaatagtcccggttccaataaaaaccgggactaaagatggtttttagtcccagtttataagcagaatagaactatgtgttttttagtcctggttggtaacatcatctttagtcccggttcatgtgctatctttagtcccggttcatgtgctgtcatgggctgtcaggcccctaggggatttttggtcccggttggagactctaaccgagactaaagatcttatatttagtcccggtttatgttaccaactgggactaaagattagtccaggttgataacacaaacttggactaaaattcgatgtaccatatataatccctatgacttatcctctcaaactcctcatcttctatttttactctcttattcttttctttgccttatcctctccttccttcaagcct

SEQ ID NO: 34061 - DNA, 1501 bp, Oryza sativa
gatccagtcgaccaaccggccggtgcgatgttgtcctgagatccagtctcgtggaatatgttcatttgagatcctttaatttgtcgtggagtttaaaattcatccctcaaaccgaaatatcagatttgttaaatctcccaactcacactactatgtcaactttaacctcttattgctcccttcgttcctaaatatttaacaccgttaagtctaacttctgggcggtggacttccggcggcccaactgccactgcaacccgacggcgccggtgacatgctgtacccggcgtgcgtgacggagggtgatgagggagaggcagatatattgccaaaggatcaacattggatacatggtacgagttgggggatggactatatctaatatttcggtttagagatgaacttcaaactcgaagataaatcgagagacctaaaatgaacttattcactttcttgccctgttcggtggtgaattgggccgcttgaacttgaagcaatgtataaatgggctttgctttcctggagatctttttttcttctcggatatgatgattttcataggaagtattttctttcaaatagttaaaatttggatttttattgacaattaataaaactataagtatatttattgaataaaaaataatttgatagattaatatcccaaaaatgctgttaaacatatttttcccagggttattaacaatctattttataagcaatcgatggttaaagtctaaaccagaagacttcttaaaacaaaactactccttgtaaaaatcaacatatttaggagtagtattttataacttcctaaagctaagcaaataaaacatcacgcaagtggaattaaatcaccgcgagtctataattaattggcaatatttgttttttctggggtcacaatcacttttcttatccacctcctccaggtctgacattagtcttgggagcagtcgagcagatataccttctctggatgactgaaaggaatggaagattaacttaacagtttaattggtctagccctgagcatgagtttgtcttgatttataaagtctgaaagccattgacttctctttaagcttatcattacacagaaatgtctctttctcgtcgacctgttaaacaccttccatcctgtcggtcgagtttggtctcctgaatttgctctgaaaacttcccttcactagaaactatactcatgtcagatcaaattctcctctgcatcagtacacacctagcttccctgttcttcgtactgttcctagtactacttgaaacaccgctccatgaagaactggaatttatcccattggtctgtcaatctgaactgaaaattcagcaaactgcactggatatataaatgttttgcctccttttatggacaccagtttcttccttgcaagaagcaaaaaaaaaaaaaaaaatcctcacgttctagatttcagaagataagatctctagatttatgcgatgcaaatcagatgtacatatattt

SEQ ID NO: 34062 - DNA, 232 bp, Oryza sativa
agagattcgtcgctacgctactcgtcgcgcgcgatcgaagagagcaacgggcaccatcttagcggtggtggtgggagctagcagccgatcgagtgccggcacgccgcgctatcgggtagtcagggtcaaacgaacacacaagggctataggataggataggagagggacacatcacgcactcgtcgcgcgtgcatggggccggtatagcgcgcgccgtgcctccgccgcagc

SEQ ID NO: 34063 - DNA, 1501 bp, Oryza sativa
actcaaaaacaaaccctttgtttgtctgcataaatccaagggcagacatctccaacttgcagaaaatttctactgtaacatgtactgaaagccacataaattttctattgggtaaatatagcaaacaagaatataggatgaggtttaatcaggatcacatagagagacaaatacttttctttagccaatggggattctccagaagcggatatcctccaccactcaaaagagctcctcttttgaccaaaggagcctccacctagctattatcctttcatgcttttatcttgtagcagcttggccggtcagtggatattcccaccatctgcactctaatcaacgagagttcccaattgcatacccagatgccaactcctgagagatgataaaatctatctgaatatatatataaaccatgcaaccacatccagggacccaagagagtatattttttgactagtttggctggagaaaatgaaatcctcaattgtgtgtgtatggagaaaccgatcatctatgagaatctgtgtgtaattgcctgattaagctcaaacccattatttgacagttgacacacacattatatagtaagataagatgatatacccaaatccgaagatgaagggaaaaaaaatcttatatataactgcaacactaggctagcagctccatcaatttccagctcataaataaatttaccacaaaaaccgtaaagtggtatttccatttgttcaaccaaaaagctttcttcctcctcatcagctttatataggatcttttgggaaaaaaaatgttaacacatgcggcatttctgttcttccaaaaagcccaaataactgctacaatgcccactctccctactgtgagttattgatgattctcactgactcgcacaatgttttggcctaaacttaacattccgacaaagaccacatatatagcaccatatgcattcggaaataccaaaacgaaacataatccagtagtatatcgagtcccatggaaatcgattgaaagcagggattcctggttatcccatggcaataattgcatctacgtactgttgatgatgttcatatgtagaaaacgatataactgaaatgttccccggctgacatcagttctagattttattagattctgagaaacgactgatgagaatctgagaaaaaatagacttttctaacttttctatttctcgtttattttatagattttataagtacatattattaaaatctgtgtgagaatctgaaactatttgtcggagctagagatttattatgaaagagcttctggtttttaagttcgctttttagattttgttactatatactattggaatctatgtgagagtatgaactatggccctgtttgaacttgctccaaataaagattaagtatgagcacgcaaaacgagaaatacattaatacatggttaattgagatttaatgatttcaaacttgagaaaatagatttatttgatattttagaacaatt

SEQ ID NO: 34064 - DNA, 261 bp, Oryza sativa
tgcatgactgtgttttcttggacaaaacatatgtgcagattttgctggaagtgttgtaacaccatttttacatttttttataaaacggacgggttcaggggcacaatgtgatctccaattctccatatattcttttgaactaaatgccagcatgctgcaatggaattcaataacctacaccataatttgtaaacttgaacaaaatcttaaaactcgaatacatgatttgcatcagaccaaccagccacttgcatataaaca

SEQ ID NO: 34065 - DNA, 1501 bp, Oryza sativa
gacgaggataattttgtactcctataggtgtttttaattatctttttaccgtagtactagtcaattgggtgtcccacgatccactgggaccagctaatgcaaatggtttacgtgagctaactagccgttgctgggaaggatgattaattttcaaacgatttttctcatcgagtttaattaaacgatgttttatagagaggaaagggcaaggacagttcgggattatagagtcagtgataggagcttgattcgatggtcatatgaattcatgacaattcaagtgctaaacaatactaggcatggcagaagttttctttaacccatgaaatattgaattatcttttacagtacacttggtctatagaaagttttttgctcggtgacttcatattttatttagataagatatgtgagtaatttttactgaaagagtttagcttcttgctttccaaggtactacctctatatcagaatataaggtgatttggctatataattacgtggacaaaaccttttatatatttaaaacatgctagttgtttcttgagttgttttagctcatattcacgtgaactatagtacatttttttaagacaacgcactgtatataagcatattctctgactaaactgtataagcaattgagtcactgacatgtggtttcactttgccatggcccatatgtgtcagtgacttgaatccttttactagtagattactacatagtttaaaaaaaggaagtagattactatcgtgtcaccacattctagcagcaacattgcatcaggctattcccaacctaagacattagatataatttttataaacttcacattatcaagaaactaatacttcatccatttcatattataagactttctagcattgtccacattcatatatatggtaatgaatctagacatacatgtgagcctaaattcattaacatttatatgaatgtgggcaatgctagaaagtcttataacctaaaatggagatagtactagacactactctttcaatacaaacatcacttttccatacttaaatttaatgctacttatctcacatgatgtcttgggtattgtgtagaaatcatgtctcatgcaaagacctagtttccttctctttcctcatttatcacttgctacatcatctttcatcatagatttttaggtgacagtttatttaatgctattgacactattctagccattgagttgagaatgggctcagagatgccatggttgacccttttctagttgagccaaattgaatgaagtgtgcccttcactagaggcgctctcccatgccacgtcatacggctggcccccacgcccccgaaaccagcggggcagccacgtccacctgtccctccacgcccctcccgtgccgtcaccccgtcaccgtccccaacccatccaattccatctcaaaacggaaccggaaaatattagatcccaccacctcccccctccctctccacctgccggtcgtcacc

SEQ ID NO: 34066 - DNA, 1501 bp, Oryza sativa
tgatgttgattttgtttgcagtccgatcgatctcgctcgatctgttcgtttgagacgacaggaggcactggcgtcttctgagaggattgttttactgtgctcctaattaacacatgattgttactgttcgaaatgatatcgcacaatgcacatccttagtccataaaagtattaggttggtacttgtccatgatttattgctgacttctcttgatggaagttagagtatatggattgcagagaaagtgtggacaggctaggcttaacaggcaatacaatcatggagctgggcagctggacttggccatataaagataagtagataacgacagatcaagaactcttgcccgggtcatcatacgaaactagaggaataaagattccatgagaaaaatcgctgttcatccgttccgataataggaatggaacaatgaagagggaaaagatgttcgttcagaaatgaagtgagagaagataggaaaagtctcgcgcgcatacttacagttttgagggaaaaaaagagcagcaagatgaacatccggtgaaacactatttttgtatatggttgaggcaaagtggccaaccagttcgtctccctcctcgctgtgctccgcctccgcacttctgccggccggctcgcctccccgatccccgctgctgaacctcgccgcgcttccgccgccacgctcgagctcgccccaggcggctgtggatctcatccatccatatatctcaagcaggacattttgccagccactgattggtccacttgtgtattctcagaaaaaaaacaacccgtccacttgtcagttgtcactgttagaattgaagataaatcttgaaattacaaacggtaaaaaagaaaatgaaaaaaaaaactccctgcactgcgctacttgcctactctcctctttctcgctatacgcacatacatcagtcattgaaatgtggactaaaatcaggttcttggtccttccaacggaatcaaggaaatacaattactcaagaaaaagataaaaatctagagctttccaacatatacctgataaaaaatcacacaggaatgtttagcttatattcatatggttatctaaatcgcttattagcaaataaaaaattattcatgagtaatttttttatatatgtatccttagagactcaaaagcaaatgatataaaataaattatatcaaattcaaaattaaattctaaaattcaaaatttggcttataaggataagtataagccaaacaataaggccgtaaaagaaccggtgaaaaggatctatctcaatgtaaaaatagatagggaaaatagaaacagatctgaacaggaaaaaaatattcctagataagaaaaacagaaacaagcggtgtatcgtagccgccacaaaattggagacaacgaagacggtagccatgacattttccggatcctttggaagctgttcattcaggggagcaagggtatcaagtcgtcgacgactagccgtgatggtttat

SEQ ID NO: 34067 - DNA, 1501 bp, Oryza sativa
aatatatatcaaaaaaaatcgaggtgaaggtgtcatgttttaggtttttatgtttaatggagcagtaggttgtcggctcacgcttcttgtgttcgttatttttaatatgttagtatgttactctctttttttttacacgtatgcttacacgtcaatacactcttaagtgcgccgcataataatatggtcacatacaaattccaacctattgaagaaattttctcaaaaaaacatattaaataaaataatatggattaattaaaattcgtaataaaaataaaataaaataagtaatttggtcgcaatacaaaactccaaaataaaataaaattttcagtaaaattcggaataaaaaatataataagtccccatgtaaaatactataaaatatcaagagtccatatcaagtggtaaattataaaattcggaataataaaataaaatactattactttatgtccctctttgtgcaggtttattagcttaatagaattcggtcaactaatcatttgaccggccctgctatataaaaaatatattaaacagtgttcctccagaagtagtaaaaatcgtacagaagcagcagctgaatattttggatagatacagccgctgtttttccataccgtactacgtactctagctagttgtacgtgtcaagttgtccttcagttttatattattagtcattttaattttatttcttagttatttttttttgtgtttgatcaaatttataaaaacaatacagtggtattttcaacataagacaaatatattatcaaaatatatttaatattaaatctaataaaactaatggatataaatattttatatgttgctaaattttttaataaaaaaaataaatttgtcaaacttactaagatttcactatgaaaaatatcaaaacgattaataatatgaattagaaggaatataaaatattttagccactgaccgcggcctgtctccactaactgttaaaaattaagacgataaatataaaaaacataacccaaaacaaaaaagaatttttcaagcgcatgcgtacctggcgtaccactctttggcacatatatatatccgaacaaacaaactactcccttcatttttttaatatataacgtttttaagatacatttaattatttaaaaaaattatataattattatttattttattgtgacttgatttatttttaaatgttagatatgacttaatttattttatattttgtacaaaagtttttaataaaataaatggtcaaatatttataaaaaaaagttaacaacgtgctactccagtagtaccctcgacgtgtcgtcgtcgttgccctgttccattttacatttttacttgctctataaaataaaccacgcgagaacgcacatgatgctctttcattagatgacccaacaaggcaagcaaactaggcttccgtacacacgtgcacacattggtgaaaaccaagtagcgctccattaacatgctgcgtcctccg

SEQ ID NO: 34068 - DNA, 1501 bp, Oryza sativa
attttctattttctgtcccctgttccgctatttcaagtgtggtacttaatctctccctctagattcttatataaaaattttgatttattttggaagagatggaataaatcctatgaaaattgaaatcctataatttcttatagaattcctataatcaaaatagcccagatcatccttctaattccaatagaggaattgaacggcccgattcaacaatgaaatgatgaattgatactccggtctggctatcaaaccaactgctcgtaaacaaaaaaaagaggaaaaagtacgatactccggtccgcctccggcccctcgtcctcgccgctgtgcgcgtgagagagagatgacatagagtgagagtgagagtaagagagagaagagagtgggtcccacattttttttaatgaatagaatgctgaccggactgccacgcgtacgccacgtagaccaaaaccaccgcggattgtgtcgagaggggtaattcgtccggtttgcatagttgggggtgaggaatgtccggttttgtggtttatggggtaattcggttaacaacgatagttcgggagggtaattcgtactttttcctaaaaaaatcgtgaactatctctatatggttatggtcttgcatatatgtttgatcatcctgttttcttcaaaatctcgaaagtcaatttcagatgatatgaaataaccataccaaagggcaagaaaacgtaagcgagaagaaatgaaagcgagggagatatacggatttcaaagagtaaaaccctgccatgctgacgagttgaaccagggtatgtttaattcacgttaaaattggaagtttgattgaaattgaaacgatacgatgaaaaagttagaagtttacgtgtgtagaaaaattttaatgtgatggaaaagttaaaagtttgaagaaaaagttagaaactaaactaggcccaaatttgaaaagcacaacaatttgtacctgtgtcctctcgtacgttaaggcgcccttcctgtttcagccgccgactagctttactcatcggagacgacgcgacgccgatgtgatggacattcgcgccggcatggcgaaccaacctgaatacgcgtgagaggggaagtcaactcgggaggggagaggtgacgaggatagcagttgatgatatgcttcctctttattttagataaattaattaaagttgtttagcggcgagcctgggaggctgggatagaccgatcaagggatttaccatttgtccagcttcagcagggaaagggctgagatcatctaatgcctagtacaggacaaaaacaaaagtataaacaatgttgttaggtttcgtttaagaacctgacttgaattggaactttaggtggtatttggatcatttagatactaatttagtctattaaatatagactacttaaaaaataattatataaataaaagctaatttacgagataaatttttaagcctaattaaatagattcgtctcgcgaattagtcaaaga

SEQ ID NO: 34069 - DNA, 1501 bp, Oryza sativa
taaaagtattataggcaatttgttaacacaaataaaagtattataggcttagtacaatgttcctatatattaagataattaagaggggaggtgtcaaagaaaaacggtgtcgccatgtagcccagaacccacctaggtatctgatagaacaaaatggtttagaaatgcttctattcatatattaacaagaaatcacattgaccaaataaagaatctatgacgcttcacgtaccattatgtactttctggagaaaaaagatttacaataaacaataaaattaaagggtatagaagtaagtaggaaaaaaaccaatatcaaaatcgtgattctaagatgtgttcctaataaaacatgtgttttctccaaacgatcacaggtgtgctcgactgagcatgaaaacaaagaaaatgagagtgagaactaagtataaaaaaaggagtgtatgcaacaaaggattgatggaacaaaaatacaattatcatgaaatttatgaaaaactcctcggtagaaaagaaaagggatagaaagtaaggaaagggaagatgggagaaaacaaaataatgagagaaaactaggggtttgaataaaagtagatttgtgtcttgattttacaccctatttcttagcacttacatatcatttttaggtatatgttagattttagttttcattttttaaaatattcatctgatcgaaactatgtattgctaatactcgatgttacacaggctaaatacccagcgtgccaacgtgcgcgctgattttctagtctattctatcagcaggccagcaatgtttggtatctaatgggcccgtcggaccacttatcggaggacttgacattgggccatatcacttactgggcaagattgggccgatcagcgtattgtccatgaaggctggagagaacgacgaaacggggctccaaaagcccgcatgtgctcataggtcgttatggccttatgggccttgccggaattagccaattaggccttacaattccaacgtccgacgtcgtctattagagacgttcagctcatctcatcatcccccaaaggcctaagcccccacgatccccatgccgccgtgcagcgcactcgtatattccacgcgacgcgagagactcgaccgagtccaacacgggcgctgcttttgaatcacctcgccactaactttctacggtttggtccaggtttaatgatggcgccaccgtttcaaaaggcgaccgatcgatccaaatcgctagctcgtccatgtacgctgcacgcgtatgcctacctacgcgcgcgcgcgcagctcgtgcatgcacccgccttgagcccttgacacgtcccagctcaagctcaagagctttgaacggttgatggttggcgcgcggcgtggtgttgtaacgaaccatgattttttttttctcccttccttcggtgcggtctggtcacccagactggcgcccatcggtcggtcgatcgcctttttgacggagtctcgcgcgcgggccac

SEQ ID NO: 34070 - DNA, 1501 bp, Oryza sativa
gcttggcagtccctcttcctatcttcatccccttcattttccatgagcacactttccaaactgctaaaccatgtgtttttttaaaaaaataatctgtagaaaagttgatttgaaaaaattaatccagttttcaaatttttatagctgatacttaattaatcatacgctaatgaggctaagttctagttataagcattatatgcatccataaatttaagagacttcatgttagtaaagtgaaaatttgtctggttactcttagcattttagtacatgcctataaattcttgtagttataattgagggccctttgaatcgtaggaatggaaaagcacgagattctaacaagaaagtaagtaagtgcaatacagaggattgcaacatgtcagaagacacaaaaatgaccgtttgattggattgcagaaaaaacacaggaatcagatgagaaagatagactcaaaggaaatttttttcaaaaagttggagctcttgctaagtttttctctaaaatctttatgggattgtccattccatatataggaatttcaaaggatagaatataattaaatcctttgtttcaaaggccttcatatgaaattttccttcaatatttctatgttttttttctacaaatcaaaggacccaatgatcttccttgttggtgattgtaggaaatccaagcaatatatcaagggtttggagctagtctatccgaagtgagaaatgctaccactaaagagcacacaccatatatgatggcataatattgtttttgtagagtgctccaatatgaactagcaaaaattgccaaatattcgaaacctcaaagaagaactcggcatgcgtcgtcaacttctctctctactctatttgcagttttccacctatcacaatatacatcctagtattgacattccaaactaggattgaccctaggttgtaaaaacttgtttaattttgcaagatagtcacagtagtcaacctagatacactaggctatctcttatataaattgcaactaggatctaattgttgttcttagtttaaaaatccctattcaaccctaagggcaatcccaacccaccattgatgggtagtgtctagaggagagaaagcataataatatatatgttgacactatctcccaacgcatagtgtccatagcaatttctgtagagaagaaaatttaataactctttacatgtcatgtaaatggagaaggatcaactgtgacatgcatcacatacatccaaagatcaaaatcagtagctacattgtactgtatgtgtcaaactatcaacatatgagcatatatcagtgctaatctgagtaaatgagaagaaactaacacatatcagtgcatatacgagtagaaactagtagatatatatcaacacaaatttccatgttcatacatctcagtacaataaaagagagacattgatagccaaaatgatagaacgcaaacacaggtaaaaagaaacataggttgatgtgacca

SEQ ID NO: 34071 - DNA, 421 bp, Oryza sativa
gcgctttctctctctccatggagtatgtctgcttgaccatttgctccagatgagatgagattattgtcatctggtctgccttttttccggccctcccggctacaattatcgcggtcgtctcagaagactcggcacgcactcccatgctcaaactccggcttgatccgcgccgcgcggggtggagagtttttttttcctttccttttaacgccttggacttggacctgatcagagagtgctgggcttatcagctcagaagtgagagggaagaagaaactgagttcggctttactccagcttcttagtgaaggcccaaataatgccatcacaagttgatagtttttgataaggaaaaagtatatttggactccctcaactaccgcctggagtatgattcatatcctccaaccataaaaccaga

SEQ ID NO: 34072 - DNA, 1465 bp, Oryza sativa
gcagcccgaagaaagagaaaaaaagaaggaagaagggagaaaaaaataaaaaaaattccatgtcattatccacgtgatgtgccacgtaggctataccacagtcaaatgcggctttgaaccggaatgatataataaaccaagtttagggatctcgatgtgcactttgcaagttcgtggatctaagtgaaacctcctgacaagtttaagaaccgctggtgtattttactcaatgatttttccagtagtgaccccaaaaacgttaatgtgtatataacttgggaaggaaacacactctacatttgtatagagtagcacttagggaaagtcatgtcatcccttaacatgatataccaccattacttgcataccaattaattagtaatgattttttttaaaaaaaattgctaacgtaattcattatgttatatcactccataaacatacaagtttaaaatcaactagaacctggggcgtgccgttggcgcgccacctgagcggaattacggtgggcaagaaatgggtaattagcaaagacgccagatgatgagatataaatgtaagtattctttggtgttaaaaaagagagcaagaaagcaggaagtgaaatagaagtaaactgcagtgccaaacagttataggcataccgatatctagtagtctttagcagcaacatggatatacacagacgtttcttaaaatgtccaagctagtgcactatggatagtaagcacctaaggtgtagaactaataagcatggtaacaattccaggggagggaagcggccgatcctgatagtgatcagcttgtttactggcagcagaagcatgatcataagatagctatgaatgcccatatggtcttcacaggacatcaatagtaacctccaggcaggttgtcctgtagaaatggaagatgcaaactgatccgagagctatgtcatctgtgctgcgaactttgtccaccctttcttcaagttgcaacggtcatctgttgaaacgtggaggatcatgctggttgaaatacctcctgctacttgtacttcagtgtcgacggttttttaccttccattagcggttttatgtagttctgtgaaaattcctttgtaaagtactgtaattgcacggtatgttagttctttattagtggtagaaaagcaatattatcatgaatgataggggtgggaaaaataaataattgttgcaagagcttacaactctatcttgcttgatgaatgtgctgttgatggttacagcatagaagctgcttgaatggtgtaggaaccgcttaatagcttcgatgtacttttttagatcagttgtgggctggacattttttttcgcaaaagcacagctccctaaatgtacgcccgcggttacctgcacgaatatatttgtatgtgagttttcattggatgggaagatgcagatgatgtaaatgaataacaatgtctatagatgttcgtagg

SEQ ID NO: 34073 - DNA, 1501 bp, Oryza sativa
ctcgcgttaattctttcctgcctcgcgcatatataccgtacgtgctacatggggagaatataagggcctgtttagttgtggtgaaataaaacttttttgtgtcacatcgggtgtttgaccggatgtcaaaagaggttttcggatacaaatgaaaaaaaaactaatttcataactcgcctgaaaaccgcgagacgaatcttttgagcctaattaaatcgtcattagcatatgtgggttaatgtaacacttatggctaatcatagactaattagactcaaaagattcgtctcgtgattttaatgtagattgttcaattaatttttttatctatatttaatatgctccacacatatgtgaagagattcgatgtgatgtttttgtgaaaagtttttgggactaaacagagccttaagaagaacccgctgcgcaccaccaaagtggtacagtgatcaatcgatttaacccattaagcattattaacccaccacgagcgcttgtcggttaaataatcggccgcccatgaatgatccccatttcggccgcccggccgaccgcgcgccggccaatcggaccaaggaaatcacgcgtgcacgtggcaccagcagccacagcggcgcgagatgcgggtacgatatacgtacgcatgcgtgaccgcgcgacgactgatgggaacgcgtagtaacgtacagtgcggctggggctaattttagctagctagctctgacgtgcggttcacttgtttgtttgcgattgtgtcccgcaagcgatatgtatagtgctcgatcgagcgaattgattaaggccaggtgtacacgagatcctagctacaagtagtaatttggattttggattttaatcatgcgtagcaaattagggacgaaatctctctctcgacagcgcatgcagcagagcagcagcagttatacaaggatgcatgttcacatggacaaacgcggtttaccgtacgttgcatgtacacgtgttggatctgatcaacgtcatggtcacacgtaggaaacgaataaccgatcggtgctatatatacgtgcagcagcggggccatatatacgtgcacgatgtgcactgacatatgcatgtgtgaatatgtgatcagatttcgtgcgtactgctagttgcatatttcatctcgttcacggtcaccgagtctcaggggatcatgattatagacgccggatgagaacgactttaaccagaagactattgagacaagggccaaaagcgagtaggggtctcgttttgtttcacacattgtcaggagctctctgcagacatgttgtccaaaatctttcatgcaccttccaatctccttttcaacatcggcaagtttaaggccatagttcgattctcatgcattttcctgtctctacattctgctatttgcggcagcaaagccaaataatgcatcatgcatgcatatttctacccatgctgtacttgccctgttgcccaacgggacaatatattgctcgaaccaactaat

SEQ ID NO: 34074 - DNA, 1501 bp, Oryza sativa
tgggccgctgatggtgacagctcagtacgggtattcctccaggttagtatatattcataagacaaattcctggggagggtactcctccgtatttagctccgattggacgaccatgacaggttatcgtaaggaactcgtcaacccgggatggtctctcgaaacactaggagggcactgttagggggtattggttgcatgacagtatactaacaagtgtagactaaatgtgtatgtatatccgaagtataggaatgaattcttttcttattcttcctccacttagcttagattatattttagtgagagtatcatagttctttcttatgtgtgtcacctaccctttgaattgcttaacctctgcataagaccttgatgtatacaagtaatatataaactattagcatagtactctcttatcatatcttcccttgggattaaataaatacgataccttggaatactcccgggtgaaatgctacaatggtatatccgtgcgcttgcggatcatatctgtaaccataagtatgccataaatatttctacgtcattgctgggaattatttttctacttatgtcgttaagaaatatcaacagcctccatgagcaggcagaggaaggcgacaccagtgccagcctctagaactgatagagggaggcggcagcggtggcctccacgagcaggcggaggaagacggtgccgacggaggcctctagagtgcagaaggcgatgagggcagatccaaggagggagaggagaagagcaatcagctagcttggggcaggaggcgttgtgaaggggccttgcggcagcctgcatggttggggaatggagggggtgctgccgtgctggaggtccgcgaaggtgatggctcgacgattcatcataggaccacgagctctcccaaggagatctcacccatgtcgtctcctgccgcatcgcgtattacacggctcgccacaactctccgtcgttgagcatcatcgccaggctgccttctccctccacctgatctcgatcgcctcctcctccctccattttctcgcccggtggctcaggcaagcgcccgtggctgcgcccgcacaggttggagctcttcctaatgacgggcttagcgtaccctccgacttcatttctgtcgctgtcgtgtgccccgacacgatcacactcaccacccggttggaagctgcctcaccgactctccgagctggagcacaacgcctcagcggcagatgagagagaaagaaaggaggaaggggaggaagaggagttgataaggctgacacgtgggacccacatcttctttaacttttttttggttagctagattgccacgtgtccaccacataaaagcaataccgggttaaaatcgattaggagggcaattcgtatggtttgaaaattttgaggtgttaaatgtctggatttgcagtttcgaggggtaattcggactaacgcaattgtcagggggtaattcaaacttttcccttaccttaataatag

SEQ ID NO: 34075 - DNA, 220 bp, Oryza sativa
tcttttttatcgatctcttctattttccttgttcacccaattttgcctaaaattgataaaattcaactcaagatcaccccttttttttgcgagacaattcaagaattgatttacttcgattctacattgttatagaacacgactcgcctagttgtgacaatgacttacatcaagctagcgcccaagtatgaccgggttcgatctcttctccatcactagg

SEQ ID NO: 34076 - DNA, 619 bp, Oryza sativa
gcagcccgaagaaagagaaaaaaagaaggaagaagggagaaaaaaataaaaaaaattccatgtcattatccacgtgatgtgccacgtaggctataccacagtcaaatgcggctttgaaccggaatgatataataaaccaagtttagggatctcgatgtgcactttgcaagttcgtggatctaagtgaaacctcctgacaagtttaagaaccgctggtgtattttactcaatgatttttccagtagtgaccccaaaaacgttaatgtgtatataacttgggaaggaaacacactctacatttgtatagagtagcacttagggaaagtcatgtcatcccttaacatgatataccaccattacttgcataccaattaattagtaatgattttttttaaaaaaaattgctaacgtaattcattatgttatatcactccataaacatacaagtttaaaatcaactagaacctggggcgtgccgttggcgcgccacctgagcggaattacggtgggcaagaaatgggtaattagcaaagacgccagatgatgagatataaatgtaagtattctttggtgttaaaaaagagagcaagaaagcaggaagtgaaatagaagtaaactg

SEQ ID NO: 34077 - DNA, 194 bp, Oryza sativa
ttgtttattgtactagagggtttcctaaggtgtttaggactcttagtatgagttggttcgtggctttaggctgcttacctcatgtataaatagagggggagcgtgaggcttcccggtattgctttttagagcaattgagttgctagtttagttagggtttcgagtttagtcgagatttttgtaaggagtgctgt

SEQ ID NO: 34078 - DNA, 1501 bp, Oryza sativa
gaccatcgaatcaagctcctatcactgactctataatcccgaactgtccttgccctttcctctctataaaacatcgtttaattaaactcgatgagaaaaatcgtttgaaaattaatcatccttcccagcaacggctagttagctcacgtaaaccatttgcattagctggtcccagtggatcgtgggacacccaattgactagtactacggtaaaaagataattaaaaacacctataggagtacaaaattatcctcgtcgtttttggcaaactacagccaagcaatttgactgatgctaacttaattaggccctctttgtttaggtttataagccaaaaagtctaagccaaaacaaacaagcagctttttcatttgtcttttttgaagccataagccactctaacactattaagccaaaagctatgttggagaagttttttttggcttatatgagatagatatatgactccaccactaaacttaggacattaaatctactggcttataaatcatataagccaataagctgacttaaaagtttaggccaataagtctaagcctaaagagggccttagtggcctcaaatgaaatgatccgtagggggtagttgatgcggacagatcgatggatggaatcagccggaggatcgcggggaaagggcgcgagaatatgcgtgttttgtgcggagatcattccttgcaagataccacctgacgtggcgcacgcaagtcgccgcgggagcggacacgcatatctccgtggcttttgattggggtttaacgtgagggtgatcattggaagaaaaaaaaatttaaattatattattgatttttttctaagaaatatgcgagatttaaatggatttgcataaatagatagtgtcacggtacgcagtacgaaatcgtaagaccaaagtgcgatagcgatgatggcatgatgacgcaagtggtcttgcagggcgagagtgctagatcgctcgctggttgccgtagcccggaaatgctactgggcgatcggattcttcccccctcctccctctcccatcctccacctggtttttttggcatcgtattattttcctattctagtaatttatttatgcacctaaagtttatacacctcaagtttacacatctaaagtttagagaccaaaagtttatatatccgattcaaatttgaatttgaattcaaatatattttatatatagtatttctatacatctaaagtttatacacctaaagtttatagacttaaagtttataagtccaaagtttatatatccgattcaaacttgaatttgaattcaaatatttttcatatatagtatttctatacatctaaagtttatacatctaaagtttatacacctaaagtttatagatctaaagtttatagacccattttaaatttgaatttgaattatatccgatttaaatttgaatttgaattcaaatattttctatatatagtatttctatacatctaaagtttatacaccta

SEQ ID NO: 34079 - DNA, 467 bp, Oryza sativa
cgggtgggccccacccgtcagcgagggtggcgggcgggcccgcccgtcagcggcgcgcgcgcgggaagaggccggatgggccgcggggagaggagagggagggggagggagatgggccgagccggcccaagagggagagggagggaaaggggactttttagagcttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaatatgcaaaccaatttctgctgggatttgatagctgtatatggagcagcccaaaatgcacaca

SEQ ID NO: 34080 - DNA, 362 bp, Oryza sativa
atatggtaacgccgcttcggtcggcgagcgtaattaacgcgcgcacgatacaatccatttcgattgccacaaccgcatatccactcaatgcgccgtaagcgggcgaatgggattagtggaagcgtgggcacgggaaacgagggagcgagatagcgagatacgagggagcgaggtagtgggcgcgagaaacgaggagtcaggcccagcgatggcaagggtataaaagcatcgagaaaaggatttgcttccttcctttcgccattgttcctcttgccttcgccacctgagctctaactctttctctgctacgccctactttcgccacacgcgctcgttctcaatcatctcttcctccgccgcca

SEQ ID NO: 34081 - DNA, 897 bp, Oryza sativa
ccgggggttctccccggcaccaccccgttgaatccacatgtctcttgtcatcatggttcccccgattagctagttactcagccaggggtgtcccattctacccatgtggtcgcacttgccttatgttcggatgaaattccaaggaaacggtccttaagtgcaagagcgataaaccgtactcccggtacgtcccctggtctgcgattttggaaattcattttagttcgcaagcaccgacctaggtgtcgggttttccaagtcttttgtaaaaccccaagttttacccatcgttggatgttttaaatttgaggggaggtgctccgatgcgcgtgcctgtaggcccgtgcatcgaagcacaacagttgacaaaggtggtttaagtgttcaataattcaaggagggtaattgcagcaattaggattggggccggcaggctatctcgcaagcgcggccgaaatacttgtgttaaacttattcatgcaatatttgcggaaaagaagtacttagatttaaattataggtgcaagatgatcaaaggtgacttgccttgctcgagagcttgatccttgaaatcctcgcactgcgggtcttcgggctccgaaactacacgcgaaacgggacaactcaacaaatggcgaaaataaagccctattattgacctctaaacgtgccattaaatagatctcaagatttgagaaattttggaagttgaacggagtcaaacggacatacggttgagaagatattgaatttctaagattattggatttttggtctaaaggaaaaaggatttaattaaaccctttcgaaaaagaaaagaaagagggaggggaaacagacttccctcgggcggctagggcgcggcccgagagaaaggggcggctcggccgagcataa

SEQ ID NO: 34082 - DNA, 1501 bp, Oryza sativa
gtatctcacaacaaacacatatctataatagtctaatgcgacaaacttttatattttcaataatgtaattcataaatttctatgctcattcaaagggtaaaatggtcattgttggtattacttaacgacattactagaaatataattcccagcaatggcgcagaaatactcctggtatattatggttatagatttcatccgcaagcgcacggatataccattgtagcattttacccgagagtattccaaaggtatcgtatttgtttatcccgtggaaagattatagtagagagaatcgtactaataatttatatattacttgtaataaccatagtctaagcagggggttaatataagcagagggtagagtgatacacaagcataagactattcactctcatattaaattatccgagctaagtggaaagaaaatagaaaagaatatattcctatacttctagtatacataatatacatacatcctagctataagattaactagctaatacccttattccgatgccctcctggtacttcgagaagccaccccctactgccgagtttcttacgacagcccatcatgaccatacaaccggggctaaatacgaaggaataccctccccagggaattaactaaggactatatacacgcgcggaggaatacccgtaccgagctgtcaccatcagcggcccacctctcttccgcagcatataaccccaaataatgctacctagtaatctagacaccacgcctaaactaccaaatactactctaatatcatcgtcatgacatagaataattacataagcaaacattatacacgtaccgttgcatctcccagataagctagaagtataatcaacataactcagatataaagtaaaattggtattcatatactcaaaaagtattacaacaccagagttgtataaagaagaatattctaaataaagtacaagtcttacaaaagaagaaaggagagctactggagctatacccgaactcttccgaagacttccgaactcatacttctattctattcctactccactagcttgagaatactaaactaagtttgagagagtatgagagagcttgcttgaggtgtgtggagaaagtgagaagatgagctccttaaataggctgccaatgacggttgtggcagttggaatggtcggaattgccctccaaccgtcattggggagcgatccacgccgtccagaagaaaccctgcatccaacggtgccagggaggggttcggctgaaccaggggctgggccttcctagcctattttcagtaggtggcctcctcttttgatccctgtcacagacttgtggattttggtaaaattcaacgtgtcatttctgagttcttggcccattcatctgatttccgacatcatctgattgattgatcgtctgttttgattttgattctcctctattttatgtttattctctgcaagaggttagtaatcctagtgctaatggaatatttat

SEQ ID NO: 34083 - DNA, 1501 bp, Oryza sativa
agtgcaagccgcagttggtgcggaaaaaaagagcctcttattcgtctgcacaattacaggttgcaaattggattgctgctatgcacttgtattacagtattcactccactggtaaacacagcaaactctcatctctctccatgacgccgcaaagcatccgtgccaataggacgggtccctcgggcaaacgcaactggcaaacccgtagggccgcgagcagcgaactcgatcgatcacaccagctttagcgcggctcccgccgtttccggccaagtgccccgctcgccggatttccagaacgggaagcagcagcacgtacgccgcggatcaccccaatattactcaccggctcaccgcgagacgagcaaccacaagaagaaaaaatctgtactactagcgcgtagtagtgtagtgtagtgtagcggcgtggtcggccaagcacgtgcagggtggagaagtgcgtcttgttcttggagtgtggtaaaaaaatatcctttgcttctttttgtgtgtgttgagttttgttgggggagggaggtgttggatcgcggaggcatggctcatgcacgcgcatcagtcgagggggtagcatgtgtcatcgccgcccgtgttccagaggaagtgcgcgtaggctgccgcgtggtgcgagttgctgggttcggcggcgatggcctcctggtacgtctcctccgcggccgcgaggtcattgcgcgctttccacaggaaagtcgcgtaccgacccatcgcctccgcgtccgccggctccgcgcgcaccgcccgcttgaagtagtgctccgccctgcatccgcgcaaaaccaccacctcggtcagcgcccgtaaaaccccaagaggccccggcggccatttcgtcgaacggctggcgacgtggcgcgcagcaactcaccgatcgtggtcgcgctgcaccgtgtacaggaactgggcaaagttggacagcagcagcgagttgtctggctcctcggacacggctcgctcgtaccgctcctccgtcgccgcgaactccgccgtgtcctccgtgtccagcttggcctccaccggcgccacgagctgccccagtgtgtccgggtccatcagcgcctcggcgcgaacgctcgcctgcatcctggtagcctcatcggctatccttttccagatgaccagttcgtcctctgtctcctccacggccattgcttctgacacgggcacggcctcctccgcgccagctcccggcgtaccctgtgacgcatcctgcggcaacaccgcgccgctttgccgatttgaccactcgtccgagcgaccgtcgccggttgccccggcgaccggccgcaccttgccgccgccgccgctgttgccacccaccgaggccgttcggccgatggacaacgtcttgagcgaggcatggtcgaaccgctggtgggaatgagactgctccgcgtgctgggtgtcgaccatcgccacagtcgccgcggggggctggggaggcgggagcgtggcggcggccgcg

SEQ ID NO: 34084 - DNA, 1501 bp, Oryza sativa
ataatttaggagggtaattcgaactcttccttaagtaataaatagaaagaattaaaggacgtcagttcttcggctacacaacgagataaacaattatctctctcctagacaatcgaatgaatgttttaatttacatgtgcattataagaacaatccgatggtcatgatttaaattatggtatgattaatacatattgagtttctttcatttatatagaatagaaaaaacttggtaaacctaagtacccatcttccctataattcaccaactgcactcctatatacaaacctcattcatgaaatccaacgatccaaaatgaacgaatccaatggctcgcatcgtcccacggaccccctcacctccctgcaccgcacacaccccctctctcccctcctctctctctctctcacctggaaatcactcgtgcatcccacaccaaccgcgacgccccaccattgccctccctccctcaaagtgctcctggctccctcataccccttgtcgccgcatgccctccacactgccgctggcactccccaccgtgcgccgcccccggccttccctgctacaaaggcttgcccctcctctccggcatcattcatcatctccaccttagccgcccagctaccggtcatcgagcagaatgatagcttttttatgagagacacaaaagaatgggcgtttctcagttaactcaatgtacaaagcaatcatgtatagggaagtcgtttctaaaaaggacatgatttagaaactcagaatacaattttcttgtggtacttaaagagtggagtaattttagcaaaggataatttagccaaaaggaagtagaagggtagtgttaagcgttgtttttgtgattctaacgaatcaattcagcgccttttctttgattgtattttggcaagattcatgtggaatgcagtctatatatcttttggaattcacccgcctaggaatgttgctagaatgttcgggaattggcagaagggggttcggcccaagttaagggctcaaatccttgtggggatgggaactttgtgttgggtggtttggttatgccggaatgatgtagtctttgatggctccaatactaatttttttgttgcaggtgattttcaggggggccttttggacaagacaatggtctttcctacttaaggaggaagatggccaaaaagtgagagaaggttgcttgatgctggagaagagagtttttggcttttctgcaatgaagggattgaacttaagaaaaagattaggatattaatactatcttgttttcttatgtggtacggttgaaactttgtattaactttttaagaattgttgtttctagagactaagtggttgaaactttgtattaactttttaagaattgttgtttctagagcctaagtgctcgggtctagttgcttcagatggtgttaaaccttttgtaagggtgtgagtctatatactctttgtatgtttcgttgagactgtgtagaggccggttta

SEQ ID NO: 34085 - DNA, 1501 bp, Oryza sativa
cgctcccttggatcacctcatgcgaaaaaaaaaatgtctttccaatgtagaacattagagttatttataattttgtcatcacacttgccttaggttttttggataatgaaagctttacagaactcagtcaattacatcaagatgataaaaccgtactgtgaaactttcttagtacttgccttaatcttatggtgtgattaatgttctttccaagtgcaggcttcctttgcccaccgtcaagctggtgtcggagtccagcgtgttgaaggtagaggagaggtcggtggtggaacaaggggctgaaggccatttcggaggggaagctagccgttatccttttagccggtggtgagatgctctaatagaaagattacctgaatttgctatttctgtactgtgtgcattgggaagcagcctccttatggtttgattcctcttcatgtgtgtgcaggagacttggcctggcagctctgatcctaaagggtgtttcggtaggttgattccactgcaatcttattaataattgactttatatgaacaaatgtatggatattttttcagttgaaaaaagtgaggtgctctgaattgtttttgttttacacaatgtttttttggttcagaaaccctttcaatattctaatgtgatgaacaaggttatgtcctttgagctcactgaatctgaaattttcaccttttatcttatttcacagttcaacatctggtgggataatcgatagagctatatatgcagaggataggacatggtgactttatgaaattggtaattgccatttgatgtactacaataaaaagttactttaactggcggagtacagtattaacaatctgctttttagtctgtaacagtgaaatatcttggaatatatgtcgattacttaagatcttgttgaaggatatctggaattggctgcagagacaatcatttttgtggcagtcatgcccgggtagggtgtagagtactgcattacagtggatgttgatctacatgtaagtataggtgtttgaactactgccctctaatttagcatcatcttgagtcttttttctccatgcttaaatttaatttgttcatagttcagacatttcatctttattaaattaaatttatgctaagtatttggcatacaaactgtacactctaagttgacaaatctcatatatgctattatctccaaagatgttgcttccaaagataaaaactcaaaatctttagattttaaaattctatctcaaatctagtgggactgcactcaacttagttgatttgtgattgtttggtgaaacaatgtagtttttcaaataattatacttaacttatcacctatgtatagcttactgcaaagcataactcatgtatttcagtattgcatttctccttgcttttcaccaaataatatatagtacttgaactctatagtttcccgtcctgaatttgacaagaataagctaaaattacgggtaaagtttgctttggagtgta

SEQ ID NO: 34086 - DNA, 1501 bp, Oryza sativa
gccacgtcggcgccacgtgtgcgccacgtggcgatcccctctcccgataccgtggactcggtccaccgtggaccggcgtccccgagccgatgacatgtggggcccgcatgtaggcgcccccttgtgctgacatcgctagggttaattattgcgcaataaatcaattaatgttttcctttttatagtaaaagcacagtgaatcttctaaaattcatagaaaattcatccgtgctctgtttaagcccattcaagtatcagtaagtcaagaaaaatgcaaataatccattaaaaatggttttgttctttgtttcagttgtcttttagcctatttgcattgtttgctttgtatgtcgcatagattccagctctcccgacgctccggtgtacttcgagatagtcgtcgaagttcctccggccatagagcaaggcaagtcatgcttgtcacttgaacatattgatcccatattgcaaatgctttttaaatattgcattgttttataatgctaccatgggatgtctacctactggatcgcttagccatgcttagatcaactagtacacaatgggggaattacattaatgcatagacttaagattctagtattgatgttggattagtgccaccgctttggtgttggttaattaaaatatattaaatggtgggctgtgggtacatggttctgttggtcgcgcccatggcaattaaggaccggttcgcgggaaaccctggaagaattcctcgtacttaccacaagccagcatgggcaactgctgggcttgtagtgtagctttcctctagctgacgcatccaggcaagggtgggcgtgatggagcgggatgggccctgcgacagcctttgtcgcttccagattcacctaggcacaagaggggactgcccgctgccttgcgaggagtgggggtgaaacctgaggtgtggtgtgcttggttagagggggttatctgaagggtcctatcacggcctctttccagtatgtcatagtggcatgtcagtgcacgggaacgtgtcgtggggctgtgtcttgtgggtacagttgtacacctctgatcagagtaaaactattcgaatagccgtgcctgtggttatgggcggtcaaccagattcatcatgattagtctcacctctagcttagcttaatggaactgattagttcagttgatggtttgggcctgtctcaacgtggtgtagcgttgagcagtgattggtttaatactggttaattactataactgttttactactttcaactactgtttataaatgctagctttacgcaaatgaaccccctttagcctcctttgattatatcctgcatcataccctccgttctggtatgacttgctgagtacagtgggtagtactgagtcttgctctatctcccaaccctcagagttcaagtacgcttccgatggtggtttctccgaggagtaggcttcgtctgtgctgtcgaggatgcctgtggagtggtgttcccgctgcaat

SEQ ID NO: 34087 - DNA, 1501 bp, Oryza sativa
taaagagctactgtgagagagagagagagagagagagagagagagagaggatacctgcagctgtggcagaaagattagtgcatcctccctcttttagtattgttacgacgtgattattatttctggaggaggaaaacctgcttttgatcagtactacagaagggtacaacctatagcttcgacagatcacaggtacaatttgggtaggcaagtgacaaattttgcatggatacagtgattgttggctagtgttgacacgccgcgtcgcgggctcacggcatgttcagagttcggaccgaccgtgtttcaaccgtccacaactcgtgctttaatttgccattccccaacaaccaaaatattctagtactagtactaccacggagtactactacacagacatgcaatcccaaaatggacggaagctgcaagtggcagttaagctaaacacaaacacttcaacatcacgcatgcatgtggatacccgcggaaatatgcatcaggccgttgctcgtgtccgtcgttgcagatcaacctatatcaccccaattaactattccctctccccacttgtagctacttcatgcgtgcagaattgcagaacgcagatctctcctcacggcgaacggtcggtatgcaaggcggcgaccgatccgatccagccacgagagctagctgactactgagttgacgcgcgcggggccaacgccgccgcccatacagcggccgcccgagcgagagtacccgtgcgcacgcatgtggaaaacgccggggttgatgagtccgatctagcggtgtgcgtgcacggttgcgtgcgttcgagtcgacacctccacgcagcttccgcctcctccgggtggaaactgacccccctgccgccgctgcgtgctcccgtctcgttcaccgtgcacggccgcttgtacgcgcgccgcgccgctgcacaagaatccaaccggtggtggtggtaggacgtccgatggggcggcggaacggggccgacacgtgctggtgcgggtgcccgtcgtgtgtgtgtttcgttgctgcctgccagcaggagcgcacatgagagtgtgtgagacgcagtaaggccaaggccagagtcaatgtgaacgaacgcggatggatctggaaggatccaactgcccggacggatcccacgaagagtaaaaagtgcggaaatgcgtagcactactgcactagtactgcagtagtatgtcgttcttcctatcctctttgacgatggttgttgtacatgttcacgtgcacgcattgtaccacgacgatcgaaaaaaaaaaagaagaaaaggccatctagcgttagcgtacgcgtttgctccgtgagaaactgctccttggttttttttactcgtcgagtcatcttcccttccaattcaccatttctttacacaaacatggagaggaaaaaaacaagagcgcaatcgctgagccgaggaggagagagcagcagccgaccacgccaccttgctttgcgctgctacctcca

SEQ ID NO: 34088 - DNA, 1501 bp, Oryza sativa
tggctccaatactaatttttttgttgcaggtgattttcaggggggccttttggacaagacaatggtctttcctacttaaggaggaagatggccaaaaagtgagagaaggttgcttgatgctggagaagagagtttttggcttttctgcaatgaagggattgaacttaagaaaaagattaggatattaatactatcttgttttcttatgtggtacggttgaaactttgtattaactttttaagaattgttgtttctagagactaagtggttgaaactttgtattaactttttaagaattgttgtttctagagcctaagtgctcgggtctagttgcttcagatggtgttaaaccttttgtaagggtgtgagtctatatactctttgtatgtttcgttgagactgtgtagaggccggtttaatccattataaaaaaaaaagaagccggtcgtgatctgcagccgctgggccgcgggtcgcgatctgaacagatcagtccgaccgcaatcgctgtttcttttgctgcagaacctgaaaaggtcaggatagcaccgatatgcactagattttgacctatatatacttgcctgcccttttctgctcactagggatcatgatatacgataggcatttcagaccaatacttgccactgttttaattctcttttctgtttccatgatcatcatgtcaagaggggcaaacctgacagaaaaatctcaactgaaatcatttgcgaaaccagtgcaacactgcaacgatgagagtgagaattagtctggcaaatgaaaaaaattacaaattatgggttccactcatatatatctcagtcaatcacagtagtatcttggggaatttcaactgaattctattttgcacaaccacaaacctattcacaaacatgattggtacttttgagagaaaaactggtgagaaatctatcttcttgaaagtttagctaaagagtattcttaatcaaaacactaatataagaattagatttactggacaattgagcagctgtgaatggttgtttaatgctatattaaattactaattgaattgcaatgtcaattggctgaattaattttcttctataagattggaccaatctagaagggaatacacttgcctaaacttttctgctaattgaggtataactggtaccacgcctcatatgcaatgaaatgcaaatattattagctgtatcaataggacaagcagaagaatctaagatgcaaaaaggaaatgcagtatatatctaagctgaaaaatgtttgttatttctcaactgtgtatgtatacattgaagtcatttgacttgtgctatatcatggaataaaaatatatgacagtatatctctattcatcaaggaaagactcccccgcgtcgctctcatgggggcggctcagggtggggggggggaccctagccgcccgcgccgccacaccctcttccccctcctccacctcaccgccaccggagctcgccggcggcaaagccgg

SEQ ID NO: 34089 - DNA, 1501 bp, Oryza sativa
aaggtggtgtttggaaaggagggactaaactttagtccctctcatacaaacataagttcttacaaaagagactaagggcttatttggttctctaccctaccaatttattggtagtgccaaagtctaggcaaaatttggcactaccaaaatattggtagggtaaaattatttggctaccatttggattgctaccaatataaagtcaaattctcatagtatagtaaagaaacttctagaaaatgaccaaatagtataagggaactaccaaatatttggcttcaatccaaaataacacatatactattcaatttgccaataaattggtagggtgtgtttttggtattaaaccaaaacggccctaaaatttttgtgagagggactacattcccaaacaccacctaagtgcgatattacgagcaatcaatcaatcgagtataatgcagcttaagccagccagccatcgccttcgtttggtgttgcacgtgtcaaatccccgggcgggccggacccaccgtacagtgacagatccagccactggcagttgggccgcgagcgggccaacgaaccaccaccccagcatttattactccccttgcaccaccacgcgtaatccacccaccattaaactctggccccacctgtcatccagcgtgtggtgccacgtccgtttccccttcccgggagggagcagcgtcctgtttgtgatttacccgtattggtttgtacccgagacactgagatgtggggcccacggtgagattggtggcttgcgcgtggtttttcttgtggtcgtaggcacaccgcccgccgcgaccgcccaactactcggtgagttgacttggtaataaagaagacgtatactcgtgtcatggaaattttcgtccaggtcctcgtgggacgacgaaattcaaaccggctccatgcatggcttactccgtacaccgccacacgtactccgtaacacgttacacgtctacgggtggcatgggcgagcgacatgagcggatcgctcattccattatacgttctgtttgctcgtcccatgtgtttgtttggctaggtggatgagcttcgatgaaagatggccgtccgaatttttatattgtttatttaaatggtatgatggatagtacggtctagaaaagggaatattctcttaatatgttggatgagtgtatccggccgatttgactggaaaaagtcatacaaggcatgtgtaatgtgtcatattctgattggctgtggttggtttgattttctgttagcaagctccaaatgatttttttctcctaaaccatttatctaatttatgatttgattacaccattatatttattacaattaaatctttaataaaatctcaggtgattatattttaataaaaaaaatatatatgataaatgtgacccactaacttttggcatatcccaaccatgctatatccctccaaccaaataagaaatttagtcatcctatatacaaatcaaacaaaaaaattaga

SEQ ID NO: 34090 - DNA, 1501 bp, Oryza sativa
attttacctaatctcttggagtgagaaaatttttaacacctcaaattatgtttttgcatccccataactaaaaatttgggaataaaattttaagatgtgttggtgatgctctagcagcggttagcgtacgtacgattaggggtgagcataaaaaccgagaaccgaataccgtacctaaaaaatcgacaccgaaaccgaaaaaaccaaagtagcggtcttcggtcgtttgctcggttgcacgatgggagagaccggttcggttagagcaagtttaatagtatagccaaatgttagctccaaatcatctataactaatctaatagcctattcatacaatagttatttacacaaatatcctacacaattaatatccggtcccacctcatacatacaacgtgttgaagtccgtgttgttactggcaattaaatttatagcccacttacttctctttctttttttcttcttgatatatcgttataggtgacttactgtacttgctctcagtaccggctacaaattgaagaaaccgaagaccgaaagtatcaacttccatgttgctccaggcctccagcccattggctgccctagtagcccaccgtccatttcgattgggcccacatgactaatctccagttccccaccacatgtccgggtgaacaaaagaaaggaaaaaggggagtctcgatcttattcagttatcctcaactcggcaactcctcgacgacgacggcacatgctccccagcctcgactcgcacgggacctcgtcccggccaccggaggggccagcccttcctccgcgtcgcgccgccgcctgcctccttcgcgccacgtgcgacgcgccgccgtggcgccgcctgcctccttcgcgccacgccgcgccgccgacctcggcctgcttgcggcttgcctccacttctccctggctgccgtccacgctacacatccacacctccatctcggctccgcacgaggggctgcgtcgggcatcgccgcgctgtcgcttgctacatgtggggattatggatattccatatctagacggcagttatagtttagttggatacatggtactagatatagatagaatatctttatgaggactcgggttagtttctaacttatatgtcaagaaaatacccgagatcctagtcggttacgattatattttatctgtaatcacatattccattagggatatggactgtattttgtaatacggaccccttcccctatataaggaggggtccgggctcctctcgggacgaccttttttccccagatcatacgatcaataatacactcggcggaatcatccccggacaggagtagggtattacttcttgaataagaaggcctgaacctgtataaaattccttatcttcaaacccatccacttttctagcttgatagccaccccctttaagtattgccgaaatcttgttttgacagttggcgcgccaggtaggggttgcgtcaagtttctcgccgatcagtgcga

SEQ ID NO: 34091 - DNA, 435 bp, Oryza sativa
tgagtagataaatgctatcgacctaccgtactcgagaaaaaaatgttatacctactacgaacctctggacaaagctaccctttcaaagtattgatagtctgcaattatgcctgtgagaatgaaatctgtagttttcatacgacaaattcagatagttacaaaatctgtcatctgtcaagaagagtcaaggcttgcacattaggtctcccgttttgacccagtttatcaactcaacaaagcaaagcatgcgaagatttttcttctaaaggaatatgtgcctgcagaaattcagcagaaaaaaatgtttgtttaaaattgatagaattttaaaacggatactcaagtacaattgatagaaagtcttaaaagaaacaactagtgcgtgcaacatgaaacagtaatatagacctgactatccattgcttttggtcaagt

SEQ ID NO: 34092 - DNA, 1501 bp, Oryza sativa
tggggttggtggtgcggtgcctgaaccggaatctccacgcatgcctgtgtcactgtttgtgtgatggtcatacctgtgtcactgtgtgtgtgtgtgacggtgcgttgggcccgcagctcggtcaaacgttgtgttgttcggtctgtttgatggtcggggggagcggacggacggtgcgtttggttcggtagattagtctgtggatgtagggtaaaaacggtacggaaaagggaggaaagcatatttatcgttttcgtttttattttttttaattggaattggaaacctcggatacgaaaacgaaatcaaatattatcgaaatcgaaaacggagataaaataaaccggcgcgaatacggtaacgaaaatttatcggaataaaaaacccctcaaactgataaatccaattctcaagtctcaacggtcaacaatctatctattatatctataaagtaataaaaaaagatcctccacgtccgctctcatggtctagaaattctcacattaataaaaaaaaaagaaaaatagaactagattaggattagtattagttaaaaactgaagaaaggaaaaaaaaaaggcatactaagatacttgaatcggacagcagtcaaaaactttaaaaaggaaaaccaaatcatattatacactggaaacagataatgttatgagaatccgcgtgttcacaccgcttttagaaacattgaaagacaaaccagtactaatcaaactctgccggttccgaattctattgttcgctctcacgcgctagaaattctcacattaatcgaaagaaaatataaggaaatatagaaaagatcaagaccgtagaacatattttgcttcagattatacgttgtagattgctttcgtaggatccaggaaacggacaaggtttctttcgatttagaaagggtgaatagtcagttcagtccttcaacttttgctcagaggtcgaattagtcctttatattttataatgtccaaacaggaccctaaaaattatcatacggcttaatatagtccttatacccacttaaaacgccacatggacatgccacgtcattcgtgcatgtaagataacatttaaatgtccattttaaccttcaattttctatcaaacaaagaaaagaaaataagaagaagcaatcataaaacaaaaaatgttattttttttatctatcaatgctacatatttttgccaatggtcaaaaacttttttttgtgtgtgttttctcaatagtttttctttatttcctataaaaacataagggtgtaaaggacatttaaatattgaatttacatgcatagatgatgtggcatgtacacatggcatgtttagagggtctaaggaccatattgaatcacacaatgaacttaaggtatttgtttggacaacacgaaatgtcagggactaaattgatccttaagtgaaagttcaaggatcatgttgggtattcacccatttagaaaggaaaaagtacgaatcacccccccccccc

SEQ ID NO: 34093 - DNA, 1501 bp, Oryza sativa
gagagagagagagagagagaaaagaacgagaagcagagaagagataagggaggaaggaaagaagcaggagactagaagaaagaagagaaaaggaagtgggacccgcgggacccacatctcccctcccctttgaccactttgactttacagccagacaccaacggattatgggtgtgtttagtttctaaaaaaagttgaaagtttagaaaaaaaagttgaaagtttacgtgtgtaaaaaagtttttatatgatatgatatgatggaaagttgggaatagggggaaactaaacacagtatatatgaaaagcgtcggttttgactaagagcaggtaccgtacaatagcattctataagcatacttcctacgtcccacgatacttggctttctagtatttaaaaattattctaaaatagttgtcattttgaagtactacatgtcacattaaccacttccaatttaaatttctcctcattctacccctaaccaccatcccacatccaactatgtattattaattaaggggtattatattctttttcttttaaccttagtatatgctaaacaatccagtaaaggaaaagagataaaagcagcgggctatagatttgtagccagctacagcacggactccaagacgtaatgtgtttatgataggtaggattagatattaatagtatagtaaacaactattgtatgaattagctattacattcactataaattatttggagctagtagttggctatactattaaacttcctctaagaaccgtcatctatttctttttcccaataaaagtgccgcttctatggtggtgggtcccacgccaacttaaagatacccgtttctatatctgacaaaggaacagtcatctatttttttcccacaaaagtgtctagggtgtgtctcacaccaactaaaagatgtcggtttctatatctgacaaaggtaaaagatgctgtttttttataaagtggcacctattaggatataaagatgccggttcttggtattttgccgggctcacggacgcgtgggtcggcgcgtgggtggctaagacattatatgtgtcgttttatcactttcggtacctatagtgctgatatttatttgatgttttgtagtattgatagcggttcagcctagttgagttggcgaagaatgaattagtcgcacgttcccgaaatatacctaacacgtatctagcattccatagtgaccattttttttttctgtgaatgcaacatttttagcgtagagacatggtttaatgatgattttgcttatgagcaattaaaggtccatgcatgttgcaacattttacctagaaaaaacacaaatcgtgcatttatcttcttgtatatttgaaatattttctagtggatttaaaaagggtgtgaaagcggccggctgataaataacactgttataataacaaccagggggaagtgaaatcattcacggatgacggcacgtgatttaccattacgttatttaga

SEQ ID NO: 34094 - DNA, 1501 bp, Oryza sativa
ttaaaaaaaatgatagatctaagagcattaccaacagtctacctatatgattcccaaaactaattttgagggattttagttcaaaaatcaactctaacagatcccatactctcctacccgagttttggagttcccttcccccggttcctcgctccgtttatatgcgggcatgaaagtcgctcccaatcacgcaatcccacctctctccttcgttcccgcgcgtgggagatagcgatctttctgcgtgtgaaagaaaaaaaaacggaattttctcttggtagtttaatagaagggcccacttttaagttttggggattgaatttaggctatctgttggagggaggagttttttcacttcctattttcagtttaagaataacaaaaacaaatttttaggagaaaattatagataatctgttggtgatgctctaacggtgtaaaatattaggtccaccgtattaactgaaaatcgatgtgtagatgtttttcttttttctcataatttcttcgatttctctgatttattgggtgccgcttgttataaataatcgacacatataagcccagccacgtggcatgatggtccagaatcggtaccaataaattggtataggtgtcggttcttgatacaaaaccggcacttacatatattataggtgcagattttacgaccggtgccgatatccgaagtcatccatgccgttatctgggtgttggttcgaaaaaccatcagctaagtgatttctcgttacctatggtgtagttgaatgtgcacccagtccacctggtcatcttgtatgagcacatacactaattaaaatctttgtgattagctggctggtttgcaatcccattggatgagtttctagaagaaaaaaaaactatcgatttttttttcataataactccgtaataaaaaaaagttctaaaactactggattgacgaaaaccaagcagctttcacggtttttttaatcggtaatgaccccgacgtctttttttttttgctccacccctgacggcagtatagatctaatctaacggtaataacaacgggtccatcaatttaaataaaaattaatggtgagattaggctgtgccaagtggcggcctcggaacgtttataggagcgccacgtggcagcttgagagcgtttgtatgaagtttaatggacttttagtatataataatagatatttttatagaaacaagagatcaaagttgtgttttggagaccgtgtcgctgtccaaaacgacttcctttattagtatagagggagtatgattttgcttgttccttttcccattggagaaacatttacaggtaaaagagaattttttttatttttaattttttttattaaaagttttaaaaaataatttttcattttgaaaattgacagaagtggtctcctaccgccctctgggagggcgatttttaaaaatcgccatcccagagggcggtgaaagtgacgtggcagacggccgttcgctctcgggc

SEQ ID NO: 34095 - DNA, 945 bp, Oryza sativa
ctccattcctgtttccctatatagagttgcaacagtgtcatttttattttattttttcggatgttttttcacactcaggatcacgatacaaccaaccacaaaaaaaatttaaactcaaactaccacttagctaagtctgaaaatatctagcataccacttagtctactttgcaccttcaataaaattagaccataactcttttagtaaaaccctttgatcagcatgttaaacataatgcactctaccactatatgaaattacttaatctaatttaaaatataaccacataaaatgacatataagttaaacagtacatagagatgtaatttttttatttttatttcattttttgatatttttttcacacttaggagaacataggaaccaaccgtataaaaaataaactcaaacggacaaaatatgtgacatgtagaattttccaaaactctaccgaaatagacaaaatatgtcatctattaaaataggtataactttttcatacggactcggaatcaggcaaataatatatgcacggacatctacagaaaaagttacatccgattctcccccgctttgccgggttcggtgatattaaaacctccaaattccgcttgcaagaattgtgttttcgaggagagaagtttttcggtggagctttggaaaattccatatgccacatatttcgtccgtttgagtttattttttacatggttggtttctgtgagttcctaagtgtgaaaaaaaatatcaaaaaaataaaataaaaataaaaaagttgcacatctctctcctctgcactagtccggagagaggagaggagaggaaaaattctacatgtcacatattacgttcatttgagttcaatttttctatggttggttcttgtgtgtccctaagcgtgaaaaaaatatcaaacaaataaaacaaaaataaaaaatttcggg

SEQ ID NO: 34096 - DNA, 898 bp, Oryza sativa
taaaaataagcaatattgaaagaaatttccatgtaagaacccaatacgagattaatcaaaattcaaaataaaaataaaataaaatccaaaattagaaaaggaagggagagtccaagtaggaatacaatttaaaaatagttgaaattcggaattaaaaacaagcaatattgaaagaagtttccatataagaacccaatacgagattaatcaaaattagaaataaaaataaaataaaatccaaaattagaaaaggaaatgagagtccaagtaggaatacaatttaaaaatagctgaaattcggtattaaaaataaggaacattaaaagaagagttcatataagaacccaatacgagattaattaaaatttggaataaaaataaactaagtaacaggcctataaaggagtagagtggtggcggttgatacgacatataaaaattgttaataaaacatcaaatagaatcctaatgacgattaaaaaggagggacgtcaggcagcccgtgaagcaaacgagtaaggcggttgccgggacttcttagacagtaaaaaaacaaaccgcattgataatcgtattcgatttttaaaatctcaatgataataaaaaggagaagcagcgggcggagtgtataagagtatagttgcagagccaccgacgtttgacgggacttctagaaaataaaaaatgaattccaacgatagttatgttcgatttttagaatcacaatgacaataaaaaagtaggcggcgaacatgctgtagaggggcatagtggcatcgtttgataggacttctaaaaattttaaaaaatgaaactacaagttatgttcgattttaaaatctcaatgacaataaagaatgaattacaatgatagttatgttcgattttaaaatctcaa

SEQ ID NO: 34097 - DNA, 515 bp, Oryza sativa
ctggatttttcacattttggtccttttgaaaaacttatttcgcaagtagacccctagaaaaacttatcccaaaaatggttctttttggggcaccagagtggctggcgccgttgttcaacaggacggcgccagcctctttggcgccgtccccctgccgacgtggcggggcgatgctgaggtggctagggggaatgcgccagagtggctggcgccccccccccccccccgaaattttttatttttgttttatttgtttgatatttttttcacgcttagggacacacaagaaccaaccatagaaaaattgaactcaaatgaacgtaatatgtgacatgtagaatttttcctctcctctcctctctccggactagtgcagaggagagagatgtgcaacttttttatttttattttatttttttgatattttttttcacacttaggaactcacagaaaccaaccatgtaaaaaataaactcaaacggacgaaatatgtggcatatggaattttccaaagc

SEQ ID NO: 34098 - DNA, 1501 bp, Oryza sativa
ggctgtcgtaaggaactcgatagtcaggggtggcttcttgaagtaccaggagggcatcggatagagggtattagctagtatgatagataactaggatgtatgtatactatgtatactagaagtataagaatatattctctttctattttcttttcacttagcttagatattttagtatgagaatgagtagccctgcttgtgtgtcactctacccttggattatcttaacccctgcttaggctacgattattacaagtaacttataaattattagtccggttctctctactatgatcttcccacgggattaaataaatacgatacccttcgaatactctcgggtgatatactacaatggtatatacgtgcgcttgcggatgaactttgtaaccataatataccaggagtatttctgcgtcattgctgggaattatatttctagtaatgtcgttaaaaaataccaacacccggcacggtccaagtcttactgggctgtgcctgggccgtgtgtgcagcccgtgggctagcacgacacggcccggcgtgtaggtcgggccgtgccggcccgactgacctcagcccagtcccgccgtgcctgggtcgggccttgccgggcggcccatttggccatctataccggcgtctagtctttttagggactgtctatccatttgtcgggtgatttttggttagaaatcacccgacaaatggatagacagtcgttagggactatgggtatgagaaattgtcagggtcagtggggcccaatgcatggctatagcgccacccctagctgggagaggatatcgccgagagaactcgagatgatggcataccttcgccgcttcgcatgagctccagctccaccaccgttgcagctgcctccatcctagcttcagttccaccgcctccaggctccatcaccgttgcagtcgccaccgcgctagctcaagctctgccgcagcgccgtcccaagtgacttctagctccgccactggccgtcgagtgagcgcatgcaggagagcagtagggtggcggcgtgcttgcccgattagcaagctcgacgggctagcccctgctgcgggtcagcaaggggaggaaacaaagggtatgtttgggggagcttaaagattctgagaagcagctgattggtagctagcttctaagaatctgaaaaagcttgattttcctgctttaggcttctagttcattttcaggattctatagatataacttctcagaatctgaaccaaaagctggactgtttgaggagcttttgattctgggagaagatgcaaaactagaagctcccacaaatagacccaaagaggtggtggggaatgggattgtgagaggctcatgtgagagaggtgaacctcactaatttttttaaaaagaaatgttgattggattgccacatagaaccaaaaccacttatgattgagtcaagggggtgagggggtggtatttgtccggtttgaatagttgagggtgaaaaata

SEQ ID NO: 34099 - DNA, 532 bp, Oryza sativa
ttagaaaactttcaacttggatttgaaacttttaacccagctttgaaaacattcaatccagatttaaaaactttcaactcaaatttgaaaactttcaacttagatttaaaaactatcgacttagacttgaaaactttcaagtcaagattttttaaaaaacttttaacttagatttgaaaattttcaagtgaatactttcaatttatttttttaaaaaaatcaacttacattttgaaacttccatatctagttttgaaaattttcaagtcaagatttgaaaactttcaacttggatttgaaaactttcatctaaaaattcaaaacatttaactcaaatttgaaaattttcatctcaaaattcaaaatttcaactcaaattcaaaatttcaacatgaaaggttcaacttctaaaataaaaaaaatcacgaaaaacatggcaaaaagaaacgaaaaaaacacatatgttagcttttccggaaaaaaaatacaggacgtgggcgccgtccgcctcacgtatacgcgccaccgcagg

SEQ ID NO: 34100 - DNA, 398 bp, Oryza sativa
cttaggtcatttaccctttcacaatcaatatataactatttacaatcttcctcttcatatattggtgtccctcagtccttacttcaccgtttcaccacggtccacaatcaccaaatatgggactattcaacaatctcccccttcatacattggtgtccctcagtacttcatcatttcatcacggtccctcaggtatacgggtcccgcaggcacccacggtccatcagtccttcacacactgtctatcgggtcagagatgttaaactagccagactctgatacgaattgtaggatcgtaaaagggcctttcctacccccaaaaactaaccattgaggtgagggactctcgcacttatatttaaggtaatttgccctttcacaactaaagcagagaatga

SEQ ID NO: 34101 - DNA, 899 bp, Oryza sativa
cattaaatatagataaaaataaaaattaattgtacagtttgtatgaaaatcgcgagatgaatcttttaagtctaattagtccatgtttagctataagtgctacagtaacccacatgtgctaatgatggtttaattaggcttaaaagattcgtctcgcggtttccaagcgagttatgaaattagtttttttattcgtgtccaaaaaccccttccaatattcggtcaaatatctaatgtgacacccgaaaaatttcttttgacgaactaaacacacaccctgagtgtgacctgactgagagtacgtgttgcttaaagaatgaacagggtagtttgggtaatcacctttcttaagtcaacggggtcaaggaagcagagaatccttaacaatatttaaggcacaaattcctaacagttaagttcaacactccctatgtccacaccaaatactaacaaaaagaactcttcgttcacgcttgtacacaaagtttctttttgacatctgtacagagtgaaattgacactgttttattccagttcgttaaaaaaagtactaagaaaaaatctcatgccaacacacacagaggagggtctctataaaatgttaggagatgtagatggtctattattcggctaatttcggttaatcaactagtaaatacagtctttcggtgcttcgaaagttatcaaggtatctgcagttttacaattcccttttgggcggctgagatcgagtgttcagtggagaatcttctctgttgcatctgatctgagccgtccgttgcaaacttgcaacatccaatgagatggctccaatgacagtgtctccattgtctcctccaggatgagctctcatgacataaatactgctcacacaagatttcagtcagcagctgagctcc

SEQ ID NO: 34102 - DNA, 500 bp, Oryza sativa
cttttcacccatggaacaaagggtgtgtttagatccagggtgtaaagttttggcgtgtcacatcaggtatacggacacacatttatagtattaaacgtagtctaataacaaaataaattacagaatccgcctgtaaaccgtgagacgaatttattaagcctaattaatccgtcattagcaaatgtttattgtagcaccacattatcaaatcatggcgtaattaggattaaaagattcgtctcataatttacacgcaatctatgtaattagttatttatttaatactctatatatgtatcaaatatttaatgtgatagggtgtaaaattttatgagggatctaaacatggccctatatggtttttactgtatatttcttccgaaagtgcagtgcagagagcgggtggggggctcagcctcgggttagcttggctacacgcctacgccaccacccctcggaactcggagcccattgcttcctcggccccctccctcggaagg

SEQ ID NO: 34103 - DNA, 1501 bp, Oryza sativa
gttaatgtagatactgaaatcaatggttttactattgtttaccataatgttctttgataaaacatgataggtcgtacgtatatcattttcgaacatggtagtatattgctactatagtggtgcaccaccctctgttttgctctagcttcgccactgaccacaatctgcgaacatggtgacgcttctggtgtagcagcatccaccctccatgagactgctctagtcacgcatgtgctggtgccgcccgtcatctcctatggcttggttcaaccaaaacttcgtccttgcagccaaagatgacgaaatctctatcttcatctttaaaagtagtgctctggtgttatgccactccgtacaacaaaatataaaaatatcattttttttctacaatgatgattgttaattacttctgttataaatattgtttgaaagaccagcaatattgtcaatatccaactttcaagctagcaaaatgtatgcatatatttttttatgaattacctggcaaacctatctctagttgtgtcatatacctatagtcccatagtgtgacttttggatgtacatcgttaatctttagaaaaatataatgcgacatctcagtactatttcggttggtcacaagaaaatcatattattatatgtactagatttttcaattatacaaagaaaataagtagtcaaagttgatttttgtaaattgtgccaattttaaaaaatgatacattttcatgactggagggagtatacttgcgacagtttagcaataccaaacaagaccaacaattcaatgcacttgaccaagtatttgaacccaatacactttgtatgaagcaagcactttaaactaatacccacttcagctatttcagatgtctagtcaaatggccagcaaacgttaaatgatagtgtaattatatttatattagtacctcatcagtgtcttgaagtccagaaaaaaagagggtgagtccaaggtatacctccatccgaatgatgctatgcctgaaaaccttcaacaccgtgtgaattatggtgagagtaatttcgccctacgcaaattatgccagtaacgttctctatgcattcaaggcatccatatatgtagcattcatgtgagcaacacattttttccatatcatctatgttaaaataaagcagtatgaaagattcatcaagaaaataaggcataagccaacttccaaacttgggagtgcttatctggttatctaccatccatacgtaatcgcctagaacttcaagccaagcacatcatcagttgcacactcttttaataaagtacatatgacaaacaacacacctaccttaagttttttggatgcagtcatgttacacctttcaaccctcttctatgttctaacagccaacttcgtttttgcatcacaggctataaaaaggggtggcatccatagctgaagggacacacctagaaaatttaatagaactttacaaattgagtgttatagtgagatggcatcgg

SEQ ID NO: 34104 - DNA, 1501 bp, Oryza sativa
gtttgtgggaattccccgatcctcggttaatctcgccgtgttgccgtcgcttgagcaggagcagggatgcaagcgggacaggcaagcgggtttttttcccgcttatcccacttctagtctatcttttttttaaattttgtactactataaaaaaaataaactagcaagcaggtttttatgcaggtagcgggattacctacttacatccctaagcacgaggttgccagcatcgggcttagcgtctccactcgtgttcgtgttggttcctacctctccaagtctctacaagtctaatactctcaatctcaatgaccaccataacaatagcgtgcatgacgacgggagaataaaaaaatatattgataactagagggtgtggctggacatgcaaagacgaagcggagggacggtggtggtctcattgagaaagagcggtggtggcggtccgtggagcggcaggtagtgattactggtggtccgaagagtttgctatcgacacaatctctaatcaagtttattgtatttttttctctaagtagtgctaatatgtgagccaccaattattataaaaaaatatttcctcagtgtttcttttcccatggcctctgactatgacattatttaaacaagttttatactgagacactttctagtagattttggacagatgtgacacttttatattttggacggatgagacactttctaatagattttagacggataggacatttcagtaggagaaagtgtcatatttgtttaaaattagaacagtggaattactaagccaggtttaaagtaagaaaaaaagataaaggcggagatactcgagtatcttccctttccttgcgtgtaaaagaaagtctcccgtctcttctctcccgctccttgcgccatctcgcggctgaaccggggaggggcgccgatctctatccgacgagcagaccaagggaggggaggggatcctggtgagcatctgcatcctctttctgattcatctctctcaccgggagtacttttgtgtaatttgcttgcgttaaccctagcttatcttctagatctggaagaagctctcctcttaatttcagagccttaaccttaatacaaataacagtttgttgtttgttccaccaaaagtttgggggttcaactgaacccccatgtcccaagttggatccgcccctgggtgtaggtgtaatattgcgatagagatctcatgattgattgctatctcgttctcgtacttactgcttcttagtttcttgatgtgatcaaatagctgccagtcctttccatgtaaataactgcagatttcttgtttattacacgttttgaactaattgtgggcttcacattgtcgaattttaaggagttaatttgaccttgggtggaactgagtttaatatacaaaattattctttccgattcaagttttgcttatattgtactccatccctcgatgatgctagggttcacccaaatatttgaagacccaagcgtt

SEQ ID NO: 34105 - DNA, 1501 bp, Oryza sativa
aatcttgcagagctgctgccaccgagcaattcttgtacttgacataggaggaaaggataggtgcttgattctcaatcataattcattcacccaagaattcaagattagttgttacaatactaattaattcttgaagtagatagaaataagtgaattagtctacttccttagtgacaaaagacaaagtttttttttattatactaggcaattcgtgagagagataaaaaatagcacattgagttagaaagataattattagaactagttacacctctggactgattagttttctaaggaaagctgaagataagtctttatacttgcagagactttagggtacaacagatgaaacgaaatacagatgccacagatcataaaaaaaaagtacaataatttgtaaatagatcagaaagtcataaaagaaaaaggcacaactgatggagtaggtacaacatatcgataatacaatggcacattgcaattgcggattatgtctagatcatccattattcttttgctagttcgttgtactcatctatcaccacactggggttaggggaattcttagccttttgaatcatgcttgccagttgtttgatatgagatgtctttgccctagtatcttcaggtgcctggctgctgactgttaaaaatacctgttgcagctttgagaggttttccagaccatacatatagtccaccattctgaacctcagctcaagcctctgaagctccggcattgctccttctagaaagctcagagaaggtagcacaggtgccgcaaaatgcagtagcttcagcttttcaaatccctcatccagcacaaagatcttacctcctgacttcattgtattcctatgtattattttgagagcatttgaatcattgtctgctgcatggagtgaaaaagtgagagagaataactcaggcaggctactcagaaccaccaaagtatctgtcttaagtgaagtcaatgacagagtaagcttctcaaggttgtgcaggcggtcaatccatccaggcgctttagataacatgccagaaagctcgagggtgtacaggtgttctggtgctgcttgcgaagaactcagtgagctttcaaggaaacctgtgaaactgtcatcaattgcaagaaacttgagggaacaactgctcaaatgctcaatagcagagagcagtaactcatcgtctttcgcttggaactttacaagcttgtaaatggcaagtttcttaaggttggtgagcttctccaaggcttcaagaggacgcagctgttttggaaggtccactttgctagcttctttatgtggaccatgcaaggcagtgttgcctctctcctcggctctggtggttgtagagtgtctgatgggcatatctcgtggctgctcccggtcttcttctaaagttgagcttccactgatctcaatcccggaaagtgtttgtagagctacgacctttgtaatttcctcagttaatttcaatgctgtccgcttgcttttg

SEQ ID NO: 34106 - DNA, 1501 bp, Oryza sativa
tccacataagtttatttgccttatagtgtactattaaacttgctctaatgatcttccctgtcattgaatgcttgccagagacgtggtattgtcggatctctctttctgaaaaagaggggcctctgctagcctgctagattctcatttatagcgaaatgtggtatgtttttcatttttggtagtttgcatctatctctctgttaggttcttttcatctggcctgaaataaatgctcaactattcaccactttgctgtacccctgtattctgtggacatttcatacttgactcatgaaaattttcatgtttgtatctcatgttttgtgtgtaatgatcgtggctaagctgtagtgtactcatcccatcatgctatcttgtgtggagtatgctcttctggccttttcataatttttgccatttttctgcccttgtctcaagcaccagtttgccagttgatggatcaaaatcaagagctgcactattggaacaatctacatcctacggaaagtcgcatgcctggcaagaaatatctcaaatggtcttggtagatgtcacatgacaaaagggttgcttttcacctttctagttctttgatcttcttatcagttgaattcactgatctgccctttcttccatttatttggtctttgaaaaaagggacttccatctatttgtttcttgttttactaataagcattgtgacattccttgtgacttgcgttgtttttctgtgtcctgttttttacatgtatttcagatgtacctcttagtgacaactattttgtctgtcaattgatggtattagatttgtcctccgtgatttcagagttcagacagttatcatctctcttccatcagtgccattagtgccaggttgggaaagccttatttgctggcacgttttcttttttctttttttttttttggtagtgttgatctgcgtcatgttctgttgttatctgtagatgtctattttcaaagtaagcttgggaacatcctacctttaaaaaaaatggcttgttcagcagaaatattagaggttgttttatgcatcggcttttgggaggattttgtctgctcaagtcatgagcagccacgcatctcctgcctttgcattgctctggtctgcaacaattatttctgtgctaactcttcagcctgttcaagagccattggaagtttggaacaagtgagccagtgaccagcattgcattgcacctcaacaaatttttgcctcttccttttcctagtgatgttgctttctcaatactttaataatagaacattacaacccctctccctctcccaccctctctttctaacatcacttttggccggagtttacatcctccaggagaagctctcaaaatcctgagtactgattctgctgaggctgattatgcatcggttgcagctcggttcctgtgggactgacgctctcggtgccaatgaagttcctgttgcaagagaaaaaagagtcaatgccagccatgttcatctg

SEQ ID NO: 34107 - DNA, 1501 bp, Oryza sativa
tgcttcaggatggtttgaggaacaagcttgctcccgtgaggcctccgggagaagttagccacaatgtggcactggaaatgagtttggcaccggagtcgacggtggagctccatggcaagagtggtcttgccaatgccggcaggtccagcaatggccatgacccggaggctctcgtcggcggccatgagccatccgagcagctcgtttgccgtgccgtcgatggcaacaagatgatcatggacggtacaggcctcgacttgggctgcttgaggcggtgatggcatgagctcagagcgtagaccattgaacacaaggtagagagggtataccttccgcggaatgtcatagccgaatgaccttcggcggcggaagcgccgcgtggcttttcgcagcggcacgcaaggctgattagatagaaatttcacgatagccgtgaccgtattccgcactccgatcagaacactcatccaggtcatcaggtcataatgggcaccatcatcatgatccccaatggaaggcgacatcggcatcctcaggtatgcgacaatggcgcccagttccatctccaggaacgccaaaccgtgcctttcgtgggcgtcggtgaagcgtccactcttcagcagcttagagacactctcaaggaggggctccaactccttcaacgccgcctccttcttctccatgatggaagttcttcccatcgctccctccgacatgatccccggccgcacgcctgcaacactgtacggtaagtactcaagagatagctagctagtgcggcagaacaaaattactgcatcatgtaaacaactgtattgcagaatgcagatgcatgccgaatgcgagctaggcagatctatctctagcttgcctgagagttctgctacttttacttgctttgcctcttctctgctctcccttgttgtctgtcatttccagcttgcaaagcgaagtagtagcaattaattaacactgaactctgcatgcatctcttctcaattactccagtagttttcttcttcttatagcactttacacattattcttgccatgtgcatgtcacgttactaaggatgatgactttgcttccactttcgttcattcctccggtgctatgttccaaaagaagatcctccagtgctattatcaaattaaaaagaagatcctctcacacaagttcttttccaggaaagtaccactccggcaagttaaaaggcgcgcgattggacacaaaacctctccctttggcaacatcaaggtacattggcattgccatttatcaactcctcactacaagccatgcatacacatattcgtttcttctatctcaagcgacacattgcgtaactagtcatgcatgttgtgtgcacctgcgacatggaaaggagtgaagagcaaacactgccgtgaccaagaatggcattcattcccttgtgaaaagaaaaaaatccacatgagattgatcgattgatttggccggtgattaagcgagccagatcga

SEQ ID NO: 34108 - DNA, 1501 bp, Oryza sativa
cactttctaatattaaattcatttgtttgtgccccaaataattgtcataaactcagtttcatccatcatctatatagaaatggcctagtacagatacagttgctgtaatgcgctgcgcttgattttaagttgcttggaaaactaaaacttgtattcattataacttgttccattgttatggttaaggaaacatgttatctaactgtcatgcttctctcaattgtttcaaattcgggatgcaataatgtttttttacactgaagattaattttgaggaaaattgatggtggtttgcgttttactgtactactattactattacaattttggagtaaacaatgcaaatactagtgtttgtctaaccgaccacgtctttactctgttggttttacaaatgtatcataaaacatcatgacttgtgtagactttatactgcctctgttcctaaaatgttgtcgccattggtaactaatttagtttcgatccctaataattagatggttaggctacatgaaaatccctaaaatcccttatattttaggatcgggggagtacctactatatgcaactaataaggtagtatacccctgatatccatttctatcaccatccggttacatccccagcattcagtaaaaattcagcattcactgctacactacttatacacactggatgcagcagaaacgaaaaaagaataccatcttcttttcctgtccactctggcgtccggcctataggagatcttgaaatcataccgtgaggagtattgagcatgtgattctattgtggttgtgatgagcctgctgtttcagctgtctggtacttggttgactcttgcacctgctccatgacgaaggtaacgagtggctacgtacgccgtggccgtgctaatcaatgggcgagctctgtgaagaagctaactcccaaccaactattccaactcggttattaaagccaatggtaatcgcccaacgctgcatgctgcactttacccttgtaaaactgtgagcgttttcctttggtggatagaacagttgggatgcgatgcacggggaaaagggaattgcagacacgccagaaaggcagagacattgccggtatctatcacgtgaaaatgtgatgctgcaacttgtccgtcccatgtatgaattcaacattttgggtgagaaaacatgtttttgctgttgtttacgtagcttaccgcagggattacctcctgcgtgttagactgcaccagtcaagaaaacccactacgttacgtgaagctagcagcatcgatcgcactagtgtcgctctctggaagtaatagcctcttaagttagctgcgagctaagcctgcaattatacaccgtctccgcctccccttcccatgtcacaaccaaccttggatatattaactccctctcccgctgctccactccactcccacaccatcagcgagcacctagcggtcgcatcgctagctgccatctcctggtgagatccatcgagacgcccg

SEQ ID NO: 34109 - DNA, 1501 bp, Oryza sativa
aaaattgaaggaacaacaaacgtgtgttcatgctgagccaacatttttttttcgtttacttacaagtagcggctttattatccacaaaagttgcaataatccaaaacaagcacacgactggaaaaaatcttgtctatcgtcacaaggaaatgaaaggcaaaagcagggaggaaaaggactttcactttttcgcaagcaaattctcacatggaaactaagcaagttgtgggccggtgtaactaacagggaaacgaggcgcaggcgccctgactaaaccttgcagttcatacgggcaattgcataagagttaggttgagaaaatcagaatgatcaacaaatttcaacatgtatttttttttccaaacacggaaaagcttcacaatcaagcggaagggcaaccacacattcaaatacgcatttcaaggactagagaggactaggggatgctaatacttggtgaaaaatgactgcttcacatatactaggcgtccccatcttaatgaaatttggtcgccgttcctttcggccgacccggcagaaaacatatactaggcgacaagtggagtacttgcaaacgaaacgggcgaccgtacaaaactttgccgtattggtgagagtatccggtgaagttactagtactccatcaaattgcctagactatttcagcagggaatcgagaattcgagatctgtaaataactttctctctgcttaaaacatcagcaaagtctggctcggtttcaaaaaaaataaaaatcgagatctggaaaacgcggctcgaacttgccgtgttagattgtaccgagagagggaagagcaactaggggttttagttacctcgccggactccgagtgtagattggtcggccgccgtcgtgttggcgtcatcatggcgtgttgccggccgaggaggagagaggcggaggcggactcgcggaggaagcctcttggcccttggggcggccggcggcgtgccgccctagttgggtccgcaggtcgcgggttcggggtccctcgctggctaacttttactccagtgggctttggcgtgcggctcttcccttcatggcccgtatggcgatatggaattatcgggccttagttgatgggccagcaaggcaaaacggaaagtaataagttcatttgaggtcccttaactttacaccgaatccgattttcgtccttcaacccaaaaccagatacaaccggtccctcaactgtccggtgcaaataagatccctcggcggtttggaaggcagttttggctaacgtggcacccacgtggctggtttgactatgtcttcgtccctgtaggatcaaggaggccgactagaggggggtgaataggcggttttaaaacttaatggcacttaaacaaaactaacctaagttgctaggcaaggtgaggtgcaaggttaactaagcaactaagttaagttttgtaaacctaggtgatatgggctcaaatatgtctctatgaaaataaattgcacaaatgtaaa

SEQ ID NO: 34110 - DNA, 1501 bp, Oryza sativa
  unsure (1)..(1501): unsure at all n locations
aacctgatgttcctgaaaaataaggggtannataaatgaagccataaagaagcgtgtantnncatcaatntgtcagttggcatgcnttaagtgaaanntatgtgcatagncnncatggtatcanttctaaagaannatcttanngcggagctatananngatatgtgtactctctatagaagagagctcnnttggcagccanannttgcgtctgggagatatacatatggcgtacgcaccaggatactaacctctttttgggcgtagagtgccttctctggtgtctatagtgcgtcataccactaaagtggcgacagttggcacccagaatacctgtgtatagttgacacttaacagttagagtacaaacaaagatcattctccaattaagttaataatcaagatttaattttcttctacaatgtgaggtatcagctcaaattgattgccaagatattgctttccatggaaatagcattgagtagatatgcaaactgcacagcagttgcttgtgatgggtgatagagaaattgcgaagtacctggcccctgatgagatggctgctttatgcaccttcaaaccataataacctttgcctccaaatgctgggagtagtgaagggtgaatattcaaaatggattttggatattcctgaactagctcaaccggtataagtttcacgtaaccagcaagtataatgaagtctaccctgagttccctatttcacataagaaataaggatagattgatccgaatattgagacctattgcaagtaaccaaaacaaatctccgcagtaggcgagccagtcttgtagaagaggatataagtaaatctacaaacaccataaaacatgcagtggctattcgtgaaaaaaatcaacagtggtacattacagtatatcagctaggcaataacaaaatggaaactaatctgactgactgagtgggcacaccgtacaactgatgaagaacacactccaataggttcctgactaaacgtcaacccagagcataaaactgatatcaaagttcatctggcaaaacaaggtagtgacacacattcaataagtagacactaaaatctttaaaatagttatcaattcatcttcatttgacggcttcgaacaacagtacccgcacacataagacaggtgaatggattagaaaacttttatcagcaaacaacacaacaatgtatcatgtatgcatttttcaaacaagacttaaggcaagtgtgaaaaatctcagatgttgtgtgccttgtgtctaccattgtttctgcaaatccacttattttaacacctacctaacagatgagctacaaagctactagaaatcgaatgccaaagcctgaaggtgagatcaaagcaaccaacctcagagcattcaacagctcatcagtagaaatcccctctggagtagacttcgaattagggaacacaaccaccggtatcccattacccctcgcatgctccgctcctccacaacctacaagccaca

SEQ ID NO: 34111 - DNA, 237 bp, Oryza sativa
ttcagttatgttgttttatgtgtagcatcctcaccttcactttagttaaaagcaaatcgggacacttacgaggctatattaatttgtgtctatagctgtaatatttccaattgtcacttttttcaaggcaaaatattcattacaaaatttgatttctgtactatacaatcgtgccttgggaattctttgatgatttctacttagggtgccaaatcaattttctgtcaattatgtagg

SEQ ID NO: 34112 - DNA, 1501 bp, Oryza sativa
catttttctagcgactgggtttcaaaattgtagtactaggtgaaaccccacacattgctgcgggaatttagtatgataacaacgaaaaaaaaataacgtgtaagatagctagataacatcagattaagtaaattaatgtggcttatgataatttaaatttaaatagtatgtagaatggtgattcaaacgtaaaaagtaaggaggtatgactttatggaagaagaaaagtagggagatagtttggaccgtagattaatcatctaaaggctaaaaacaattgatgtgatatgacttaatttgaggaaaaaaagagaaagataatttggaccataaattaatcatttaaacattaactaagtgatgatgaactatataagtatatatgatatcataaaacataataaagatatacactgaaacattatgtgaattatattggatgataatttaacatgtttgtctttgaaaagctctataaagatataacatgtttgcatgatatttaaatgtgatgattgttagtagatgatgatatggcatgcatcttgttagtggatgatgatgtggcatccttgtatgttaagcttaagtagttagtggggggtaactttatagtaagataggatttgtgagctacattctgatttctcatgtttcacttgtgacagtacggcctcgccatcatcgtcagaagatgagtcagaggatgatctgttgttcagtagttgatcagcatgtaatgagtagcaaatgtatcaaagcttaacagtccgatcggatcaggtggcttgcacgatggcacaaaaatgctagaattttgcttttgttttttccagaaagtatttagtgtagctttagggagttcctgatgtgcttgtagggcggtgttcttgtgtgtgtgtgtgtgtgtgtgtgtgtgtgtgtgtgaacgatcggtctgtatcttttcttttatcagtgaaatgaagtagtagatcttcagtctctgttttaaatacacacaccaaaagatctaatcaaagaccatcaagttgtatgaaacacaatcttcttagcatgctagtgctaactacactgcactggagtttaaattcgaagaaaatacgtgggcgtgtttggatggtagccaggtgtatccagccaacggttgttctgagttcgattttttttggccagcggttgttgtttgcctttttttttttttcttctgttccgtgttcggtttatggctcggctttcaactccactaataaaccgacccaccgataaaaccgaaaattagcctctagccattcacgcgacggagggaggctggccgtgcggaggtggcgtgctcccggttttcttcggccgaaaccgaaagccgaactgatattttctcggttttttttctgcaaaccggaataaaccggtgttcgctgctcgccgttggattgcgcattcgattcaagagcccaaccgcacgcgaaagtcagagaggatccgatccgcttgcgccgcc

SEQ ID NO: 34113 - DNA, 1213 bp, Oryza sativa
gagcaagtcaacaaacacagatgaatttaagaagtaatgaggtattacatattctcaatccgtggaatttttttaactgtcacgatgcaaagagaagagggccaaagacacttaacaacgagtaagggagagacaaacattgtgaaatcatgaaacaatgttgaggacagcaattcatgaattactctataaagcaaacaaatataaatgttaaagccaattatttacctccaaatctcctggttgatgcatgagtggttacagcccctggcagtgagcacgtgacaagtgttgacatggaggacacttttaagatctacaatcaagcaacataacattgtcacatatgaaaagaaatgaaatgccatgccaaatgattgcaaaatgaaataactatttactacagagtgcataaatacatggcatctcaaacctgatttgactgcttgagaaacaacacagtatgctcagggataatgttatcatgcatataaaaataatacttcctccgtttcatattataagactttctagcattacccacattcatatagatgttaatgaatctagacacatcattaacatctatatgaacgtgggtaatgctggaaagtcttataatatggaacggagggattaagtcacaacacaggtttgaaaagtatgatacttgtcatacaactccgatatcaccatagtgcttttaaaagtgtagtcgagatcccaccccatatgctcaacacctcaatcgtcccgacacccattagttttaaacaattgggcagctaacaatcatcaagatgatggattttatccaacagatagtgttacccccataagtaaaaaacaaaaaaaaatctataacagtaaccatgatccccaatttttaacaatgctaaccactgccgtcaacacgatcctgtttttgcagggttctacagggagcacggttcaggaaaatttcccaataaccaaaaaaaaatgatcatgaaggggattagcatgatctttgtacaggttacctcccaaaaacaaagaaccgctgcggcagattaaaccctattctccaaactaaaatcacaaattattccccccccccccaactaagtatcgaaaccacgtctttatcaaactctccaacaggcaggatgacatgcccacgggatgaaatcatgaaatctctaataacccttgaccccctcactcacctagg

SEQ ID NO: 34114 - DNA, 1501 bp, Oryza sativa
agccaccatcaagattaagttctctttgatagcacgaaacctcttaagcatcacaatagtagatgcaaatctagtatcagcaatggcaagaaatttcagcttactaaaatcattgaacatggagagcctcattgagtgattcataatgaaattctttatggcagatgcatctgtagccacttcactaatccattggaattctagaaaagcatccccactagagtttttggcagcacatatactcttcaaggctaagttcaaagtatggacaacacatggtgtccagaaaatgtggctgtacttttgttcaaccatcaatccagcagccctacaattagatgcattatcagtaataacttgcacgacattatttgggccaacctcttcaatgatggcaaacattttctcagcaatatattccttcctcttgatttctccttcagtattgattgcttttaaaaacattggtccatcttctgtcactgcaagaaaattcaagattggtcgcctttgagcatcagaccatccatcagatacaatactcacacctttagtagaccatgttgacttgagagcattcagcaagcgctcaacatttgtcctctcttgaacaagaagtgttgttcttaatttgttgaaatttggaggggtataaccaccaagttggttgttgcaagcaaactgaaaagccttcctgaaatatggatttcttgcaacattgaaaggaatacctgcaaaccaaatgcacacatataattagttgcacgtcataaacaaaacaaaattgataatgttagaactgaaaaaaaacatgctatattctgacctgatgtatagaacatcctcgcaatcaaagcatcaagcttggcacgagcatctaaattgaagcttgactcaatagctgaaacagcccttctcttccccctactcacactctctgttggtagtgggatgtccttaggcaaattccttgcagagattgcttcagctctagtcatttcatcttgaagttgcccaagtatatctactgtcacctttttgcatgtagccacaccaattgttccaattttcaagagatgtgctttaactcttgagtaactcccatggataacttggttacaaaacctgcatctgaaccttgcattccctccttgacctttccctgtcttttccagcagctcaacatacctccacaagggcttcttttcatcatcattgggtggaatcacacgagcagcattcaaaatgctccttgcatgccctcccattgttgaaccactcccactagatggtctcgatgcatcaaaaccagtattaccactaggattgctagcactaccactatcattcgagcttccacttctaaaatccattgaatctaccaaagatgacagcaattatactaagaaaaattgaaccggaacactacgcacagtgcagatcaaacttggaggggatattcacttacctaaggatcctcagcgtcgtcggaggccgggat

SEQ ID NO: 34115 - DNA, 1501 bp, Oryza sativa
tcggagacattcgtgacaggcgaatgcttgcgagctagactcacccctcctattaagtatcaacttaggctgtgtttagttccttttaaagttaaaagtttatgttgaaattggtacgatataactgaaaagttgtgtgtgtatgatatgttgatgtgatgaaaaaaagttagaagtttagatctaaacacagccttatacatactcccaattaacattaagaactcgtctggaacatacgaatcttacaggagcttgacttgtccttttgcagcatttgctaccatgaattgcggtaggcttcaagggaaacagattacttactttggaaggttcattcggcgtctttggggcctcgtttgtaatgttgcaattttacgtgaattttgaagggaaaaaactgtttcccatgaaagtcacgtagaatttcttattagttcaaaagtatggtctctgaagtttttcctacgctggatgataatttgtatgaagtaaaaaaaataatttgagcaaataggtatgctgtagcggtaggtgagaatgaactagaactatcaagggcggtctacacaacttatgatggaaaatccacccgacattgtacaaatactagatcattagatttactttgagatttgttccatctccttctagtcagcctccccccctcccctctcccctcaagacatcgatgtcgaggtgccctgccccatcgtcttctctgtctgacggcgaggagccctcggatccgctacctctagtttgttgcttctaaattagtcactctgatttgcccttgccaccaaagtatacgacatagttggagggacaagatcttataagttggttctacccttgttaaactagtaaggtggtactccctgcgtttcagactataagtagttttgactttaattaaaatcaaactttttcaaatttaatcaaatttgtagaaaataataataatatttttaatcccaagataaatatattataaaaatatattcaattacagatttaatgaaactaatttgatgttgtaaatattactatatttgtctacaagcttaatcaaatttgaagtagcttaattttgaccaaagtcaaaacaagttataatttgaaattggagggagtattaaatatgagcacacatctctcataggccgcacatgtcaaattctaattgggtaaggatgtcacacccctctagacccttaggaaaacccttcttttcgtgcttcccaaacccaaacacaaacactaatctatgtcctcttttgttcgtcggcactggagaaagggtggaggtcaccaaagttagagaaggagcacaaacacgaatcacggtttagaatctgtaaagattttgttcctaaattatccgccgaatgtcatttagcaaatccgtgaattaactggcacgcgtgtatattagttcatgtgatagaatttaaattttaaaacttagaaataaagctgagaaataaataggattaga

SEQ ID NO: 34116 - DNA, 152 bp, Oryza sativa
tcttgctccgggtcggtgtctggtccagggaggccggccgcgtgacgactcggtcagcggcacgggccaaccagtggtagcaccgggtctcagctctaaagtcgcgtggcgcgtggctttggacaaaccgtcgggacccgccattttttagc

SEQ ID NO: 34117 - DNA, 1501 bp, Oryza sativa
tgaggttcttggtcactgcacgttctaagtgcattagtgtactttgggcccctgatttcaccatgtttacttcatccaggaacggaatcggttatggtttgtaactttccagtttagtttattgtaattgatgatgttagatgaacgtaaatgacgattttttttgttataaaaaattgaccaaaataggcatcagttttgttgcgatttgttggaaatctcggtctctttattctcatgggaggcagcttgtacatcttataattgcattgtgtttttagtactcggaaatgatatgagcttgtggtttgaaagaaagtctattgagattggtcactagacccgaagcacattgtggtgttatcaggttgctgctaggggaacttctatggttgctcatctgtttgtgaccaaggttatttgtactcgatattgttttgcatccatacacaatagggagctttatgggcatattgactttttatgcttttcatatgtactacctccatcccaacttatatgtactacctccatcctaacttgtccagctgcatagccagaaataaagtatttttgatatttttgggatgtaggtagtatgttttatacactaagcttgggttgactagtccaaattcctaaatggcaatgacttgagggttttgcttaaccccaaaggattcatagtatcgtagatggatattaagttgcaagttatagatccattgattgccgagtatataagcacagtataatagctttactgattggtgatttggtgcacgtggggctttacacatcatggaagttgatgccgtccagtatgtggctcatgcatccaactgattttttagaggaagtcactttgttgcaacactggtgttaatgctgcaagcagggtgctttcctaaccattcataagaagataaagcacttctgataaatcacaagacatagatgtaaaaactagtttcattgctcacatatttggatgtcctatgtttattgatagttatgagtgtatactggttgttatgttatcccaggtcaggtcaacaaaatcggtctgtttgcttttggacagcatttgctttcccttgcaggtttgcacaaacaataatgtgtgacactccctcctcttcttttgcagggaactccatgcctttatgagagcaaagcttaccttttccgttgtaactgcctaaacaaattgtgaatgctttgaattttcataatgttcatttcgctatcagaactatgaatgagcttacgagaacttatttttctgtggtaagaatggtttggtgggtaaaagtttggttgttttctgctatactagctatttttctgtgataagaatgcttatttgacttggctgatttggaattttggatacatttgttaccaagtgaacatatttctccatctattggctctacttcctgaggtgcagtttctggtgcaatgttctcaatcgatcatatggcggcagttcagtatc

SEQ ID NO: 34118 - DNA, 609 bp, Oryza sativa
ttccagtaaagatcctatgcaggatagtaagaaagaacataataaatagtggtagaaaccttgtaaatattaatatcatgctttttcgggtacaaacctgacacaacaaaattagttgcaatgcgcatacggtgaatcacagtctactttagttgatctgttgatgcaacacatcatgattttttaggtacagaactaacacaacaaaattacataacaaatcacatagtctacttttagtttattcaacatatcaccacagtgccgtattatttgttcaaagtgaacaactatgtttttcctttaaaagtaaccactcaagctcacataatcatgtagcttcccacattttagtggtgatcataaacaaatggttactgaaaaagtgcagaacaatctgcttctaaatacaaaggctattatttttatttaaaaaaatagtagtgtgtgctgcgacgtgtaagagcagaatgtgaaacaaataattgaagagctcatgtaaaatgaataaaacagttcttcagagaaacaaacgaaaaacaactggaatgcgcaattatttgcactcaggtaatgaagatagaacagagcaacagacatgtttaattg

SEQ ID NO: 34119 - DNA, 248 bp, Oryza sativa
atggtgatattagaattaggatgacttgattgttgagaatctcaaacatcttatttgatatatcggagcgctagtaggatagatcggagcactagtagtaaaatatgaaataatcatatggaagttgaggaattttttttcatgtgtatttggtttgccttgcttgtctatgttggatgatgcttgttcttgcttttcttgtatgtcgtgtttcaatgatctaattgaaaaatatatttgtgtgtagg

SEQ ID NO: 34120 - DNA, 1501 bp, Oryza sativa
ttcagatacgcatcaccattatgaactattttttgaacacaacatcgccatgatgaacttttgtttaccacaacatcaccattgtgaactagatttatagggtttgattctcaaacagacaaattttgcaacaaaaaaaaaaggagggagaagaagatgtcaaaatgtcatggcgtgaacagatcgaacggttaaatttaacaggtattgcacttcgtaggtatgtataatgcagaatcacctaggaattttacattagtaagattttacccaactatgccacagtggtactactaaaacctaacctaaatgcaacaatcacttagagcatgtacaatagcagactataaaccagctgcaaccatatacttcctccatcctaaaatgtttgacgccgttgacttttttaaaaatatttgaccgttcgtcttattcaaaaaatttaagtaattattaattctttttttatcatttgatttattgttaaatatacttttatgtatacatatagttttacacattttacaaaagtttttgaataagataaatggtcaaacatgtttaaaaaagtcaacggcgtggagggagtatatttttaggagataaatgaagaccaggaacggaaccgcggcgcggcggcgtgcatgggcggctccgatggaaccggtggccgctccggccgcgggctccggctcagccccacctgctacgcggaaacggaaacagcggcggcggggggagccatgagccatcgaggggaacgacgctcacaggggcgctgtcgcggttgcggacgttgaagcgagcggcggcggcgtagattccgtcggcgggggaatcgaatcgggcggaggtgccatgccgagcgccggctggttgtgcgccgacggcgtcacgatcggatcggcgcctccgccaacttcggtgtgactccgcgctctccatcgattttaaccaaggtttcgtaatcatccccccttgtatttaccatagcatgagcaatttgagcagccatcgactttgtgaactacctttgcatctagatttatttactcttccaactgaaacacaagtcaagattcctactcatagtcatcgaaagcatgcaaaagattaaatctacttttatagttttatttatttataatgtaacgaccacgtggttgaatgatgcaaatgccccttaatttttatcttgctactagctgttgttaattcttattttgaattggagtcctgtcgctttctctgaaaaatggggagtgctgtgctgtcctatttgggttgttagctgcagggaaaggaaggttgttcaacttaatcaaatcgtgttgatagtgcccgaattcctcgtagtttcatttggtaggttggatgcataagggtagagtagtggttaattagcttggggaatggagactacaagaagctcaagtgccatctgcctagtcagtggagattgagagagcatcagttcaacatatggagaggttcgcaagta

SEQ ID NO: 34121 - DNA, 1501 bp, Oryza sativa
tagattaatcgctttcatgtcattatctcaaaaagggattacttgtacgtgttgcgtttatttgcatctctaccttcggagaaattagctggcttgcaggtgtgtgctatgtgatactagtataaccgatgacctgaccaccggcatgctttctccatcccaaaataacttaaccaaggatgagatttgatccatcctagaacaacgaatctggacaatcccaacataggttgagttattttgagggcaaaatttgctacagggtatccaaaaatcgtgtaattagccagtgggcactgtaagatcattaaattcgctgcagggcaccaaaaaaagcggtaattagctggtggacactcgggccattattttattatttccgaaggaaaagaagtgagagaattttcaaaatgccgagaatgcccccggtggtgcaacatcttatcctgactgggtccggtcgaaccagacccagtcggtctcgtcgcctcaccacacagccgaaccacaaccctagctggcgactgaggcggcggtggcggcgacccagatctgcaacggcgagggcagcggcgatgaagctatgagctaggcacggcgtcgcaccacactaaggtgatgtcgcctcagaagaagttggcggtgaagaagccgctccgtgtgaggaccaccggatccccattgctgacagatgtgtcataggtccccgaagggtaagcttttctattcctctaattttatgggtcctgacttactggaatgagtttatggttgaagatgtcgtttgcatttgttttatttgcttcctctctgttcttgttgcgttcccataggatggatggcagctcagcttgcagagttgctgttgagcttggtccatttgtcgagtttactgacaacggtaggccagaatttcatgtcactaagaaaattaactgggtgttagacaaagatacgatatgttggattgatctcatgagtgatcttgatgttgaggttaaacatggtcctgctcaggaattaagtgtaaaatttttggacataaatgctggtagatttgctcagatagcatctgacagtgctttacttcatgcttgtgatttgtactgggagcaaaggaggctccctttggttgttgaggtgagtgatgacccacagaataggacagagccttgtgtagagcagggcacgattgaggcaccgggtaatgtgtgtactgacatagtgttgtttacacaacaaagtcaatcaccataaccatctcagccttctactaagtgtagcactccgaaaccgaaaccaaaactagttgacacttggggtgagaatgatgaggttgagtatgttggtgtagctgatgagaaggagaagtataaagatttggtgtcagatgatgaggaggttgatccagattatgagcctgattctgacgaagacgatgatgacttagctgtcgacgatgaggaggaatgtgagtctgtagctcatataaccgatgtgg

SEQ ID NO: 34122 - DNA, 1501 bp, Oryza sativa
gtgtctctgtcccacgaaaaacgaatatagaataaatgttatatattctagtacaataaatctgaacagagatagatccaaattaatagtattatgatgtgtcgcatccaatacttactttgtttttttatagaacggaggaagtacctgctagtatttttttttctttttttaaaaaagaaattctctgtattttttccacaattccgttgaattattgccgtatggagcaaaagtcgtcttttccggaacagtactatgcatatattgtgttaaatcgaggagaaaaaaaatgggtactgtgatgctggagttaaaaagttttttctttgctgtacctggttaaatagtgagaattgaagggtggtgtctaattacgcgcgtcttgcgtcattgcatacgctaagcatatgaggagagttggcaatagggtcatttttttaatcttcctaaatgtttctccgatggttaaaggccattttggttggatagggagagtcacatgcattattcgggtgattagctaggtcggattggcttgattaaataccgtttttagctaacagtcttcacgatcaactaaataaacaaaatacgccttcatttccttatatattgctcgtttgagctaaccaacgtcatagaaaagattgaagggatcaagggagtacaacaaaacacttcatcaccccagttgatatcccgtgcttttactatgggatatgtagatgaacgaacgttataaattatagaaatgatagatacatatatttaaacaatgtggagataatgatttacattgtttgtatattgagttctaaaaataaaaaaaagttatattggcatgatattaacatattgatatttacataatttgtagtgagtgatgatatgacacatttacatggtgagatttagttaacatcaattttatagtaatataggataacaatatgttaaaatgatctacattattttctatgtttttttacattagggacttgtttcatcatgacacttcaacaaaaacattcgaataaaaaagatgacaaaatattataagatataagtacatattatacctgcataataaatgataaggctcggttttattggtacgatagttggtcactacccctaattattatgagtacaatattagtagtgaaaatcgtgataaacatcattgatgacgtgaataataataaaagattagggcttaaaatacataacacgtggtcctagtagttgctactgggtatttggactcttcctctcagagacatcaacttcttcccaatcagccgcttctactactactaactagcctatttcgtcttcctctttcagagcctcccggataaataccccaactcctgcctccccacgctccccctcccgactccgagagattacttcctccaccttccatccatctcctcttctccccctctccctctctctctcgagatcgaacgaacgaagaaccctaggtcatcca

SEQ ID NO: 34123 - DNA, 167 bp, Oryza sativa
ccccaactccactctagactcaactcctggagtaatatttaggagttggagctgtaccaaacaggcccttagtctcctgatcaggcaccttgtgatcttgttgatcctcttttgccaaacaatgtttcattatgtactaatttttcattataccttctctgggcagg

SEQ ID NO: 34124 - DNA, 1501 bp, Oryza sativa
agatgcactcattgctagcacctaaccaggacttcacgaggcgggtagcacgattgacgcatacgatgaggttaccggtgaccttagggtcaagggtcccgttgtggctagtcttctcgatgtggaggaggttcttgttccaagtgatgacctcgtgcgacaagaggttggatggcttgttgaggtttatgacaccgtagcaaaggtgcttagcgatgggctgcttgagcggggagtggggtgtagtggccagtgcggacattgaggtgggaggagttgagggcatcgcgatgccgcggcagcctcggtgtgggtgatcaggaggagcaccggcatgaggcaatatgttgggtgcggcttggcaatgaaatctcctgtggctaggccacttacatgtgggccccacatgttatttgtattctctgcatgctgaccaggatgccatgttagcgaaaccacccatgctttacagccatgggatctactttgcatggttttgaacagttgaggggaagagattcccagtattgaggattaagaatgtcatacgtactcgtaaagttgagggatgacaggtggacttatttgttgatggaactatgttacgtggatttcactagtggaccgaattcttcgtcaagaattggtaagcgggctgattagctttaattgaacagagtgggccaaattcatgtacggattttctcacggctgttaagtggactgtattattagtgggcttactttttcgtgagaaactaaatgggctgaattctgctttaggccgagtttttttcatcggaagtaggagggatacatttgctcgtgagttggattttcgggccgaattaatttatccacataaactaaaaccgaattcgtttgttggtccaattcaaaaatccaaaagcagaatactccaaaacgaaaaaaataaaaataaaaatcaaacaggccattcaaaatgaggaaaacccacggggttgaccggcttgacccaaccaccgtatgtatagtcgggcgactcggaccaagtcgtcccgacgaccacccgacacccacacagctatgcggccccgccgcagagacgcctccgcctccgactccgacgacgccgacgcgcgctcctcctcccctcgcccgcgccgccgccccgaccccgcgccgccgcgcgcgcccctcctcagcagcctcgtggtcaagctgcagccgcgggggccggaggaggagcacggcgcggccgaccggctggagcgccggcgcgatcccccgcccgccgcacgccgccccccgcgggagccctcgcctccagggttcatgcgccgccgggagtcgcgccagacgccgccgccgcagcagccgcacgcggcgccgaggcgccgcggcggcagcgcgtcccctcctccccctcgccgccgcgggagccccctggggtttcggcctaggtatccccagccccgtgaggagccacaaggtatgaaaaaaaaatggaaaagaaaag

SEQ ID NO: 34125 - DNA, 263 bp, Oryza sativa
ttttcgactagaaatagggcctgctttggttgccaagttaccaatacaactgtaatagagtttatatccatgccattataactaataatttagttaggagcagatctaatatagtagtcttggggtaggtgatccacaacttttggcacaatgcttggcaaaacctaattgatgggagaagagaaaatgaaagaggggtaaggtgcaaaatttttgcagtgccgatgtgggcaattttatgtagaaaaatggccatcttggat

SEQ ID NO: 34126 - DNA, 1401 bp, Oryza sativa
tccctagcaagtagcaacatagattgataaagtaaaggcaactctttactcccaactaattttgtggcaagtagcaacatggattgataactctttactccgactaattttgttgccaaagttcgaacaccaaacctgaacaagtgagttttgacctgcctgggatggaagagtaggactcaacttctgcagcgactgaccttgcctctttagtatcaatcagagatgcttctaccacgatcgacctccgttagagccatctcagactccttcggcgcggcctcaactgacgcttacaccagctcggactccttcaccatggtctccaccgaagcaacctccgtgggctctgcctccttcgccgcagtctcacttgcgttcgcaaccgccgccgacgaggttggctgcgtactagagggtggcggcgtttcgtggggggcatcatcggcgcggtgttgccgctactagatcggctaggtggggagagaggttgggggcgtggtggctgcgattcacggtggaggcagccaagagatgcggtctcatgggatgaggaagcagtgagagctctgcctcctttgcgggggagttgccaacggtggcttggggcggcatagcagtggcggagatgcggcacacgggatgaggaaacggcgagagctctgcctcctttacgagggaggcgacggcggcggcagcttactgttgcggaggaaccgacaagagtgcgcgaaagagatagggagaggcgataaaacgagaaaagtcgggggtgggaaattggggatcgatgatcgatctgatgaccttgtgtcggttgatttgtcagtccctccaccgacatttgttggccccagttgtcagtgatactaccattgagaatgttttaaagagtatagattatagacagatagtacaaagaaagaaacagaaatgcaaaatgacatagtcacaagcttttaccaataaaagtgttagaaatttgaaggcaaatgctcaggtattgttattccctgcactcacaaatatttgcacaattgagtatcaaacagttaccaaagacacaggaaagtgctagtaatgccatggtagcattctagcaggctttacggaacatacaacataggagtaattgcttttacctgactgacgaagcctggagcagcttatgtaaaacatggctgcaataaacaaaatttacacctcaagatttcacacaataaaacatacagagcacagtatggttgtgttcatctttaaccactccaatattcattcctagcattgccctttaaattcagttcatgaagacatttctaatggtgaaacttccactgaaacaacccaaccaaggaagtaactacacagtacaaaacattaaacattattacaaagcttcag

SEQ ID NO: 34127 - DNA, 1501 bp, Oryza sativa
atttatatagagcaagggtgagtacaggagtactcagcaagccatgggaattaagtgtttaatgcaggcttcaaaggaaatgctgttgtttttgcaattggttttatttaaactccttgttgaaacaactaagtgagtgcttctcaaacgacacggatgagacagtgcgtctcgtctggtcggagtatgtgcaatgtatcaatctttgaactgattcaaggttggcacccggccaacggctttcaaacggccacccgggcctggctgatcccatcagccgcagattttccaaacattgaacccattccataaaagtaatttcacaagcagtagtcaaactacgctaggaatcacctcacatccgcccatgaccgtgggcacggctgttcgaacagtttaataacctctgcagagggggtacactttacccacatgacattactaacccggatcaccccgcccgtgcagaacggccacgtctggagaccttgaggctttcatgacaaggcatttcgaaagccgacacaggttcaccatatgccaacgagaggggtcccagaccgatatcaggttaggtcccacaccatactgtgccaggaagcccgggggttccccccggcaccaccccgttgaatcgacatgtctcttgccatcatggttcccccgattagctagttactcagccaggggtgtcccattccacccatgtggtcgcacttgccttatgttcggatgaaattccaaggaaacggtccttaagtgcaagagcgggaaaccgtactcccggtacgtcccccggtccgcgattttggaaatttaattttagttcgcaagcaccgacccaggtgtcgggttttccaagtcttttgtaaaaccccaagttttacccatcgttggatgttttaaatttgaggggaggtgttccgatgcgcgtgcctgtaggcccgtgcatcgaagcacaacagttgacaaaggtggttcaagtgttcaataattcaaggagggtaattgcaacaattaggattggggccggtaggctatctcgcaagccgcggccgaaatacttgtgttaaacttattcatgcaatatttgcggaaaagaagtacttagatttaaattataggtgcaagatgatcaaaggtgacttgccttgctcgagagcttgatccttgaaatcctcgcactgcgggtcttcgggctccgaaactacacgcgaaacgggacaactcaacaaatggcgaaaataaagccctattattgacctctaaacgtgccattaaatagatatcaagatttgagaaattttggaagttgaacggagtcaaacggacatacggttgagaagatattgaatttataagattattggatttttggtctaaaggaaaaaggatttaattaaaccctttcgaaaaagaaaagaaagagggaggggaaacagacttccctcgggcggctagggcacggcctgagagaaaggggcggctcggccgagcataa

SEQ ID NO: 34128 - DNA, 1501 bp, Oryza sativa
ctccctctctccctcggattcggttggaaaccgctcccctaatcccgccggcgccattgatggcggccgacctcccgcgccggtttcctcccttccccggccaccctctctcgccccggctctatttaaaccctccccgcacccccttcgtccggttccgcctctcgccgctctctctctccgccggaatcgagctcgcgccgtcgctctctctctccgccgtcgccgccgagctccggtccgccgccgtcgtcgccccggacctcctcccgtttcggcgtcgccttcttcgggttcgccgcaacctcgccgacctcgtccacccctccgttttgcccgccgaccgccggaacgccgccgtcctcgtcgacccgagccgcgccgccgccttcctccgctccggtcgccgttcccgtcgccgccgtcgacccggggtgagccgtggaccgccgtttcgcttcccccttccctcccctctctcgggcgccgctccgccgcgccagtggtcaccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggtgtgagccgggtgcacccggtccaccgtggaccgagaggctgccgcgtgggccccactcccgtggacccggtccgcgcgctcctctctcccggctgacgcaataaatctattttaaattaaaatttaaatgaagaaattcgcaaatatccatttaaatagcatataaacttcaaatggccataacttggccatttgaactcggaattggaccgttcaagtctctaatttttccttaagaagtcaagaacccatttttgtgctttgtttctgcttgttatatggagtttattagagtaaaagccgtttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgatttaaattaatgcattatcgctttatttaaattcccgcgttatcactgttttatttagccttgcctatttacctttgttatggccttattattattgctattgttattattaccttgtttaccctagaataaacaaaaccccaactagtgggtactctattcatggttccactagtataaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccgg

SEQ ID NO: 34129 - DNA, 1501 bp, Oryza sativa
gggcgaagaacctcacttagcgcccccggccgaaccggcaaaggggggcctgcgcggtctcccggtgaggagccccacgctccgtcacaaccgtttcttttcacaaaagcttgcgatatgaaaaaatgtgaagctccagaatcaaacagaactattgcgggtacggagttgacagagaacatacccatcacaacgtctggagcatcctaagcggtctcagcttgaatgtggttcacccggcctcgaccaaagttgttggaagcacgggaaccttgtccacttgcctgcgagctaggactggactgagctgctgctggagtaggagttctggcagtgctgccattagcatgccctgagttcaagttggtaggattctgagggcactgtctggcatagtgacccatcaggttgcaccggaaacactgaactgctgacagtcctggcggtgacttgaaagaggtaacactatttgctgcagtattgccatttggggcacgctgctgcggctgaggtgccggatggttcatctgaggacgaggggcatagcctggctggcggttagcctgagtgaccgactggtgatattgcatgggttgtccaaagcgagggcgaggtgcgcctcaggaagaattcccccgatggttagacttgcgtttcttatattcttcggttgcctcttttctggcatcctcaagtataagtgccttgttgatcatgtgctgaaaagtggggaagtcatgagcaagcaactggagcctcattccaactgtgactcctttcaagaacttcctgatcttcttcttgtctgtgtccacttcctcaggagagtaccgagccaacttgttgaactgacttaggtactcattgacacgactattgccttgcttaagcctgttaaattcttctttcttcatgtcaatagtactttcaggcacatgagctacacggaaagctgtagcgaactcattccatggaatgttagtgggttcgaggtgtgctgtcacgtcctgataaattcatcccgaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagccctcaaattttacttgaattttcagagcacaaataataattattaagaaataaacaaagttaaaaaggttttatgaaaagaaaaaccctaaaaagtccttttttcccccttccccacttgggccggctcggcccatctccctccctctctctcctcctccccgcggcccactcggcctctccccgcgcgcgcgccgctgacgggcgggcccgcccgccaccctcgctgacgggtggggcccacctgtcatccctatcctcccgccgctcccgccgcctcgcccgtgccctagcgccgccgccgctgcgaatcccgccgcctcccgccgtccccgcgc

SEQ ID NO: 34130 - DNA, 1501 bp, Oryza sativa
agtcgagccgccaacaagcgggtcccactcgggaccacgcgagatggacccggcccaccggctacctctttcctcccctcccgcacgtgccttgggccgccttctcgggccggccggcccattatgctcggccgagccgcccctttctctcaggccgtgccctagccgcccgagggaagtctgtttcccctccctctttcttttctttttcgaaagggtttaattaaatcctttttcctttagaccaaaaatccaataatcttataaattcaatatcttctcaaccgtatgtccgtttgactccgttcaacttccaaaatttctcaaatcttgatatctatttaatggcacgtttagaggtcaataatagggctttattttcgccatttgttgagttgtcccgtttcgcgtgtagtttcggagcccgaagacccgcagtgcgaggatttcaaggatcaagctctcgagcaaggcaagtcacctttgatcatcttgcacctataatttaaatctaagtacttcttttccgcaaatattgcatgaataagtttaacacaagtatttcggccgcggcttgcgagatagcctaccggccccaatcctaattgttgcaattaccctccttgaattattgaacacttgaaccacctttgtcaactgttgtgcttcgatgcacgggcctacaggcacgcgcatcggaacacctcccctcaaatttaaaacatccaacgatgggtaaaacttggggttttacaaaagacttggaaaacccgacacctgggtcggtgcttgcgaactaaaattaaatttccaaaatcgcggaccgggggacgtaccgggagtacggtttcccgctcttgcacttaaggaccgtttccttggaatttcatccgaacataaggcaagtgcgaccacatgggtggaatgggacacccctggctgagtaactagctaatcgggggaaccatgatggcaagagacatgtcgattcaacggggtggtgccggggggaacccccgggcttcctggcacagtatggtgtgggacctaacctgatatcggtctgggacccctctcgttggcatatggtgaacctgtgtcggctttcgaaatgccttgtcatgaaagcctcaaggtctccagacgtggccgttctgcacgggcggggtgatccgggttagtaatgtcatgtgggtaaagtgtaccccctctgcagaggttattaaactgttcgaacagccgtgcccacggtcatgggcggatgtgaggtgattcctagcgtagtttgactactgcttgtgaaattacttttatggaatgggttcaatgtttggaaaatctgcggctgatgggatcagccaggcccgggtggccgtttgaaagccgttggccgggtgccaaccttgaatcagttcaaagattgatacattgcacatactccgaccagacgagacgcactgtctcatccgtgtcgtttgagaagcactcacttagttgtttc

SEQ ID NO: 34131 - DNA, 810 bp, Oryza sativa
ccaaagtttataaatcaaaagtttatatacccgattcaaatttgaatttgaaatatatccgattcaaatttgagtttgaattcaaatattttctatatatagtatttatttatatatgtaaagtttatacacctaaagtttataaacccaaagtttataagtcaaaagtttacatacccgattcaaatttgaatttgaattcaaatattagtttatagattcaaagtttataggtcaaaagtttacatacccgttccaattctaaatttaaatttaaatatttatggcgtagtacgaagagaaaaaagagaggagggagcgacggaggtaggggaggcggatctgatcgcttgggtgatcgcccattatgccccactataagggtcaccggcaacaaggaggcacgacgatacacagcaaggacaccaggaggagagggcaacgagctcgctagcagggtcaccatggtatggcgacgtcgttgaatacggccagcgcggggggagggactgagggagggggttgtcgggtcgatgatggcaatgggcgatggcatgtcaatggtctttgggtaagggcgtgcttggttcttggtgttgtaatgtcggaggtgacaacatagtcgggctgtgtacatccattaatagatgtagagaccggattttaatccattttctaaaaaaaaaacatagtcgggcggcggtacgacgaagcgagggtagcggagtgacgagacacgaggtttccaatggccttggggcttaggaaagaggatgttgaggcgctgaggttaggggccagaggggagga

SEQ ID NO: 34132 - DNA, 1501 bp, Oryza sativa
gcgaactaaaattaaatttccaaaatcgcggaccgggggacgtaccgggagtacggtttcccgctcttgcacttaaggaccgtttccttggaatttcatccgaacataaggcaagtgcgaccacatgggtggaatgggacacccctggctgagtaactagctaatcgggggaaccatgatggcaagagacatgtcgattcaacggggtggtgccggggggaacccccgggcttcctggcacagtatggtgtgggacctaacctgatatcggtctgggacccctctcgttggcatatggtgaacctgtgtcggctttcgaaatgccttgtcatgaaagcctcaaggtctccagacgtggccgttctgcacgggcggggtgatccgggttagtaatgtcatgtgggtaaagtgtaccccctctgcagaggttattaaactgttcgaacagccgtgcccacggtcatgggcggatgtgaggtgattcctagcgtagtttgactactgcttgtgaaattacttttatggaatgggttcaatgtttggaaaatctgcggctgatgggatcagccaggcccgggtggccgtttgaaagccgttggccgggtgccaaccttgaatcagttcaaagattgatacattgcacatactccgaccagacgagacgcactgtctcatccgtgtcgtttgagaagcactcacttagttgtttcaacaaggagtttaaataaaaccaattgcaaaaacaacagcatttcctttgaagcctgcattaaacacttaattcccatggcttgctgagtactcctgtactcacccttgctctatataaataatccccccccccagttgctgaagaaaatgatgtggatcctgctgatgaggagttcttccaggagcaagtcggctacgatgagttttagggttttggcctagttcccaagtcacgcctgtgatgaatggtccaagtcttggcttccgctttcccttttgtaatgcagttgtgagctcagcatctatccgcagcccaacatgattgtactcctactctgtaataaagagacctctgctgctgtgatattctgtcttcctgtgataccagcactgtttcctgggactggtatcgattaacatgttaatttggagcgtcacgggctagttccgttcagggctagttcggggcgtgacaaaagatggtatcagagcacaggcttggccctagggcgaaacccgacgtttaggatgaccctaaggatactaagttcaaaaactacttgctcaaaggcttctttttgctttctttattttcagtagtttattgctaaaatggttactgatcttttctccctctttcaaaattgtagatggtagtgaacgccagcttcagttcccatagttttggtgagggtcaccacgtcgctcagcttcgtgacctcgcccgcttccttggcttctcgtgtcccgagtacacggggtactctgtggaccgtgttccccctcgttg

SEQ ID NO: 34133 - DNA, 1501 bp, Oryza sativa
acgcaagtctaaccatcgggggaattcttcctgaggcgcacctcgccctcgctttggacaacccatgcaatatcaccagtcggtcactcaggctaaccgccagccaggctatgcccctcgtcctcagatgaaccatccggcacctcagccgcagcagcgtgccccaaatggcaatactgcagcaaatagtgttacctctttcaagtcaccgccaggactgtcagcagttcagtgtttccggtgcaacctgatgggtcactatgccagacagtgccctcagaatcctaccaacttgaactcagggcatgctaatggcagcactgccagaactcctactccagcagcagctcagtccagtcctagctcgcaggcaagtggacaaggttcccgtgcttccaacaactttggtcgaggccgggtgaaccacattcaagctgagaccgcttaggatgctccagacgttgtgatgggtatgttctctgtcaactccgtacccgcaatagttctgtttgattctggagcttcacattttttcatatcgcaagcttttgtgaaaagaaacggttgtgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgagtgaaggaatacagagagccggagagccagagagagttcaggctctagaacccattcgctagagtcccaacccctttctcttttttctcctccccctttctctcctaggcctgggcctcctttttatctggtcaggggtcaccacaagggcctccaactacctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggatggggcgaggcgtgtgacaggccgcctgttgccacctaacccgcgatctgaccgatctgtgaccggtcacacaccgcgaccggtcacggaccggataagcgtgcgctgcgccgcattaaatgcggcgtggcgcgctcgtccaacttgctataaatgcggttaggtgagcccgctgtgctcacctaacccacacacgtggcgccaaaaccacagggggtcggggcgccccagccctcggggccgaaacgggagcggcccgacccctcggggagacagagggaggggtggccacgtcaccctcggg

SEQ ID NO: 34134 - DNA, 1501 bp, Oryza sativa
  unsure (1)..(1501): unsure at all n locations
ctcccatacacactggcatgaataattctatagctcaggtacatgtgcaacattattagaaagaaaaaaaggtacgtgtgcaaacaaaaactagcacaagccacaaagctattttctccttttttttttctcttgtttcttctcctcatgatgttttgctatgataaccctccatccttgcattaatgacccatattaacacacagatggaggaaatttacgaaattttgtgttttggggtatttttgggaccgacgtttttagaatttttaacttttaacatattttgactgagatttgaataagcttttaccaaattcaacagggaggcccatcatcctcacgcgctccattctgaagcgtgcgaagcccatccggagacctgtccacaacagacacacacgcaccccggtttgccttagtcgccgctgccgtcctaccctctctggacctatgcccccccctctccgccctccttcaaaattttcgccatgaatgatagagtaggagcctaatgcatgccggtgggtacccttacccattccccaaacccatacccacctaaaacgggtagggtatggacaaaagatcctttacccattagaaatagggtggatacgggtatgcccgtaaattaaaagggtatagggagggtgctacccactttccccgtgttacccgtccccaatcgacctcatctaagcgatgacggcggcggcagcttcgacggcggcttcggtgagcatccggcaacagtgactgcagcctcggtaatggagaagaaccctttacaaggtactgcttcgattgactcatctgctgcttcaatttgtgaaatctttcttctgctcaaagcctcaaaccctagaagtaatcttggttgcatatgtgtaaatcttgnnnnnnnnnnnnnnnnnnnngttcttggctttgttgcatccaacatcttgctgattctaatgggagatcccagccatgatcgtgatgcggccggaagttccagtaagtggagaggacctgctgtacctgtagatgttgctattttatactgacaaccattcatgtggtatgtctttaggcagtagaatgaattttatttcaaatgagctccattggtgatattcaaagcttcgatcgaaatctagaattgcaaaatttttcacatgaatcatctgacgagcggcatgatgatgggtaatgtttctacttcacacttctagttaatcgtctttatttatttttcgtgctaatagaactccaatcttttatagtgtgtttaatgtggattttgctttagaatttactaatacagtactttcgtcgattcaattccatagagttgagggaataattgagctaggtaaatatgttagttcagacaacagaaagttcagatcgaaagtttggaaggattttaaagtgtcagtagtggatggttatactaaggcaatatgtttacaatgttctgcccatctagtcactggcaacaagaatggaacaa

SEQ ID NO: 34135 - DNA, 455 bp, Oryza sativa
taaatgtactaaactgttggtattgttgtaaacatgtgacggaataagtattgtggtattacatctatgtcgtagacagctttttgggtttgcagcaataaagtacataaatatctgtttggtgctgtggtacaacaatgtaaatagtttattgcagtgacaatgttgcactgttgcatgcatttttgttaggatcatggttgtctgttgccttgttatgccattaacaaatctagaataagtgaagcagcttaaagttatgttctcgtgctcttaagagcaaacatttaagaggtataatagcattctgtgttcaaactatattttagaacctttgcccttgcttaaatagtttctgtacattaatataaacttgtgaaataattcactaactaattatggattgatttgtttcatgcagttcactgggttaatgtgagcttcttgataaaata

SEQ ID NO: 34136 - DNA, 1501 bp, Oryza sativa
ctgattacttttacgtgattaaagaaagtactttgtgctgtcataaacaataaaaaaacatgaaagtcatatgacagatcacaagattgtacctctccgccaaactttttaacacccaaatacttagggttagagtcacggccattttttgttgatccagctgtctttttggtggcccaacgcttaaaaatcaagctcaatcctccagatgactctgcaatgaggtatattttgtcattcaaacagccaagcaccttattcaaaatagcacaaatacagactcaagtcagtcaagagtctcagactgcctaaagccaaagccattacctgctgcgctagtgtagaccgaaacatttgagatcaattctttgacatttcctctcctgaaaactgatgaaaaagccatcttgattgtctcaaatcacctgaaatcatcgaaagcaaactttcatatattcaacactaatattatactgagggtgaaattaacaatgatacgactatggaagtaccttctccagtttccatttgatagaacctattatctggttactctattttactaaacctaagtttcaacaaagaatcatagtagctaattcttccaattacctaggttgtgatgtactagtctactgaagctctcagttaacttatccccattttatgcaagaaattgaatttaacaaaaaagtagatgcagtaatccaggcagcaaagcacaaagtatattcgtatgtgaagtgtaaagatatgcagtgtttgctcctcaacatctcttataaataaaactatttaagcaagggcaaaggttctaaaatatagtttgaacacagaatgctattatacctcttaaatgtttgctcttaagagcacgagaacataactttaagctgcttcacttattctagatttgttaatggcataacaaggcaacagacaaccatgatcctaacaaaaatgcatgcaacagtgcaacattgtcactgcaataaactatttacattgttgtaccacagcaccaaacagatatttatgtacttcattcctgcaaacccaaaaagctgtctacgacatagatgtaataccacaatactaattccgtcacatcttcacaacaataccaacagttaagtacatttaggaaaccgcaaacaaacaatcatcttattcagtaaaataggaaaaaaaaaggtcatgtatagttccatgttaaggtcaagaaaatagtacatactaggttgaggacctttggatattccaaactttaacatagacaagtttactccctccgtcccaaaaaaactaaacctaggaagggatgtgacattttctagtacaacgaatctggacaaaggactgtccagatttattgtgctaggagatgtcacatccttgcctaggttaagtttttttgggacggagggagtacgtaatgaagccagcctatatatagttataaagcaaaacaataaaaaatgcaatgaccgtacaagatata

SEQ ID NO: 34137 - DNA, 427 bp, Oryza sativa
  unsure (1)..(427): unsure at all n locations
gggtaaggagggcgagggttngggggtgggggtgggtggggctcaggcttaacggggcgcccgaccgagcggaggaatggacggcccggattcggcgaggcgggtggcgctggcacccgatcccccgtccatttgggatgcgcagcgctcgcgctcgcctccgttttttttttttttttttttttgcttgctttttccctcgctgggaatctggaaacccccgggaatggaggggaatccggggcgcgggctccgtttgaaagacgcgggaggggatcgctcttttcgcatcggttctctctctctcggaattttaacgtggtgtgtgtgtgtttgcttatgtttatagttgtgtaaatatattttttaattttaacacgttgaacaaactaaggcccccatcgtttggcttatttggggattaagg

SEQ ID NO: 34138 - DNA, 1501 bp, Oryza sativa
ttgcgtacgtaccgtttccacaaaattgttcatgtagtaataaataactgccaaagaaagctgatgtgactccatgaatgaatgtatactacgctatatctgctgtattgattgctgtagcaatccattcgttttcagtattgtgctggtgcattgtttgcaaaagcaaatcatatttattaatttttcattattgagttgcagcttgcaaatgtgtatgtatgtacatattgtgagagaaagtaggcatgtctgaactctcaacatgattattgtcataagaaaaatgttatcgttgtttttctctctttttgggtaactgtttgtgtttatggttataagttctatattataaatttgttcaggctggaattaggctgaccaaatccttgttttgaaattcgaattatattgatatatatcttgtacggtcattgcattttttattgttttgctttataactatatataggctggcttcattacgtactccctccgtcccaaaaaaacttaacctaggcaaggatgtgacatctcctagcacaataaatctggacagtcctttgtccagattcgttgtactagaaaatgtcacatcccttcctaggtttagtttttttgggacggagggagtaaacttgtctatgttaaagtttggaatatccaaaggtcctcaacctagtatgtactattttcttgaccttaacatggaactatacatgacctttttttttcctattttactgaataagatgattgtttgtttgcggtttcctaaatgtacttaactgttggtattgttgtgaagatgtgacggaattagtattgtggtattacatctatgtcgtagacagctttttgggtttgcaggaatgaagtacataaatatctgtttggtgctgtggtacaacaatgtaaatagtttattgcagtgacaatgttgcactgttgcatgcatttttgttaggatcatggttgtctgttgccttgttatgccattaacaaatctagaataagtgaagcagcttaaagttatgttctcgtgctcttaagagcaaacatttaagaggtataatagcattctgtgttcaaactatattttagaacctttgcccttgcttaaatagttttatttataagagatgttgaggagcaaacactgcatatctttacacttcacatacgaatatactttgtgctttgctgcctggattactgcatctacttttttgttaaattcaatttcttgcataaaatggggataagttaactgagagcttcagtagactagtacatcacaacctaggtaattggaagaattagctactatgattctttgttgaaacttaggtttagtaaaatagagtaaccagataataggttctatcaaatggaaactggagaaggtacttccatagtcgtatcattgttaatttcaccctcagtataatattagtgttgaatatatgaaagtttgctttcgatgatttcaggtgatttg

SEQ ID NO: 34139 - DNA, 1501 bp, Oryza sativa
aatttacaagtctagctttataccactgaaagatctatatacactttaattaatatcactaaaaatttacatcgttcctttctttacacaggtcctaagagtatcgtcctagcagatatgccatccagacatcgattggcaaaatagcggttaggagaagaaaaacgtgatccagcagatacaccatcccaccctccaaatttagcgtatcctccatcctagagagagaaacatcaaatttagcattcatctctcctcacgctaccccacaactgttgacgtctaaacagaactcccaccctcatccggatcgatgccttcctcctctcctctacttgttttgacgacgactagggtggcaatggcggccgggactaggaaatgatgtaccaaatgtagacgtgagggattttctaggaaaagggatgtggtcgtcgcggacagacaagctccattcgcggcacctccaaccgtgcgccgcacgcgtgtcgacctgagcaccgcccacgaccaagccacatgtacccacattggccctaagcgcatgccctagagccgaccccatcaccgcccttggccgagccgcatctacccgcatcggccctacgccgccaagcccatgttgcccctatgccacctgcattgagccgcgccggcctctcccttcccctcattctccctatcctctcggagtacaagtagaagagaggaggagaaattggtaaaaggagctagatgagagaggaagagagatgtgagaatagagtatatttgtttagttgaaagatattgttaaaatataggagggtgcgatatgatggatataatatagataatttgttgaagtaagaagagatacgaagagaaaatcttttccgaaggtaatctaaataggaatatctatatctttaccttcacccattataaaaaatcaaggtgtttttgcccagaaactttcctacgtcgcccccaattggaaatagcgcccggtttttttttgcactgtttgttaaaaaagtcgtgcaaaacaaaagagcgaaattcgtgcgagaaaaaaaaaaccgagcgaaattcgtgcgagaaaaaaaaaacccaaataggaacagggaggatcaattttatgtggactgctgggatgctctaagctatccgtttccgtacatcaccgccagcggggaactccttagcgccactgccatgtgggcccacatcgaagggacccagcgctcagtgcaactaccgtctctctccgctcccacgtgctagcacacccaacctctccactccaaatagccccaatggcagctacagctactcctctgagagagtgggccccacgcggcagcgacgcacgcatgataggctcgtagccctcgccgtcgtcgtcttcctcctcctcctcctcgcgccgcggagaggattccatcctcctccctctccccgccgccgccgtcaatcccgaatcccgagggctcgggtggtcgtcgtcggtccgggatgg

SEQ ID NO: 34140 - DNA, 769 bp, Oryza sativa
tgttccaatggaccaatagaatgaaatttttttaaattgtgaactggaaaatttgaaacttgaataaattttctctggatataaacaaatttgcaaatatctaaacttttcctaacggaaaattttagaacatttggaaaaaaactaaaatggcaatagacattgattgagttgaaacattatttgaaaccagaaaaaaatcgaggacgaattatatcacaccagaggcccaaaagagttgaaattttggaaattttagtcgaagtacagaaccctgcctaacaatttggcacaggagcagaagtgtcctttctaatttttcatgtaaccaaaatgtgaaaataataatggctataattttttttagcaaattgtcacaaaaccagagtgttgtatggcaaagctttacgacatatttttagagagttctacggcaaatgtcacaaaactacggtgtcctacattttgctctaatttaattagagtcgctaagtctagttttaattggtgtgcttctgagttgtttagccctgatatttttttttctttcaatgttgagaatcatatttgcttgcgtgctgctaggcagagattttataccgaaactaaacatttgaatttactatttgcgtagctgctgaattttcttagctcacagtcactgcaggatagttgctgatgtcctgacatatatactcttacctatatgcatcatcgatctgtggttacaagttttgattacttgccattgtttttaccgtactctaca

SEQ ID NO: 34141 - DNA, 1501 bp, Oryza sativa
caaaactctggctgtcataacatcatgctttaatttcatgataggctaatatattttccattaagcagaggttctttggggaactccaagacagggaacgggaattcggtatctcagacattcaactcggcctcacgacgctcgaagaagtattcctgaacatcgcaaagcaggcagaactggagagctctactgctgaaggcaccctggttactctgaacctatcatcaggttcatctattcaggtttgttccttagtacccctaagaacaatgctgcaatattggacatgaaaaggataatctcactgctatgtagagaacttctgtacagcagcaacagtacagaaaactctgaaacttgctgctatgctgtaatttgattgtgtgatttcttcagaaaactctgaatatctctttgatatcacttccattttctatggcaatgcagataccaaagggggctcgttttgtcggaattcccggaaccgagtcggaggatcacccaagaggcgtgatggttgaagtttactgggatcaagatgacaatggatcactctgcatttctggtcactctgatgaaatccctgtcccagccaatgttcagctgggtcggcccccttcgctgtctcgtagggcctcagtgggccgtggaaaccctgttgggtacatcattgatccgaatgaggtcacagcagcaagatgagtgccaaagaaagaagaatattctgagagtggatgaatttagatttgtcttcatgtaaattatctctaggtgtaatgcaactatagatatgtttgtactagaacagtgtattttttctgttttgtggtaaaggaagtgcttgatgatagatacaacatgcttacatcttccatttggtggctgacaaagagcttgacgattacagatgcaagaatgacaggaatttttacagtgatttaatttgttgcattcaggacggtaggatgtctggggtccttgttttgtcgctcataatttattttttttgttcatgggtgaagtatataattatcaatcttattgttttagaaatataaataatgtgctcattagatgcattagtgcattgttcctgttgtttatacatatcataccatagggatcgtacggtttctggttcccacggccacgatatatatagcttctgccaaattgagtacacaaataacacttactaaaagtattctgaatttctatattgcttttactttgtttgtgagatataaaaataacaattttatattttttggaattatatatttttatttcttacaaacaaaatcaaatttgaacaggatttttttacttggttacaaaatatcatcatatctacatttgtgattttttttaaaaaaatttagacaactttttgattggtgtttgcacgagttttcacttaaattgagttttcatcacatatttaccccaaagaaattatatacgattaacatttgcgacacttaaccgaagaaacagc

SEQ ID NO: 34142 - DNA, 1501 bp, Oryza sativa
gccttttaagattagaaaagcatacctacacctaacagtactactttttaattgtgaacaccaaacaagcaaaaggaaacttgtcaaagatcctttagaaatagtgtagaaggaaacctgtcccatacgtttctctattatgttctgtacgccaatccctttttttatctctttattactattagcacaatctaacttctttcttttttttgaacgacaagagcacaatctaacttgtgtcttggaatacagaattgaaacatttccacctaagtttgactaactgatggtaaacaaattcacaacaaaccacgatttctgcaattaaacgagaataccaatgatgaaaacaaagatgcatttaggtttcagtcatcatgaagtagcgataaactgcaatttcagatggtgtgatgacgcccacacaaattaaaagtgtgaattaactgagcaaaatttgcatcaagaaacaattgttgtcataactcataagtggcaactaaaaccaaacatgaatagcagtgaacaccaaaataaaaaatctccgcacaatttcaccacagctgaagacagaatatagcaaatattgcagctttatatgcacagaacctagcaaaaaggtgaaaatcgagagttcaattctccacaaaatgtaagtagcgaaaacaaaaattctgaagaaagaagccccacgactcaaaatgttcagcgtcccacccgcaccgcaacaccaaaaatcttaagatccaagaactgaaagaaatcgaggaaaaggggccaaaaaaacaaataatctaatctctcgattgcaaaactgaccagaagttcacccgactggaaagggtgggacttggggagggggcgattttagctcggggcgtaccaaggcgtggcgctcaccggcgtggaaggagaggcgctggtgggcaccggcgagcgcgtagagctgcgagagcgagttggcggcgccgcggaaggcgccgtagagcgcccggtcggcctcctcctccgccgcccgcgccgcctccgccttccgcttcctccccgccatcccggaccgacgacgaccacccgagccctcgggattcgggattgacggcggcggcggggagagggaggaggatggaatcctctccgcggcgcgaggaggaggaggaggaagacgacgacggcgagggctacgagcctatcatgcgtgcgtcgctgccgcgtggggcccactctctcagaggagtagctgtagctgccattggggctatttggagtggagaggttgggtgtgctagcacgtgggagcggagagagacggtagttgcactgagcgctgggtcccttcgatgtgggcccacatggcagtggcgctaaggagttccccgctggcggtgatgtacggaaacggatagcttagagcatcccagcagtccacataaaattgatcctccctgttcctatttgggttttttttttctcgcacgaatttcgctcggttttttttttctcg

SEQ ID NO: 34143 - DNA, 1501 bp, Oryza sativa
aaaaatcaatttgatagtatcatgtgaatgcatacagagtacggttctgatgtccatccgaacccttctatctaccaattcattgggtcgcaaatgcaattgatacatctgccagccaaaaccttcatggttgctgggtgaaatcacttctatatatgtggccctctaagctctgcactggtcttcacatttctgatatcaaagatcaaactgatctggctctagttccttgatcatctcatacttggatatagccacaaaagaatgccactctgttgtgccaaatgtatttgtccattactattgttctttagtttcttatgttcttcctaggtcaaacttctctcatgtatgggttgcatttagtacttcattccttgggaatgggaagaaccaggaaagccagattttgatgtaaaaaacttgaaagtggtactaccgaagtgccacagtcaagccaggttgtcaaaggtactcctgaggtgtacgctgcagttgcaaatagaatgcctgttagctggtaatttgctatgatcaggattttatctttttattgagtgatcatacagaagatgatggactgccgtcttctctctctactagactcccaggtcatgattattgcgacttgtttccccatgactgtgaaatatatattaatcgcccatgcacccaactaagagtttatgaattttaaatcacaaagtacatgggatgggttagcatgaaagtctttctgtattgtttgctcgtagcctggggaacttgaaaaattcccaccatgagctgctgagtcatactcttgccctgttaaatacaatagtttttctgcaccatgcctgatcacatattcacatgcacattaatgttcgttgatgtgctcattcaccacaaaattgtaattggcaaccagcacatgaaccactgggttttgatttgtgtactgtcagaagctcaaaattgtactacatgaacccctgagtataggccatgccacacttctatggtgcggtggagctaataaatttattttaatatatatcactactaaaaaatgatttttcacagcgtcacccaatcattttcgctggcggctatttgtgaaaacctccagcaaaaatataacgatagtggggggcttcgaaccgccagcgaaaactaatcttcgctggcggccaagttaagcgggccgccagcgaagatgttgcggttttcgtttgcggcgcacctaacagaccgccagcgaagatgaagccattatcactggcggattggtgacgtgggccgtcagtgaagatgaagccattttcgctatcggacctcctaaaaccctaccagaaaaatatattttttgtggcggacctcctaagaccctgccagcgaaaatctatttttgctggtggtaggaatagtgttttcccgtattaaaagcctacctacccacataaatccatgcccgcagaaacccccacccatagaaatccgcgccgctccacctttc

SEQ ID NO: 34144 - DNA, 446 bp, Oryza sativa
tgtctctcgtgtgcctgatctgtgtttgaatctactggtatcttgtgattttcatcttgtgcaaccctgtgcctgattttcactagctaggacctgttatacttctcatatttcgtttttctctgttgcccggaagttcctgtctgaagaactccggaagttccgggctgctcatcactgctaggaagttccggtgttcatcaccaggaggttccgggccctgtcaatttaaccgttgcttttgttgagaaaatttcaggaaagcctattcatcccccccctctaggctacatctctgcacgttcaattggtataagagcgaggtgctcttgattcaagcttcaccgctttgagtgatccacgatgtcggacttagggggaaagaacgaggaaaatggaaaagaagatgaagcaagcagcaagggaactccaccacccaagggagc

SEQ ID NO: 34145 - DNA, 193 bp, Oryza sativa
taagttaagtgcacgttaacgatagcgggcatgggacccactttcgagacaggccccgacgcccccgcctcatgaaggaagcccgagagctcaagttgacttgggacagggggctcccatcttaagattacaagtaggaagggaccaggagcccaacttggcctaggatcctgagtccccatctatccttagg

SEQ ID NO: 34146 - DNA, 247 bp, Oryza sativa
gaaatttctggttcgttacgcccggcgttttttgacttagtttaaattcgctcgtgaccgttgggctccaaatggcgtgctcgactacggcctgtctcgcgggtcctcgcactaggaccgacaacagtctcgacacccgaagtcgcgaatggttacacgagttcattttaagcagaagtcgggggctactgtcagggctacgggttaggcataccctttaccctttaatatacgttacatatcggta

SEQ ID NO: 34147 - DNA, 259 bp, Oryza sativa
tgtgaagattatgggtaccccatatccacacggcatggttatccgactagtaataggggataacatatatgtatggaatatgtaacagatcatgacttgggtattacgtttccttgtatattatggaacggcctaaagtcctggtttgataatattgtaaagtagatttaggaatccgataccgtgttggttaaggtttctatcttgtaatcctgccccccatcctatataaggtgggcaggaagccctctagggggca

SEQ ID NO: 34148 - DNA, 414 bp, Oryza sativa
aatagtagcactccgtaatattgaattacgacagtgtcgtcccttttggcaacgaccccaaccaactaagatgacgcttaattgatttcggcaaatacgcctttccttccccttcatcgctttccactcagaagaaatacttatcggatttgcacctctacaatttgtaggacgatattagcttaccttaataattcaaacttgccaacaactaaatgtaacatttttaaatgaaagacgatgtaattcaacccattctaattttttattaaattgaataaaatttataaataagcacgaacaataaaaatttattatttacctaaaaaatatcttccgttactatatgaatatatctagaatcatttttattctagaattagaattattactgtatatatttggagaaaagaa

SEQ ID NO: 34149 - DNA, 238 bp, Oryza sativa
atagtatagcaattaatttcagataaggccaacctttgcctgtgctatgtttgcattctatttcctgctggcttagaatacattgttctcattggggtgctgaaaataagctgagaaatacccatagaacctgatctgattcgtatcagcgtagggatttgaggccatttctactacaactaggaattttaccgctcaaatccttctagtttatgttttgttagaaggactttttata

SEQ ID NO: 34150 - DNA, 396 bp, Oryza sativa
aaattttgcaaatcgacaggttaaaggctatggcataagactatgcgaaatattaaaaggaatagtgcgtatttaaatcaacgttatttactacttttgagttatggttaatctatgcccgtaataaatatttgatttatttcaaattttcaagggctaatcggcaaaaatagccggtttttgtaaaaacttaaccgcattttaaggtaaaatagcgcctttatttttgcttgtaaaataattgcaagataacaactaagatttgagagctttatgtaactttttagaaacaggtgggggaattcatttgttattaaatgaccgttacgactcaatagaagcgattgcgattttcgcaatcttattttttaacccaaaaaagtagtgcaaataata

SEQ ID NO: 34151 - DNA, 353 bp, Oryza sativa
aaaaagcaaatattgcttttaccggtaatattgataaaaaagttgagaatggcttagctattcttggccaagcaaaaggtgctgctattcaaattacaggtcttgatggtaagccagtaaaattagatggttcaaaaactaatgtaaacatccaagatggtgataattccttacaattctctgcttatcttaaaggttacccaacagcagcggttggtaaagatgatggacctggtccaactccaacaggtaaagctattgtagctggggagtttacttctttagttaactttactatgagttatgaataaaaattaaatagtgtgctagttatagaggaataggatagatgt

SEQ ID NO: 34152 - DNA, 354 bp, Oryza sativa
actatagccaaacaaatgatttcgattaaattccgttctcacaattaacggcgaagttaaatctttcgcaacataaccggttatactttcgataaattcaggaaaagtctcggttttgataactaacaatgaaccaaatgcgcctgtttaaacaaatcaatcgcttgcttggcattagtttgaaaatcaaaaaaatcgaccttagcattagtgggtttaaaagtatgctgtaaagttagcaattgatgtgcaatgggagttagaatcacgaattagcctcattatagaaatttggtttattatacccaaattccggctatacttgcctaaagttaaaagtaatggggctgaaaa

SEQ ID NO: 34153 - DNA, 627 bp, Oryza sativa
atagtaaataagcctattgatgactcattatttcgtgatttttatggcattgggatcactaaatatcactttgatataaaaggaaataataaaatatatggtgtttatattcatctgttgataatcaaagaaaagaacgtaatttggtttataaaaaatcagctatagaggctttagccgctaagtattcaaactggaatgttttgccatcttcaaggaaatttttacacagtgaataaaatatatcgtgcagaaactatggtttcactattagtgggaatagcaatttttgctattttatttagcgcttttagccattggcaagaaactcaagtgagtcaaacaaattatttatatcaacaacaggcattacatattttagaaaatcaaatagccttaaaacaagcaacacaagaatgtgaaaaacaacttcaacaaaacgacgtgttatttacgattgactgtggtgcttcatatattcaagtgaatttcccattaggcaacgtcagagtgaataagcaaatggcagcgcaactatcgctagaatagcgtgtttcaccacttataaaagtgattgaatatcagcgctaattagtagaaaatcaaattctactttaggagccatta

SEQ ID NO: 34154 - DNA, 165 bp, Oryza sativa
ggatttaatagcattaaagaacacgaataaacactaaactatttcagtccctttaagtacaacgtaattatagaattttctttcacctgcaacaaactaaaaattttaatttttataatcaaaaaaaataatgaaatagttaatcgccatctcaatataagggct

SEQ ID NO: 34155 - DNA, 182 bp, Oryza sativa
taccgttgaaaacctatctgtacattttgattcgttttgtgaatgcggttaagggtgtctctgccctagaaatctctcgtgatgcgaaaatcaactatcgcaccgcctttgtgctttgtcataaattgcgtaaagccttgctagagagtcgagatatgcaaccacttcaggcgaagtggata

SEQ ID NO: 34156 - DNA, 572 bp, Oryza sativa
tttttatttttcacgatgccgtgtattgccgatccattttatggagatgtcgcaaaaaataggaatgaagtaataatagaaaataatgttttaacggaaaatattatgccctgtgcattacctaatacgttatcaaacattagtttgcctgtaaaatttgaacaattaaaattgattggtatattaaagaaagggcagcaggctaaagcattttaattaatgataaaaaacagattttcgatttaaaagttaatgattttttattagatgagcatatacaaataactcgcattgatttgaaatcactacattatattgattggcataaaaagaaagattgtcaacatccaaaagaaaatgtggatgaaattataaggaattacgatgagaatacttttttctttattcttttttatttcattatcattattagcacaaccgttatcgctgtctttaaaaaatgcacctactgcagaaatattaagttatttagctgaaaaaaaaatgaaaaatatcggattgagtgagcaaatagacaaaaatacgacctcttagaattgaaaataggcatt

SEQ ID NO: 34157 - DNA, 1501 bp, Oryza sativa
gatctcctctcctctgaaagggaacgaggtaagtgaatgaagttcttgtgctgagattctagaggttttccaagtagagcaacctacaattgtggtggatttctagaagtaggttgagttggatcttggtggacactcaattctagaaatttgcctaggagtgtttggggttgaaggctgtggatttcctctggggtttttgcacaagtgaggcaaggggttaatcgagacccagctccttggagcccctcaacggagagtaggatcgcaagatccgagcttcgggaaaaaatcgctcttgtctctttctgtggatgattctgtgatctatcgtctgcttagaatacctgtgcaccatcttgtgaagattggcttagtctcctatttcgaaatttgaatttcatctctgttctgttacccggaagttcctgtcctagaataccggaagttctgggcctggcaggccggaagtttcggagttccttaccaggaagttccgggtctgcttgaattttaccgctgcgatttgtttttcagtttctagggacagcctattcaccccccctctaggcttcatcagcgcgttcaggtcccaggatccccaaccgtacattcctcctacaatggtcagccctttaggcaatcgtagcagttgcgcctcaacggggcaggtaggatcacagagcatagacgccatgcaaacccaggatgaaaccacctgccccgttgatgacatgactcagcggacaccatgtgagctgcatattcccttcaagaacttatcaataaaggtaagctcatagtttttagattttagacttgtccattccgcaagttgctgcttatatatgttgattactaataaataacctctcacaacgtgaaggtggcgtcgggcatggccatcccaacggacccttcagggacttaccactacaggccgattccagcaggatactccaaggtcaaagttgagtttgtggaagccacgtacgaggacctcgacttggactacgctggaggagacggtgagacgcatctacgagacacaagccatgccattatactatggcgcaagtagtacaccatcctccttgggcaacaagcggcgtctcgtgcaccatctcctccggctccgccatctcctcctcaggctcctacaccgtctcctcctcatgctccagcaccgtctccacctcaggcttctgcaccgactcctcctcaggctcctacaccgactcctccgcaagctcctcgtccggcattttccaagtcaagggcaacgaagggcaacgaagaaggcgaaagttgacaccgccaaaaacaaggacccagggtacgattgcacgcaagaggagcttgacgcttatgtggcatcaaaagtcagcagacaattgaagcctcgaagtctagaaaagaagattcctatagactcaagtgtcaggaacttcttcaggggtatgtctgcacttgccaaggaggccataaagctatcggacta

SEQ ID NO: 34158 - DNA, 452 bp, Oryza sativa
  unsure (1)..(452): unsure at all n locations
ggtggttgnnnnnnnnnnnnnnnnnnnnnnnnnnnnnnnnnnnnnnncatctgatcctttcttctgtgttgccattcgatttaacagttcatgctgtgcaggtgaaattgcattgtgcgcttcgtatcgctgaaaataaagataagattgagcattcgttcatttttcacctgagattattactgagcgttgcatgtagaggatcgaaggatcccattaaagagtgggttttaacaatatgaggatcactgcaacaaatcaggtacattttccaagtgagatgagagaggtcattgagactagaaggtggtctgatttagtatcaaaacatgagaactcatcttcaccaacaaattcccaacagttgatactgatcatccaggaacacgttattcaaaagtaaaaaacgggggaggggcaaaataatcagttctgactcctaatagcagcca

SEQ ID NO: 34159 - DNA, 1501 bp, Oryza sativa
ctggggttaaagatgaaaattaagaaatttgaaaggaaggatattaatggaagtatgggacataaagtactctagaagagtatatttttttagataatattgaagttatatattttgagacatgaagtgctctagaagagtatctttttagataaatttgatgggcgcagtcagtaagtattagcattccttactttgattaactagtctctcaaggcatcacaccctatactaaattgatgccaaatttttttacagaggtaaacaaattccatgtcgtctggaattaaaacgccttaagtctgttttaatttgcatatctgcttgctgcatttcaaattttctagaccaataaacaacatttcctttttaaaacttgcacacttgctacccctctagattgataatacttgtcattttggacaagagtaaagttaaattttaaaatgtttgactatgaatagtttctgaaatatttgtcttgaaattatggagatcatatgtatagattagtttaaaaaatacttcaataaaatcatatattagttgatactttcatatatattaatgttcatagttattttttggagactgtatccttatccaaaacaaaacaacatgcattatcaatagggagaaacatcattcggggttgttaataggatggtctgtatgccgggactaggacacaatttgatgaaatcagaagaataatcacaaggaatgatcagagcactcaattcaattccggagaaatgtatatgcagacacatgatccagcagcattctcgttttcttttctttgatgtaaaaaccagcatgctcgttgaacagatcagctagtcgtgcatggtgctttgcaacagaaatcttagaccatgtagtttaactttatttgttcaattttttttttgaaaggaatactaccaggcaatggcccagtagtgtattttatagaagccaacaaagtatttacaggaaaaaagaaaaactacaaaaggctacaaccccagaaactaattgtctaagatcatcattcatcctacacatatgtagaagaattttatgcttaaaagaattccaccagcggtcaaatgaaggatctatattctggaaaatctttccattcctttgcttccaaatgtgccaacacgcaatgaaacaaatctctaagaatccttttttctgaaatctcaatcttgctagcaccagcatctgaaagacttctagagaagtgttccaagatattcccagcttctgccaacactttctactaaaagggcattgaaagaacaggtgagacaaagtttctctgtgatgcaaagggcataagacacaagtaagatcagcatttaggggggcgcattttctcctgtccaacatgtctctcgtgttcagcctatcagagaaaagaagccatataaaaacttttatcttcatcacacacttggtcttccagatccatcggaaaggtctgggatgttgcatggctgcaaaattc

SEQ ID NO: 34160 - DNA, 1501 bp, Oryza sativa
cgtccaaggcccgttgtcgtcggtcctccgcctcctttgcagcccgttcacgttcctgttgctcacgctgcagccgttcttgctcttgtgcctggcgctcctcttccagtcggcgtcgttcggcctcctgttgtacacgtcgtccttctgcttctcgggcttggcgctgttcttccgtctcgttatcggccatgaagacgccaaaatagagaggggtgtagttatcttcaaagctttcgtcgaagtcgtcaaggtcgcggttgtcgtagcggtagccgaattcatcgtactctacgatctctgttggtcgtgactcgtgagtcgacgccaggggagctgaagtagccttccagttggtccatcgaaaccgtgccgtgtggctggagtatgacgccgacttccctggagctagaccggatcggtgctgaagccggatcccgcctaggcctacgggaagaagacgcccttttagtaaagacgacagccagatcatcggggagtttcatcaggattggcggataggccccattgtcttgatctggtggtgttgaagtagattggatctcgtccgagtggtttgaaaccaactcggtggagatgaccttggggtagacctcggccgagttcgggataccgaacggggcggagatccagcctcttcccgactggttcgaatccgagtcgaggagagaaatcttgccgaagttgttggtgatgaagtctaggctgccaaaccggaacgcctgcccgggagggaagacgaagtcgtcgatgccggagacggaacccatcgcacttagtcggcgaagaacttgacgctacccctaccttgcgcgccaactgtcgaaacaagatttcggcaatactaaaagggggtggctatcaagttggaaaagtggatgggtttagaaacaaggaattttatacaggttcaggccttcttaatcaagaagtaataccctactcctgtccggggattgatccgccgagtgtattattgatcgtatgatctaagagaaaaaatgtatccctagattgacccggacccctccttatataggggaagaggtccgtattaccaaatacaatccatatccctaatggcatatgtaattacagataagatacaatcgtaaccgactaggatctcggatatttccttgacatacaactttagacctaactcgagtcctcttaaagattttctatctatatatggtaccctgtacctagtcggactatacatgccgtgtagatatgggatattcataatctccacacatagtgaaagaaaatgatgtacattcagattcaaataatccacatagaggactattgggctgaagaggggaatcagaagactcactttcagctgaagcactctgcactctgcactctcacctgcaaaagagaggatggcacacatccgtgagaactgagtgcgtggtgtgggcagattatgacccttacaacggcggcaccactggaggcgcggcagagt

SEQ ID NO: 34161 - DNA, 1501 bp, Oryza sativa
gatcaaatagtgtaaatcaagccatagtgtcgaaacaagatttcggcaatactaaaagggggtggctatcaagttggaaaagtggatgggtttagaaacaaggaattttatacaggttcaggccttcttaatcaagaagtaataccctactcctgtccggggattgatccgccgagtgtattattgatcgtatgatctgggagaaaaaacgtatccctagagggacccggacccctccttatataggggaagaggtccgtattactaaatacagtccatatacctaacggaatatgtaattacagataagatacaatcgtaaccgactaggatctcggatatttccttgacatacaagtttagacctatcccgagtcctcttaaagatattctatctatatatggtaccctgtacctagtcggactatacatgccgtgtagatatggggtatccataatctccacagtagcccccaagacctttacagtcgatgaaatggccttctcttgaaacataaagtaataatccgagtgcttcaatttcttctgtatagatctccgagtaccaaaatcaaagactgtgaaggtctaaaatagaaaataccgagtgcatcgactagatgcaccgaattaggtgtagcccccgactatgtggttagttaaaaaactaaacatatagtcaagaaccaagtggttttacaactgaatatcatatagcaaggcatatgcggcgttcaataaaacatctagccgactgcttttagttttaatataccaaaaatgaaaatatggaaaggcccgagtgataaacactcctaaggtccataaattcacacatttgacaagaatccgagtaaaaattctcaaaaatatccatcaaatgtgatacaaatgtgataacataattagtgataagtctaaatagcctaggctatgactcacaccagaagaataagcatgccgagtaaataactgatcaaaaaccagttatctcaacaaacctgaacagcttttgcagcctaagaagacttacaaaattagtataacacttttctgttgggtacctttttgttcgcatcgtagtgattccaaagaatcatctaactgcattaaaaaggattttaacagcatcgggccatactgttgtgagcaaaaattgccaaagcaaaaatgcctaagtccctaaggatcacaactagtcacgctgataatagaattgggctgaagtactgtataggcccaggcccattagcactcccgataccctagcgaaataaacgccgaagtcaaagcgtcgcttcgtcttcctcgctgagactctcgccattttccccatttcacgctacagtacaaaaccactcccgcggaactagggttctccaatttgctcaaattcaccttccaaaattccacaaaaaatcatccacgcacccaccacatccattccccatccattcttcagccatttccaaagcaaatcgcatcacccaattcgcatcca

SEQ ID NO: 34162 - DNA, 526 bp, Oryza sativa
gagtgtacttcataagttgttttcgtgaaaaaccatggtgtctctttacccagtatggaatcagccataccctatggaaagaggaacccttctcttcaagccaaaaggtaagcccatctcaactcattaaatggcctagtcagtagaacaacagcgtccagtgatgagtcgagttccactgcttgtatttcgccgcactagaactgatccttctatctgtgacaggctcaaaatgcatagaaatagtgggccgtcacaaggctgtcatctatatcggcctgtaaagtgcccgatagagatatggtcgtacagacatgttagaagggcataaagctggggcccgtcacggatgacgccaatctgtgccgggccacaacttccggcccgtttgagatacgaaccgatatctcaaatgggcctaaagctatggcccgtcacagatgatggtcatctgtgacgggccataactttaggcccatttgagatatagaatgttatctcaatcgggcctaaagttgtggcccgt

SEQ ID NO: 34163 - DNA, 1501 bp, Oryza sativa
tacgatatgtaagtgcactataattttaataaaaatattatgtaagtaaatatgtatttgttatttactttaaaatataaaattacaatcgtatataactaaaattacatttgtaggtttagttaatatgatatgtaagtgtactgtaactataactatagtgtaattacagtgtaattatagtgtaattacaatttttagtaggtgggttggtgatttttttttacaatataactatagtgtaattactgtaatatagtgatcaaatgagcctaatctaactatctaaaatctgtgtgatttagacaaaaatatgtcacgtgatggataggtagtcccatgctggagcaagcagatcgttttattctacctccaatacatatctccagcacgtaacggtagaaacggatagtttcctgcggtgacggaagcggcgacaaatgacggaagatggtctatatctggactctaaccggagtattgctccagattggtttctcattccaaacaataaaaatatgtttcatatgtttcataaaattgcatgtgatgcagaaaaaatcaatttttatatgttgtatccagtagctatattagtactaaaatacctattattggttgtatactaattctcaagggcaaatgcatctttttacaatgaacttaatggtcaactgacggtggagtgacggcaatggcataaaagggaggagaaacttgaaccggtggcataaaaggggagaagccaatttgaagtggcatataagggagccggttaatttagagtggcactctgccgcgcctccagtggtgccgccgttgtaagggtcataatctgcccacaccacgcactcagttctcacggatgtgtgccatcctctcttttgcaggtgagagtgcagagtgcagagtgcttcagctgaaagtgagtcttctgattcccctcttcagcccaatagtcctctatgtggattatttgaatctgaatgtacatcattttctttcactatgtgtggagattatgaatatcccatatctacacggcatgtatagtccgactaggtacagggtaccatatatagatagaaaatctttaagaggactcgagttaggtctaaagttgtatgtcaaggaaatatccgagatcctagtcggttacgattgtatcttatctgtaattacatatgccattagggatatggattgtatttggtaatacggacctcttcccctatataaggaggggtccgggtcaatctagggatacattttttctcttagatcatacgatcaataatacactcggcggatcaatccccggacaggagtagggtattacttcttgattaagaaggcctgaacctgtataaaattccttgtttctaaacccatccacttttccaacttgatagccacccccttttagtattgccgaaatcttgtttcgacagttggcgcgcaaggtaggggtagcgtcaagttcttcgccgactaagtgcga

SEQ ID NO: 34164 - DNA, 1501 bp, Oryza sativa
atcgttactagaatcagcctatgtggcatatggatgacctgagtggtcaagaaacgagtctgtgtgattcgggatgtctacggacatcatagactaggcttcccaagtggaagcggattgttgtgctgatgggcagctggactctgggagtccgagaaaatgaaaaggctctgggagccgattaatcaagtggaatgactctgggagccgagagataatgatctgacctgagaggtcggtacattaccaaatgagctgttgaaaaacatctcctaaagtcgaatcgagacgcaagtctcttttcggcccaaacttagaaagaaataaatcactttgtgatttcaaaataatttcaaaacaaagatttgcaaaacaaccttgcctctcttccaagcttgcatcaaacacctaaattcccgtgacttgctgagtacgaaagtactcacccttgctctatataaatatatatatagttcctccgccttgaagtgaagacggagtgaagtgaagattaggatttcgtcctggttcctagccatcgcctgtggtgttgggtgttagtccgttggttccgctgctgctgctgttgttggtgttttcctcgtccgcgtcgtcggttgcattctcgggctgttctgagctgcaaacctaagttaaggtaaataagtcctctatttattttaaggattgcaatgattcatatttgtcaccgtgggtaccagcgctatgtcctgggactggtactgagatcgcggtttcgtaggaagcggttcgcgccgtttttcctacgacacgctcctatcaggtgccgttgtacgacggtgccagatcggggtgtgacatgcacgccgtcgtcaacgctcggtatcgcgagtccttcctactatgcagccgaacttccaaaaccctcggtacgcattcactatgtttcacatattcgatttgtttatatgtgtagatcgtatgatgcgattatgctaatttacatctgcaatgtcataatttatttatggaataaattaaatcaatatgcatgtgcttatatattcaacactagctttcagccaagggctaccaatgaaagggctgggagcctgggagtgagcaaaaatcagaggcatatgagagattggctacatgatttatcagatctacttccacacattttttaccttgacaattgccatgttacaaacaaagtttttactgtgcgtagatgagcacaacaatgttttaacttttttccgtgctacatcttggtccattacatttgtgatttgtggctcagaacacatttttgcttcagtgagttgctatttctgtgatgaccgacatgaaaattttttgtcaaactttggtgcaaattggtcgcctgacttaagatcactcatcgtcaccaataaccatagggatgtgctcatgtacatctgaatttcaacaaaagaaaaataaagagttgtatatggctagttgcagatggatgtaatggataaaaaaatta

SEQ ID NO: 34165 - DNA, 1501 bp, Oryza sativa
taaatattgtataggtaggagtagaagggtagttgagagtaaaatagagagaaatttgaacgattagtggttaatgaggccattattactctattgtgataattattttgaggcgaattcaaatcctagaaatacaattgttatgaaacagaaacgtatttgtcactatgtatacattaataagggtgaatgaaacggtctttagaagaaaatgaaaatcgaactggcgaagattctcgggagataaatgccagatgctgaaaatataaacgcagggcgacaatccaacattccttccagagtttttccacccaccagcatttaccgcgcacgcattccgaggcggccccccctcatctcatcaagtctccatctccttgttttcttctgaccaaggagggcattttcgtcagaggatgaacatttccaacggcccaattcttccccctcacatccgtttctgaattctcatcagattcagatccctttccttctgctgtaacaacgtttcctaataattttttttgattccccatccagagaaagaagtaaataattaagcccaaatcttgcatggtgaccacgtgtcagtgacacattctgtcagagaatgggattagacgatttgttaaccacaaatctctgacagaactagagtgagaaacaatctctgccaaaatctagagagagaaacaacctctgcacagagagagagagagagagagagagagagagagagagagaggcctttgtatagtacagttgcccactcatctctcgcactcgcaatgcgccttttgatgtcactcatggctgctctcttttgatcttttcctctttttcttcttcttctttgaagcatcatcaactagggcggtagggcctctttcctttgttcgttttatctttatagcttctctctatctctctctctctctgtgccctcttcttcctagccgaattctgctggtctccattgcggctactgttcttggggttgccctctctctctccttcctttggttttgggcggttttcttttgctgaaaaaaactagttcttgattggttcttgtcatctttgggaggacattgctctgggtgtgtgtcaagattgtgctgggagcataaagctgggatctttggccaggttcttgactatctaaattgtttgttgttgctatgtactaattacccttgcatttgggagctcataagtcataacattacttttctcttttgcagattgtagagggcttctggttcttgtcactgggggtgctttagagcatttcttggtgtccattactgttctgggtcatagagtttccaatctttggcaattactcggaggaattcttgagctgtgtgctactgtttcctttccctgataaatcaaccaagggaagggaaggctgtatattttccctttcttgttcttgatctttgcaataattttgatcatcttgaagaaaagaagtgtaaagtgtttggctgtgaaa

SEQ ID NO: 34166 - DNA, 1501 bp, Oryza sativa
caacttttcacaaagcacaggcaaacaaatctacgctataggaaacacctcacatccgcccatgaccgtgggcacggctgttcgaatagttagttaacctctgcagagggggtacactttacccacacgacattactaacccggatcatccaacccgtggagaacagccacgtctggtgaccttaaggctttcatgacaaggcatttcaaaagccgacacagggtcgccatatgccaacgagaggagtcccagactgacaacaggttaggtcccagaccatactgtgccaggaagcccgagggttctacccgacaccaccccattgaatacacatgtctcttggcatcaaggcttccctggtttgctatttactcagccaggggtgtcccattgcacccgtgtggtcgcacttgttatatgctcggatgaatttcccacaagaatcggtccttatatgcgaatacgggacagtgccacacaggcacaacccccgcatcgcgagttttcacaatttattttattttcaaacacaccgacaccacatgtcgggttttaaaggcttctcaaacccatttcccaagttttcgacaaacaatggtgtatgtgggatatttggtatacgcgctcagagagcacgaataccgaggtaccacaaaggtggagcgacaaggagtcagggtagtatagcctacaggaattagtgcgactactgggtaggtccatcggtttgacacgcaaaccgaggctaagcaagttaaacatgagtgattctaataatgcaagttgcaaacaaaataataatgattttccaattataggagaaattggtcaaagggtgacttgccttgctcaaggtcttcacgaagcttcacgaatcttcgagaaaacctgcgatcaacgaaaatccggtaaccgcaactatacgcaaacaatcaaaaacctaaacaaaagaccaagaaaatatcctatttagactaaataatagtgccattagatagatctcaattttacggaattactggaaatggaacggagtcaatcggaggaacggatgaagagatatgaattttggaaggtcaatggatttttctggacaaggaaatgatttatcggaattttctggaatacgacaaatgatttatggagtttatagaaataatattctcaagaatattattgacagtcactgacgtgcaggaccaagggaaatgatttatggaattttgggaataaggaattgatttatggaacaaaggaaaaaggatttattaaatcccttggaaaagaaaaggaaagagggatgtcatttagacttcctttgggcggctagggcgcggcccgaaggctattgcggctcggccgaaccaaatgggctagcgcgggcgcgaggaggtggcccattaggggcgcgcgggagagagggagcggtccggtggaccgagtgcacctcgtggggtcccgggaggggcccgcttttcggtgacgcggctcacggaggga

SEQ ID NO: 34167 - DNA, 1501 bp, Oryza sativa
aattctggctgacagactgcaaaaggtgatattagaattaattagttagaatcaatatggcttcataaaagggagaactatacaagattgcctagcttggaattttgaatttcttcatcagtgccatcattccaaaagagaaatagttttgttaaaattggacattgagaaggcttttgatactattgaacatgaagccattttgctaggaatggaagctatgagtttcagtgttacatggcttggatggataaggaagatcttttcttctgcctcctcctcagttctgataaatcgggttcctggaaacaattttcattgcaagaggggggtgaggcaaggtgacccactttcacctttactctttgtattaggagctaagcttattcaagctattgttaacagagcttatagtatggggctcctttcaaagcttcttccttcagatattgatccaaatttccccattgtccaatatgctgatgacactctcctctatttgaaagctagtgatagagaactttttattctgaaggctttattacaaacttttcagctggggactggtctgaagttcaatttcaataaatcttgtctcattccaataaatgttgatgaggggaaagctcagaacttagctgcagtttttggatgtaaattggggtatttgccttttacttatttgggtttacctcttggtaccactaagccagaggtaattgattttgcacctttggtggatagaattgacagacggcttactgcaaatgcttctttcttgtcttatggtgataggcttacactggttaattcagttttttcttcactgcccatctactacatgtgtactataatgttgccaaagacagtgattgacagtattgacagagcaaggaggcattgtctttggagaggctatcattggcagcctgggataaggtttgtaagcctaagtgcaaagggggccttggagttctaaacctttctatccaaaaccaagctttgctcatcaagtttttggataagttttacaataagaagaatttgccctgggtcaatcttgtttggacttcctattatggtaatactatccctcatttatcaaatttgaaaggctctttctggtggagagatatttgcaaattgatggatgtcttcagaggtcttgcaaggtgtcatctgaaaagtggaaataccggttcgttttggtatgatgtatggaatgatcaatctcctcttttttactctatgccgaggctatgctcttttgctcaggaccataatgtatcagtctccgatttcctatccatcgaggcagaaggcaatttcacattgccactatctatctaggccttccaggagtttcaagaacttacttctttccttgtggatgttgagctggtcaataaaaatgatgtttggtcttacatttgggggaatatgaagtattcctcatagaaattttatgctctaaacttcagagctgttaagccaacagttc

SEQ ID NO: 34168 - DNA, 1501 bp, Oryza sativa
tcgggttcctggaaacaattttcattgcaagaggggggtgaggcaaggtgacccactttcacctttactctttgtattaggagctaagcttattcaagctattgttaacagagcttatagtatggggctcctttcaaagcttcttccttcagatattgatccaaatttccccattgtccaatatgctgatgacactctcctctatttgaaagctagtgatagagaactttttattctgaaggctttattacaaacttttcagctggggactggtctgaagttcaatttcaataaatcttgtctcattccaataaatgttgatgaggggaaagctcagaacttagctgcagtttttggatgtaaattggggtatttgccttttacttatttgggtttacctcttggtaccactaagccagaggtaattgattttgcacctttggtggatagaattgacagacggcttactgcaaatgcttctttcttgtcttatggtgataggcttacactggttaattcagttttttcttcactgcccatctactacatgtgtactataatgttgccaaagacagtgattgacagtattgacagagcaaggaggcattgtctttggagaggctatcattggcagcctgggataaggtttgtaagcctaagtgcaaagggggccttggagttctaaacctttctatccaaaaccaagctttgctcatcaagtttttggataagttttacaataagaagaatttgccctgggtcaatcttgtttggacttcctattatggtaatactatccctcatttatcaaatttgaaaggctctttctggtggagagatatttgcaaattgatggatgtcttcagaggtcttgcaaggtgtcatctgaaaagtggaaataccggttcgttttggtatgatgtatggaatgatcaatctcctcttttttactctatgccgaggctatgctcttttgctcaggaccataatgtatcagtctccgatttcctatccatcgaggcagaaggcaatttcacattgccactatctatctaggccttccaggagtttcaagaacttacttctttccttgtggatgttgagctggtcaataaaaatgatgtttggtcttacatttgggggaatatgaagtattcctcatagaaattttatgctctaaacttcagagctgttaagccaacagttcattacctatggctttcgaagtgtaagcagtttctaaaatgaaggtgtttggatggctactcttgatgaatagattgaacaccaaatttatgcttgatcataagaattgtgctcctccaaattatggcctttcttgtgttctttgtcaatcgacagctgtagaagacttaatacatctgttctttctatgcccctttgctcagaattgttggaaccttttaggcattgcctgggatacaaccctttctttcgaaggaatgtttataagggctaagttggattatcaggggagctg

SEQ ID NO: 34169 - DNA, 1501 bp, Oryza sativa
taatactatccctcatttatcaaatttgaaaggctctttctggtggagagatatttgcaaattgatggatgtcttcagaggtcttgcaaggtgtcatctgaaaagtggaaataccggttcgttttggtatgatgtatggaatgatcaatctcctcttttttactctatgccgaggctatgctcttttgctcaggaccataatgtatcagtctccgatttcctatccatcgaggcagaaggcaatttcacattgccactatctatctaggccttccaggagtttcaagaacttacttctttccttgtggatgttgagctggtcaataaaaatgatgtttggtcttacatttgggggaatatgaagtattcctcatagaaattttatgctctaaacttcagagctgttaagccaacagttcattacctatggctttcgaagtgtaagcagtttctaaaatgaaggtgtttggatggctactcttgatgaatagattgaacaccaaatttatgcttgatcataagaattgtgctcctccaaattatggcctttcttgtgttctttgtcaatcgacagctgtagaagacttaatacatctgttctttctatgcccctttgctcagaattgttggaaccttttaggcattgcctgggatacaaccctttctttcgaaggaatgtttataagggctaagttggattatcaggggagctgttcatggagaagtttctttatgctccttggaatatctggaagtaaaggaatggtttcattttttgatcaaaaaattcctttttgtcttcttggaggcgattcttaaagggtgacctctttcttttgttgtttaggattaatgtgagatatcacgatgtaatcataagctggatcaatctgttgtaatttgttctcttctttattaataaaattatcttaacaacttaaagtagttttgcacgtaaatcgggcgctgacgtcatcgcctgatttccctcgctcccgtcggacgaccgatgcgtagtcgcgtcccaattataatgtgttttttcattgttttcttttccagatttaacatttaaactgctaagtgtataaatataataacttgactctaaaattatttttcattgtctcgtttattttccttcatactattagccgaagccaaccaatttgacatttctattttaggacactttgaaattttttcgagaagaagactttgattttaggactgattttacgtggtttgctggtcactctagttccctagctctatttttatgatatttagaaacataaaaaaacatatatatgtagttattttttaaaaaccaaggtcaaaatttcagaacctttaaaaaaatatttgacaagcatgacattaacggaagctaataaaatataatcaaaatctaaaaccgtgaattggaaatagcccatccggatttcaattctacgctttataatggaactatcccatctgggtttaaattctacgcttt

SEQ ID NO: 34170 - DNA, 1501 bp, Oryza sativa
gtgtcatctgaaaagtggaaataccggttcgttttggtatgatgtatggaatgatcaatctcctcttttttactctatgccgaggctatgctcttttgctcaggaccataatgtatcagtctccgatttcctatccatcgaggcagaaggcaatttcacattgccactatctatctaggccttccaggagtttcaagaacttacttctttccttgtggatgttgagctggtcaataaaaatgatgtttggtcttacatttgggggaatatgaagtattcctcatagaaattttatgctctaaacttcagagctgttaagccaacagttcattacctatggctttcgaagtgtaagcagtttctaaaatgaaggtgtttggatggctactcttgatgaatagattgaacaccaaatttatgcttgatcataagaattgtgctcctccaaattatggcctttcttgtgttctttgtcaatcgacagctgtagaagacttaatacatctgttctttctatgcccctttgctcagaattgttggaaccttttaggcattgcctgggatacaaccctttctttcgaaggaatgtttataagggctaagttggattatcaggggagctgttcatggagaagtttctttatgctccttggaatatctggaagtaaaggaatggtttcattttttgatcaaaaaattcctttttgtcttcttggaggcgattcttaaagggtgacctctttcttttgttgtttaggattaatgtgagatatcacgatgtaatcataagctggatcaatctgttgtaatttgttctcttctttattaataaaattatcttaacaacttaaagtagttttgcacgtaaatcgggcgctgacgtcatcgcctgatttccctcgctcccgtcggacgaccgatgcgtagtcgcgtcccaattataatgtgttttttcattgttttcttttccagatttaacatttaaactgctaagtgtataaatataataacttgactctaaaattatttttcattgtctcgtttattttccttcatactattagccgaagccaaccaatttgacatttctattttaggacactttgaaattttttcgagaagaagactttgattttaggactgattttacgtggtttgctggtcactctagttccctagctctatttttatgatatttagaaacataaaaaaacatatatatgtagttattttttaaaaaccaaggtcaaaatttcagaacctttaaaaaaatatttgacaagcatgacattaacggaagctaataaaatataatcaaaatctaaaaccgtgaattggaaatagcccatccggatttcaattctacgctttataatggaactatcccatctgggtttaaattctacgctttagtgataggtactacctcccatataaattataattctaagttgtttaacatatattaaggtttgagaaggaagactatgatgccccttat

SEQ ID NO: 34171 - DNA, 1501 bp, Oryza sativa
aaaaaaaagtctttgcctcagtatatatatagggggatcacgaatctcttcctttttatacaaacaatcttaattagatgatatcctcaaaaccataattttcgatacagctttatttacaggttgtttaacggtgctgtgcattgttgaatatataatgagttggatttaattgatcttttaaaacaaacataattattttgttattactgatgtaatggaagggcaacaaagagagtacggtaatgtggcgcataccttgggggtgttgtactgcgacgtgcaagacattctgaccatctggtccggagtaagataatttcctagagctcatatcaagcagatcccacgcaatctcgaagcgtcccaacgaaacggcaaggtacagcggtgacgtgccgtcgtgccgatcaacgccggccagtcccggatcctccttcatgaggacctccaccactttgctgtggccagcacggaccgccccgtgcaaagccgtctcaccgaccttgttcttcctccttgctaggagctcctggtcatccaccctcgctgcaccgctgctgtcacgcgcaggcgcagcagcagccagcgcgaggagtggttcccagctgcagcggcgcagtgcaggggcgtgtcgccgttgttgttggccgcgccgagtaggtgcctcgcctggtcgtacaccatccgcgcacactccacatacgcctggctgtcaccggaggctgccaccacatgcagcgcggagttctggtccgagtcaagagtcagtccctccaggagcgagagcgaatatacagcaccagaggcttgctgatcagtcgcagagattccttcagcctgatcttcaattggatctgtggtcggagctccctcatctggttcgggcaagtagatgattagatgggattcaggcaaggtttgacaacgcacctcatggccgaggagaagctaggctctcaagagactggcaagctccattccgtgcagccatgaggagctggggatccataattacacggggagggggaggtcgtcttgtgtcgtccacgttcttgcttgtcgccatggccacaaccatcgtagtagcatcgtcttccctactcaccagatccttgagcctctcacatccatcgcgccctgacgccatggcaagcttggctgctacaggcgcagcatttgcttccttcggcgattctggaggttgctctccgttgctcgacgccatcccggccctcttcccggcttctcctctcttctcccccggtcaacactctttctcttcctcctttgcagccaaagcactttttgcgtgtggggttaaccactgctactcccctccgtttcaaaatgtttaacgccgttgaattttttaaacttatttgatcgttcgtattattcaaaaaaatttaagtaattattaattcttttcctatcatttgattcattattaaatatatttttatgtaggcatataattttacatatttcacaaaagttt

SEQ ID NO: 34172 - DNA, 1501 bp, Oryza sativa
tagaagtcataaacatgatttatccactagatatccaaagaaacaacctaaaaccgaaattaacacaatgtggcctggtcagaccgcgggctggctggtctgactgcacacgtacagccgatgtgaccggcaaccactgcccggtctgaccagtccacactgtcagcaatctcctgttcatcacctaaaaattcaatcatctccaaaaccactttgccaataatctcccaatatcaaaatcaataatctcatataccaattgttcatcgcaaaataacaatcaacacactttgattgtgcagcaatagaaatcattccatttgaaacaagacttgagggcatgttcaactctaacacaatgcactaactagaatattattcgcaccaaactacttaaaatttcctatttacaaaaggatatgcccaagagacaaaatgtcattccataccactactcttctctactttctcatatatgtgttgtgactaagccatccttctctattccccctctctcatccaagctagtaataataaatattgtattgtcatgcatatcattaattcattatagttattgttgtacatgcccttaactatcatatattgtgttgtcatgcatatcgcaaaaattataatggcatgtatccaattaacccttaattatattagtccggacatacaggtctcatgattagcaataagagatttgctctggtcttgcaaaaagtacctcgaggtactagtacctcacgatactggatcgttggatttagctgggcaggatgggcattgttagatccaacgatcgaaaatgatttggtactttttgttaaattggagcaaatttctatcatcaaacgattggaggaacgtgatatcaagcacataaataataattagctggctggccaataaaatgaaaaaaaaatcttgattagataatattataaacatttgtttttcattcaaaacagtggaacataaaaaagtttcagtcacacatttatgaaaacttacagtatatatggagtagtaaatacactgtaacttatttgccacactctgaattcccctctttcatcttctgcctaagatcgtaggtatattctacgttaaaatgcagaggggtaacagcaaagctgtcatacacgatgttgtgtaaatgtacttctaacactccgaataaaggatatattaagaaagtacatcaatgcagaaaaaaaggtgacacgccaatcaagccattttggttctatgaatcttcatcaatccaggcaatccaaagataattatgcaggaccaaactcttttccacgtgaacaggagaactggccttgcttgggacatcgctgcccaaattcccaatctaatcctcaatgtgtttgcgatagctagggataccccgatttccatatttccaggtagcagagaaacaaatgctatgatgcagacagacactgctgcattaagagtaacaggagctagcaccaggtacatt

SEQ ID NO: 34173 - DNA, 1501 bp, Oryza sativa
atatactgtaagttttcataaatgtgtgactgaaacttttttatgttccactgttttgaatgaaaaacaaatgtttataatattatctaatcaagatttttttttcattttattggccagccagctaattattatttatgtgcttgatatcacgttcctccaatcgtttgatgatagaaatttgctccaatttaacaaaaagtaccaaatcattttcgatcgttggatctaacaatgcccatcctgcccagctaaatccaacgatccagtatcgtgaggtactagtacctcgaggtactttttgcaagaccagagcaaatctcttattgctaatcatgagacctgtatgtccggactaatataattaagggttaattggatacatgccattataatttttgcgatatgcatgacaacacaatatatgatagttaagggcatgtacaacaataactataatgaattaatgatatgcatgacaatacaatatttattattactagcttggatgagagagggggaatagagaaggatggcttagtcacaacacatatatgagaaagtagagaagagtagtggtatggaatgacattttgtctcttgggcatatccttttgtaaataggaaattttaagtagtttggtgcgaataatattctagttagtgcattgtgttagagttgaacatgccctcaagtcttgtttcaaatggaatgatttctattgctgcacaatcaaagtgtgttgattgttattttgcgatgaacaattggtatatgagattattgattttgatattgggagattattggcaaagtggttttggagatgattgaatttttaggtgatgaacaggagattgctgacagtgtggactggtcagaccgggcagtggttgccggtcacatcggctgtacgtgtgcagtcagaccagccagcccgcggtctgaccaggccacattgtgttaatttcggttttaggttgtttctttggatatctagtggataaatcatgtttatgacttctagatggatactttgcgtatgtaatactgttgtgtgctaacaatgagttaagttggagagagcttgtgcttggatatggtttctttgttgatgcatgtgtaggtgagtcttgatgccttgggagagcgttgccggtgatggatgatgagtcaacttgggagaagatgacatccgaatgatcaggatatcatgcgggatgctaggctaaaaatcaataaatgtgcgtatgggatgcagagttgaatttggagggagaccgaattcggtacaattacagtttgtaagtttgtttcttgtacgggaaggtttccttcgggattaggagttattgtataaggttggttaattcgatgctttaggctacctacctagggtatgaatagtgagggaggcctcccggtatcgtttttgagagagttgagtttagagaaaagttagggtttagagtttcattgagatttttgtgaggagtgttg

SEQ ID NO: 34174 - DNA, 1501 bp, Oryza sativa
ctagaaattctaagaaaaagcaaaacatctatcctttgattttcacttaaattagtgagtccaatattatacaccgttagataaaatcgatcttaaaacaaactaaataccatgagccccacctatcctcctcccgcgcatgggcaggtggagtatataagtacctacatggtagtacgtacgcttccttccttttttttttccttttttcttctttttaccatatatatatatatatatatatatatatatatatatatatatatatatatatatatataatggatatattttttaaataatcatgattttataaacaaagaatctaccatcacataacttaaaccggtgtactctttactttgcactattattttcaaataatgcactgttttaaaataaaatttacacaataatatcgtgtacctatcaaattaataatatctatattaactaatttatacgtgcacttaaactgatggccccattatataaatcatcggatctattttttattacattggcctattattctcaagtaatgcactatttcaaaataaggtttacaccattatattgtgtacccattaaattaacaatttaaaatctatattaactaatttacacttaccctataactggtggacctattattataatcatcggatcaattgtttgctaataaataaagcgtctgaaattctctttttgcctgctgcacaatgcacgcctgcacctttgcctttcgcacgtgtgacaaagcgtagtgtctgagacatctaagatgatcacaaccgctgtagcgctaccgctttgccacatatcaaatcatatatggagataattaattttgttaataacatgaaaagaaaattaaatgtgtgatgcagcgagagaataattaagcactatgggttgtgtttttctcaacactaattagctctgtttaagttgaaaccgagagttgattacataataattataattataatgtatttatgttatgtcgtatttggatttcgtactatttgttcgtacaggtgaaaggaatcattatgttataaatgtgagcgcaatattgatgaatatcaatagaactcttactacgacaagggtgataaagggagtttaaggccctctcttttttcccaattccatttttggatttttgtttgcacgctttccaagtttctaaatggtgtcttctttaaacaacattctaatttttttagaagtcaattcattcgtttataccctcaaatagctatcacataaattatataattcatcaatttcatcctaaaccttaagtactacattttttttcatgcaagtcatggtgatcagtaaattggtgatcaacggatcatcaaagttgtaagataaatatgtaagagttactctgaacaattgtaaataggtgtcaaaattaatttctattaattagacatctaaaggtgtcaaaattaattgctagccacaaaattaatttctctctacg

SEQ ID NO: 34175 - DNA, 480 bp, Oryza sativa
tgagcctggccaataccaccgccgaggacgcgatctaattcattaaaaccactactaaaacgaggcacttcttgcagactaatatcagcaaggcgttggatttttccagatgtttcgcctgcatagccactaaagcggtcatttttattcatttctttgcttgaaattaggcgtatttcactaattgtattccacgccttgcattctctacattgccccatccagcgagaatattccgccccacaatcattacatacataagccgtttttgctgcctttgccattttaaccttctaaatccgatcagaccttcaaagtataacaaaaaatactgactaaatacacaggcttttacccgcttatttttgcgatatagatcgaataaataacctttttaagtcgcataaattgctgacaaattgcacactatctctgctatttttttattgatattgaatattatataggagagaacaatgt

SEQ ID NO: 34176 - DNA, 1501 bp, Oryza sativa
ataaaagttctagcagtttctgctatgttaatatgaaacatcgcactatctggtgttgctcgtttcaaaagaaaaagaagatgaagtttttaggctacttactctcttggccaccgagcctctcaacggcatggacaaaggccatgtggaggtccggtgtccaccggagccgaggcagcttcgaccggttgtactgccgcaccgatggcaccctctgctctccgccgttgatcccctccaacctgccgccaccgctatccttgtcgcccttcaatttgctctctgaaacgttattggtgctgctgttgttgctggagctcctgcttccggcaacatcggtggtgctaccaccatcatcgtcgtcgtcgtcatcctcctcatcttcgtcatcttcatcatcgccgacttctccctcctcgctctcgacatccataacttcctcgttgaggtccagctgatttctaccaatcgatctcttcagctcatcatcctcaacaatctcaactagcacttccttctccttcatctctctcaggctgatgctgatcagccttctctaggtagctatctacctctcaagcatcttaccaaatcttctacttgatctctttcgatctacactgccatggctggatcggaatcgtacgcgcgtgcaggtggaatagctaggaaaggggaaggaagaaggggatgaaatgagggaagcaatgatatgtagtagtactggtggagagatggggaagaagcataagcaagctagctactggctaatgatgtgttaataaaataagagggaattggacaagcattctcctcctacattgactggttttgaaacactgttccaagctagaaattatatctctatcctcaatataatcctgaccctgtccttgtgtttggtatgcacacctatgcaaaggacacacacacatatatatacacacacacaaacagagagagaagctaagctagctagagagagggaaactacacatcaggttaaagcagattacaacagccaaaaaggctacaaattaattaacttagtagctaaagacaagagcttttggtgaaggtgaccatggactaaatggtggaagcatactttacatagcagcagtgagatccttttcttggttttttttgctttcctattaggttttgcatgcatccatgcacgagtgagtgtgagctgagctgagcagctgagctagcctctggttagttcatgtgacccaatctgccaatctggctggattccaaaagcatttctttgccctaatagttttctcgcttgggacactgacccccttgtcgtgtggatctgagctgcactccgtgacacaaaaacaaagcgtttggtggttgacctctgcctgcctgtgcctgtgcatctgcatgctccctttgacaggcttgtttaaacagctattagctagctaaaaaggaacaaatgtttgacaggtccatgtgtatttatttcattccggatatgaac

SEQ ID NO: 34177 - DNA, 352 bp, Oryza sativa
ccgttctaccaagattataaacacatatttctacatcggttttatacgctgatgaagcggctaataactcagataacgcagcttttttggtataactattgtaagaaggaatcgcaaccgtggctaaaattgcgataatggcaatcacaatcattaattcaattaaagtaaacgctttttgtagtggcttaatcaaaaataaagatgacattgttctctcctatataatattcaatatcaataaaaaaatagcagagatagtgtgcaatttgtcagcaatttatgcgacttaaaaaggttatttattcgatctatatcgcaaaaataagcgggtaaaagcctgtgtatttag

SEQ ID NO: 34178 - DNA, 1501 bp, Oryza sativa
cgcatcgggatgcactcatgtgtaatccttatccatggtttccctgtgtgctatgcttgtttcgtatttaaatctatggtattaattgttgactttatttgttcaagcttttaaagctctgcccttcaaattaatagctctcaatatttagtttgaagacaaagaaaccatatgtacatattttccttttaaaaaaatataagcacttttacaatattacaattttgtttgatgttattgttatattctaaaagaaaaacagaggtcaaagttacacaccaaaacctaataaagtatatggaggtaataaatgttttttttaatattgcgcacacatctaaatattgtttaaaggagacatttatgcaaactatatattgtggtgtaaccagacatccacctgagctaggacagtgactagaagagaacatctgcagtctgagagtatatacgtacgtaggatatatatatgttcatatccggaatgaaataaatacacatggacctgtcaaacatttgttcctttttagctagctaatagctgtttaaacaagcctgtcaaagggagcatgcagatgcacaggcacaggcaggcagaggtcaaccaccaaacgctttgtttttgtgtcacggagtgcagctcagatccacacgacaagggggtcagtgtcccaagcgagaaaactattagggcaaagaaatgcttttggaatccagccagattggcagattgggtcacatgaactaaccagaggctagctcagctgctcagctcagctcacactcactcgtgcatggatgcatgcaaaacctaataggaaagcaaaaaaaaccaagaaaaggatctcactgctgctatgtaaagtatgcttccaccatttagtccatggtcaccttcaccaaaagctcttgtctttagctactaagttaattaatttgtagcctttttggctgttgtaatctgctttaacctgatgtgtagtttccctctctctagctagcttagcttctctctctgtttgtgtgtgtgtatatatatgtgtgtgtgtcctttgcataggtgtgcataccaaacacaaggacagggtcaggattatattgaggatagagatataatttctagcttggaacagtgtttcaaaaccagtcaatgtaggaggagaatgcttgtccaattccctcttattttattaacacatcattagccagtagctagcttgcttatgcttcttccccatctctccaccagtactactacatatcattgcttccctcatttcatccccttcttccttcccctttcctagctattccacctgcacgcgcgtacgattccgatccagccatggcagtgtagatcgaaagagatcaagtagaagatttggtaagatgcttgagaggtagatagctacctagagaaggctgatcagcatcagcctgagagagatgaaggagaaggaagtgctagttgagattgttgaggatgatgagctgaagagat

SEQ ID NO: 34179 - DNA, 906 bp, Oryza sativa
cacacccacaccccaagtgccttccaaaaactgcacactgcaccatgcaaaatgacagcaataagattgttaattaattttaacctcttgtccatctctctacccagtagttttatctcagtacatagatatatatgtcatggtcatgcttgcttaatgcttggttattgtcttctagggagttagtctgcatgcatgcctctctctagatatgtatgcatgcatgatcaaatcacttagcttgttcttttgtgacagcatctttgggaaactaaaccatcacaagagatcataagtatcagtgtgcagaagttccagttaatctaatgtgccattaatttaatatgtattaaattgtttactttttcgatctgtttatctataagttgtgcgatttttcttagttgctagtcacctagactggcgcaatgtgtgtagcctaagcttacacaattagtagctcaaactttagtataaattcactacaccatttcttttacttttattttcctggataaattacatgcacttttgtgcctaatttagtactacttgtttttatcgttttgcagtcgtaagtatgcccaccaggcaccagtgtataattttcaggtttgacactttagaaattattccctccgtgttgaaacattttttagcgtttgtagacatacaatgttatgacatatatattcttttttataagtgtctgtagacatttctcacgataaaaagataagtggtagatgaatagctaatgatcaatcactcaattcaggaaaaatgatgtataaaggccatcaaaccttcaaaaattattccagttaacacttctgagaaagcctctacaaaatatttaaaccattgtcacttctgagaaaccattgtgcctccttcctctctagc

SEQ ID NO: 34180 - DNA, 282 bp, Oryza sativa
tccatcagctgtacatggagatgaacgccaccggtagagagatgatcggagcggggatcatggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtaga

SEQ ID NO: 34181 - DNA, 379 bp, Oryza sativa
taagtagcaacatttttagaatgaatatagtagtttcgcttgtggttgcactgatccgctgtaaattttcttgtggttgcatgatccgcagctcgattgtaatcccagggatgatcgatcattgccaaacattaagttttggaactttttaattgatttaaggtggctttcttttgtaggagagaggttttatttataaaagcatttcttttttatttttaaagttttgtacggtttatcggtaggcatatgtagctccgatcataaagccatacgtacgcacgtacatttctcaaccgtcgatagatgcaagtgttactagcttactaacactggtggagaaaccctttgtagtcccggtttgtaacccccctttagt

SEQ ID NO: 34182 - DNA, 206 bp, Oryza sativa
ctgtggaaccttcacccaaactaccagctaatctaacagagctacagaaatccaaagtttttcatccatccatgcctcctgcaaatacagcctcagcagaaactttgtctccaaaacatgtaccaggacatcaccagattgaacaaaagaggatcagcttcctatcttccatttcatcactcattccttttcttctgtttcttaga

SEQ ID NO: 34183 - DNA, 207 bp, Oryza sativa
atagtctactcacggtgatagtattacattactagtctacaccatagatgatatatttaaatggagatcaagatcactcacctcaccgaaatccgaattcccaaacaggggatgagtcatccattccaggggaagcaaacatcaattgctaatttgcaatcaatacagaaccggtaactaactaatgcacctttcagcttgtccagg

SEQ ID NO: 34184 - DNA, 174 bp, Oryza sativa
agggtttcctaaggtgtctaggactcttagtatgagcttggttcgtggctttaggctgcctacctcatgtataaatagagggggagcgtgaggcttcccggtatcgtttttgagagcaattgagttgctagtttagttagggttttgagtttagtcgagatttttgtaaggagt

SEQ ID NO: 34185 - DNA, 381 bp, Oryza sativa
ggacatggcatcctattaccagccatcgcatgaaattaataggatgcaacgtcctcatcctagatggaacaactatgtcatctcacgggtgaatccattcatcgatagtgtggttttgtgaaactaaactaccaaaataaatgtacttaagtgctaagtgtcaaaatatgtgttgttttatgcaacttgaaccataaaacttgtagttttgtgaaatttactcttatgtttattactaaaactgaatcattatttgtgtgttcctctgttgactacagtttttacaacatttgtgtgctttaattttaggaaatcaaaatttttaattttttctgatgggccatattgccattttacgtgttttttttctttcagccaaga

SEQ ID NO: 34186 - DNA, 321 bp, Oryza sativa
ataagatagtgatctacatcagataacgaatccttatttaaaaaatcattttttgaaacaaggaaaatactcattaaaattgataataacgcgatgaaaaataacattattttatagcgtaatttcttacggcggcgttccctcgctagtactacatgtcgcaaaatatatcctattaacaaactctatttttcttgtgaagtactttgacaagcattctctaaaaaaattcataaaaattcattcttgtcagctcaatcaaaatcagctaattttaacttactttattatagccttattttctaaataaaatgcaaatta

SEQ ID NO: 34187 - DNA, 1501 bp, Oryza sativa
taatttagatatattataaaagtaatttctattttttcataaaaatatagtcatgtgagattttgttataaagatttaattgttatgaacacaatggtgtaatcggatcgtaaatcggatgagtaatctaagagaaaattccataagaagaaaaaaaaatacattcacttttgagtatactagtagcaactagatatgagattgaggtatctagttatgaccatagagagaatggtctcgttatagacagtgtcctttttaataggttttaaccacctggtctcacgcggcatgggcctacatctctctcctatccttcttcctcacgcacgcggcggaaaaagcggcggcgctcctccagggtctcaccgccggcgacgacaaggcgcggcggctaccatacctaaggcgcaacggcaagcggtggcaccgagctcgagagcaacacgacgctgcagccgacgaggacggcgagggagatgttgagcaggatgaggagctggcggttctcggcgagtgagaggctgagagcgacctcccttcctcctccggtccctgcctcgtgagcagcccatctgcactgccttctgcagcagcaccgtggcggacaggtgcgcagcggcggcgcgtcggtggcgcggacgtggccgagctctgcgccgtggcggcggcggcgttgcagagcggctgcagcagcgggtggtggtggtcgtagggcatcgtcggccacggcgttgctgctgctagctgttgttgttgggcatcgttctgcactagctactgttgctgctgctacactagctgctgttgctgttgctgttggtgtggcgacggcatgaaatcatggtgctgctgctcctgcagcgcggcgagctcctggtgcaccatgaccggccgagccatcaccaccgctgtcgcttcccaacgccacaaccagccgaagccgccgccgccgtcaccagccaccgttgaagcagaagccgcttgcccgccaccgccaccagccgttgtcgaagaagaagtcggtcgcctgccgccgccgccgccgtcaccatcggtagcctagagttaagttggatggagatttcgggtacatgttacttaggccgagggcatttatgtccttttgaaatttctatctcctctttttcactgaaaatgataaaatattgtctcagatttactatagctaattacacaaattttgtggtgcctattagtagtgtcgcgttttttgagtgtcttctagctaattacatagcttagcttttagatgtccgtggcaaattttgcctgatgcttcttttttttttttactaattagtttctttatcttcctaagttccaagctgggccttaattttcattgcacatggcatctgctttccattctcaaactgcaaagcgacgcgacgcggcacgacaccaaaaataagtagaagcgtactccatactctgcactcaaccatggcggaggcggccaccggtgcaactgacacgt

SEQ ID NO: 34188 - DNA, 699 bp, Oryza sativa
aggtggggaaaatattcagccagaagaaatagaacagctgatttatcaatccagttgggtgcaacaagtatttgtttttcccaaagaagatagtgaatttggccagcgaccggttgcgattattcaatttaataatggtgattttactgaaaatgttacaaagctgaccgcttggttaaccgataaattagaaaaatttaagttgtggatcgcgtattatctgttaaatattcaagattatgactaacagggcaacattaaaattgctagacaacaagtgcaaacagcattaactaaattattagggcaaaattaattatgaaactgatgcgaaatgtcatcttatttgggctgaatttatttgtatgtagtagtgtgctacttgcggctgaattaccaagctataaagcgattgaaatgcaaattaatgatgcaaaaaagctagataagaacgatagcaataatgcactggtgaaacacttagaagaaacgcgcagtttgttagagaaaattgctcaacaaaaaaatgataatgaagatttaacgaaagagattaaaggcgcgagcgttgcattaggcattagccaagcgaatattgaaaaactaaaaaatgtaattgtgccaacagttgatatgttggaaaaaagttcgattggcgtttacaaaaagcattaacgagtttagaaactgaattagaaa

SEQ ID NO: 34189 - DNA, 1501 bp, Oryza sativa
ctagccctggtactgtcagaccctctcctgtcatcggatggggctgatgaagtgcccttaacaacagaattagaatagccttgaggagagaaggacttcaaagagttcctgacaagaataggctgatcagactttttgtgactgacagacttggaaccttccaaaatttcttcctgcaagaaagccagtgagcaagctgaatccagatcttgtggtttctgcgtcagaactgcagacctgatttcctgtttcagcccctccacaaacttggtcacaaaataattgagaggcagtgaattgttgtaagccaacagttggtgcataatgctgtcaaatttttctacatattcagacacagtagtatcttgcacaagatgaatccactgcctgataagaatttcctagtcatccttagaaaatttgacacaaacttgttcagcaaaaactggccaactaactcccgacagtttagaccgcatagagtgaagccaaaaggctgcgttacccacaaagtacaaaccagctatcctgacccaattcttagcatgtactccatagatgtcaaagtattcttcacaattccacttccacatttgaggattaacaccatcaaactgaggataagacatcggtggaacactaccccccaaacccatcacaccaacagaatttgctacatcagaaggggatcgatccaaatcagtcacatcagggaagggaatagaggtttttagagcacctgtttgattcagcatagaagcaatagcaggttgctcttgaggaaattgttgtacatccaactgcagctgctccaccttgccttgcaaatccttcaccgaaccttgtagatcatccaccctcttctcgacagctgggaaacgagattctaccactgccttgagcgccatgagctcagccctgctcttctcctcggaatgctccctcttcttctcactttcctcgcgcttcttctccgcctcctccatcttcttgagaagaagatccagtttcccatcctgatccatgatcttcgcggcttgcttggtgacatagcgaggtttctcgtaagtgcccgtggttgacgtctcgttctagatctcgctaacccagttgagggagccgaagcttttgcggaattagtcaccgaagcaacaattcccacctcttccgggaaaaaattttgcagcaaaatccaggaaatgagagaacggcaaggctctgataccagattgttagaaccctaactcaactgctcaagaactagtaagaacaagcaagaaacgagatagtttcaccgaatccagcaggattggtatcgccgccgccttcgcctccagttcttacttcatcgatacgaaagaaagtcagggtgctctgttcttattacaattcaactctctctctctctctccctctcttactccagacttactcgtgggctcggttggtactcatttggtccaatccggcccacacacacgcgtgttacacttacgaactc

SEQ ID NO: 34190 - DNA, 188 bp, Oryza sativa
ttgagctatttcctgtaactgaaatggtttgtgtggccttgttagtccttgtagtttaacatttgtagttgtgatgtactgtagtgtccatgagatattcgtctatttccttgctggttgaatcttaacataaaattgccttgttacaactaactctgtacctaaattgtctccttgtctatgacaga

SEQ ID NO: 34191 - DNA, 433 bp, Oryza sativa
ataattggttccgtgcctcgtgaaatcgtagcccaacgttggtagagttcgtcggtttcgcacactttattagttgtcggtgggggtttgcttttttttttttttacaagcagttgttaattcacggtaaatcacgatgaggaaaaaaaaacaggttatctgcggtgccggcgaaacgcggtggaggtggtgttgttgctgctgcatcggcggcggcggggagcgcgcaatttggcgccggggacagtgagaatccatacgaggtagaatgattgggttattgggagtggctatgttcatgtttaggatcagccttcgttggtgatcaggtgattcaatgattggatgtggctcctggtcttgatgggatggatggtccctgtttgttagaatttggggatcaatccacttgatgggttcaaccatgtgaaga

SEQ ID NO: 34192 - DNA, 175 bp, Oryza sativa
ttcttaacttaaatatagccaaacgcaaatataaaactacagtgatccaatccataagaacaaaattccttctttttcctacaatcggaaggaggcctagaaggctaggggtgggcgttcggtcagaccgaaaaatttggtcttggttttcggtcatttcggttttggaaactca

SEQ ID NO: 34193 - DNA, 608 bp, Oryza sativa
ttttaagagagccccttgtgcttatttccacacctatcagaaaatttttggagctagttcattgccgatgatacagtatgttcatatggagtccatgtttagaataagtttcttcacactctctggttctgaacttggttgatctttttttagtttcacatttatacaaggactaggccaacattatttttcttttgagtcacaatatagaatagtatgttaatactcaacggcaaagcataaacagatccattgtgagaaaaagaaatttatatatgtgttattctttcatgagaaatatacatgttgaattgtggctattttttgttatgtgttggtgaaatgtttggtgcgagttctctggttctagatgtaaaaatcgaaaatcatagtgtggacattttgtatatacttctgtaccaaatgtttggattagaactgtacccaagtaataaaagtgcatctggaagtattatataaaatgctgtttggagctacctatcaagcaattctacatcatggtattctgtgtctatgatcgatgaatccatgcatttaacatgcaatactttttgtttcattttctttcactcatctagaaaaggaca

SEQ ID NO: 34194 - DNA, 289 bp, Oryza sativa
gtccacatttggtcaactcgacttgctattgttggctactgatctccgtcaacttgtcattgacgatgtacattgttgtaagttgaggcaacaggcccaaccagtcttgcacctatgtactcacaattgcaactcttgcaaacttctcatgctcatcagcatggtgtatgtacgccacttacagtgtaaaatgtaactatatcttgacgctcttgtacaaaacaagaaattttttaccctggttagggagaacaattctgtgtgttttatgtcttcctttgtatgcaga

SEQ ID NO: 34195 - DNA, 179 bp, Oryza sativa
ctttttgtggcacggcagaagaaggcaggtgacccgctcccccgtaacaccgcggggaagttggggggttaatccatctgtttgcagcttggtaaccgtgtaataaactaataacactgccttaaaaaaacgaaaattttaaaatgggttggagcatccatggttgatagaggagaaaa

SEQ ID NO: 34196 - DNA, 377 bp, Oryza sativa
aaaaattttgacgtgccacatcagatatacggacacacatttaaagtattaaacgtagtctaataacaaaacaaattacagattccgcctgtaaactgcgagataaatttattaagcctaattaatctatcattagcaaatgtttactgtagcaccacattgtcaaatcatgaagcaattaggcttaaaagattcgtctcgcaatttacacgtaatctgtgtaattagtttttctttttgcctatatttaatactccatgcatgtgtccaaacattcgatatgacagggtgaaaaaattttgccaggcgatctaaacaggccaatattgcaaacatgccaatttctgaagttcttaccagtgtgtctgtccatcaga

SEQ ID NO: 34197 - DNA, 928 bp, Oryza sativa
taaagtccgtgctacagctggctatagatatgtagcccactgctcttctctctcatcttttatctcattaaaatatgtttatagctggctaatagtctgctattgtacctgttctaaggttacagacggcttaggcatatgaaccaagaaaatttgtgagacaaacagatgaatcatgaagagctaaccactcggctgagagatatatctcattaaaatatgtttatagctagctaatagtctgctattgtacctgctctaaggttacagccggcttaggcacataaaccaagaaaatttatgagacaaacagatgaatcataaagagctaaccactcggctgagagataggctataaagatctatacattcagcctggttatattatgattcttgctcttacgtgtgctcgatctgtaatagtacactgcacgatcaattgagatccagtgcagtctattatcgcagtcctgcttgcgttgtctataatctccaagtgatcatatagacgctagcatttggctgtttggttcccaacaatattttgctaggcatcatttgtcaataaaaattaccacactttatctaagatgaggcgatcaactttttagacacaatttacaaaggttgagggaatcttgtcatacttttagtcattagcacatgaaacccaatttattataaaggaatcttgccacaactatagttacaaccgaacatctatcaagttgatcaaatttacctaaccttagacataacaaagtgtgacttgaaaccaaatattcctgcttagtcgcttacttctcaatacatataatgtctaaaaagtctaaaataatttatcatcacaaatatatactgctatttctttcaaataactatctatataaacaattaatgtttagaccatatgtccattccccacagc

SEQ ID NO: 34198 - DNA, 207 bp, Oryza sativa
agctaattcgtgagataatttttttaagcctaattaatctataattagcacatgtttactgtagcatcacataggttaatcatggattaattaggctcaatagattcgtctcgcaaattagcaaggttatagattcattaggctacgtttaatacttctaattagtgtccaaacatcaaatgtgaactttagtccctgatccaaaca

SEQ ID NO: 34199 - DNA, 295 bp, Oryza sativa
agggcatttttgacatttcacgcgatttctttctccttcccaaccggaaagtattattttaatcagcgcggtgtccactggcaaattaccacgtttatggagtgttttcccccaaaagtgggtttgggcagtgttctagggctaaaaccacacataacaagtgtcctgtagcaaaatttccctaaattttaacatgttgggcacggttgattggtgacatcctagattcctagatagaagatggtcgagatttgtctgatactcgattcagagagaacccttttgtgtggcatga

SEQ ID NO: 34200 - DNA, 267 bp, Oryza sativa
catccccctgtggagattatgggtaccccatacccacacggcatggttatccgactagttataggggataacttatatatatggaatatgtaacagatcatgacttgggtattacgtttccttatatattacggaacagcctaaagtcctagtttgataatattgtaaagtagatttaggaaaccgataccgtattggttaaggtttctatcttgtaatcctgccccccaccctatataaggtgggcaggaggccctctagggggca

SEQ ID NO: 34201 - DNA, 260 bp, Oryza sativa
atgacgacttagcgactttcacgaacgacgacttagcgacttagcgactttcacgaacgacgacttagcgactttgacggacaacgacttagcgtcttagcgagttagtgacttagcgagaacgacgacttagcgacttaacgacttaacgagaacaacgacttagcgaattatacatgtatacttgtagggtttagacgtctgagctgtacatgttgatgtccatgacctcactgtctttttttctttgcacgcataga

SEQ ID NO: 34202 - DNA, 344 bp, Oryza sativa
aatgctagggtggaagaaagggttaacaagggcctcgccgacatgaatataccctgagggacaacacctggtgggcattcaacttcttgtgcacaacacgacgcgagtccgtcacagcataggagtagttgtgcatcccagaggtgccagcccctggtctcccggtcgcaccactagctgcagtggaccacatcgaggtaattgatgttatccgatccatatctaataaaaaacctttacacgttccaatattaaattcaaactttcacatatgcagggcgcagcacagtgtgtcctactggcgagagtccacccaactttcgctcctgaagtcgctgagggca

SEQ ID NO: 34203 - DNA, 184 bp, Oryza sativa
gcccggtacaccttgaggttttcatttatgtggaaaaacggctattagatggctcattttttggcaaaatgatgtggtgtgtatgtttcttcacatgttggaacacatatgaatcatttttttttttttttggaattgtaatttatcatctctttagcactctaataccttaacttcctgtaga

SEQ ID NO: 34204 - DNA, 681 bp, Oryza sativa
ggtttgaaatctcttagctcgctttcctgtcgagatgtgctttacttcttgtactaagaggaatatgatggcttttactttatttgcatgcttgacttggttataacatcaattatggctcaagggattataatatcctcttgatgagaacaatgcactaattggctgttgtgatgtgctgaacattgcagcataatgattggacccttgaggaagactcaaaagccctacattttctccaggtattgcaaatccagataaattcagtcaattgtatctgtgtattgcattaagttattcacatctgattattgtagcatgtctctagttttatgatgtaagatcatctgaagtgcagtctgtccttttctttattcatgttctacgcctttttgtatgcctgccatcaacatgtactgatgtacagtccagctgccaaaatgacactggagtttgatagaaaaatatccgtactacatttattttctataacattatgtttcttattcccagaagatctaactttctctccgtgtgaatgcagccagatttggtactttttacaggtgcgccctttgccctattatatctgtactacataatatactcgttactttgtgaagttacacttaaatgcttattccttacatctcctgtttgctgtcctccatttatggcagg

SEQ ID NO: 34205 - DNA, 1501 bp, Oryza sativa
acagtaaccgtgcattacacaaatcagcaatggcagcaaaaatagtccggcagagcatagccacacgcaaggaggatcgaggggcattaccttctagtgattgggcgcttcggttggagcttgaggctgctggggctgacagtggcgcagctaggggggtgccggagggtgccaacacccccctatccccactacatcccctgtttttactctgtattaaggttaactaagataagtatttatctagtttatttgtgtagcttgaaagtattatcactttagttagttagcagatgtaaaaatattagcaagaaacatgatatacaaaattagtttgtgatttctcatctttttcaaagtaaaatagataatacttatttgtgagattattcaatagtttacattgaaagaatttagcaataaattaagactatttcaaactttcaatgatattattaaagagctaaaattcaagattttgttaaaggactagtttacgcattgattattattgacggtgactatttgacctcctttgctataaatattagttattcggtctcatggcttctcaccccacacctcctaatatcaaatcctggcttcgcccctagaggctgaacagcttgtcccagaattgtcgagcaagctgcagctgccgatgctatcagcaatccgtgctcacctatttacagcggaagagtctcgtgaggtggtgaggatccgaccttaaatcggcggtggaaactatggcgagccgaaatttacatcggtggcgacggcggtgacagcggtgttgggaggcaatggtagaactttaggggggcagggaaggatcttcgataggctttgatgagcaggggaacagtttagtgaggtggtggggaatcgacctcaaatcggcggtgacggccgtggtgagccgagatttacatcggcggcgacggcggcaacgacagcggcgaccgtggcggtgacagcgatatggatttcctaccgtcctctagcggccagatgatgggacgggcgtatggcgagtaggcgaccaccggcggcggcgtggttgtacaggggacgggaaagaacgatggggaatgggttcgctggaagcaggcaaaagacctaaagactcgtcgtgcatcggattagaaacatgcatgggctgatccaatggccagcaagcagatgaacagggcaacagtaacgtgactgcgtagcaagacaagcagcgcagctgccgtacttcaccaaaaactataatttttatagatctgttgccagagggtcaaaaagaagaggccccgagtacagcttccagaagccgtccattgtgaattcttcggctggattcacttctagaagacctgatcccgtctccccatatcgccttcctcgagatccccccgcttccacatccctcctcccccatttcctcctcctcttcctcctcctccgtgcccaccacctgttcgacggatcgacggactcgccaccgcagcca

SEQ ID NO: 34206 - DNA, 1501 bp, Oryza sativa
atttttccctctctctctcgcgttcaaacgggcggatttgcccccgcaaatctcgccggcgccattgatggcggccggacctcccgcgcctattccttccccgccggccgctctctcccccttccaaccctatttaaaccctccccgcacctcctccgtccgtttccgcctctcgccgcccttcctcctcgccggaatcgagctcgcgccgtcgctctctctctcctccctcgccgacgacctccggccggccttctccgctcgccgggaccgtctcccgcccctgcgtcgcctcctccggcttcgccacaccgccgtcgaccccgtccaccccctcgccgagcccgcggaccgccggaacaccgtcgaccccgtcgacccgagccgcgctgccgctttactccgctccggccgcctttttcgttgtcgccttcgacctagggtgagccgaggaccgccgcctcgtttccccctttccctcccctctctcggccgccgctccgatgtgcccatggccgccgccagtgaccataggggcgcgggcgcgccgcctcctgccggccgcgccgacgtggccgccttcgggcgcaccgagcggctgctgcgtggggcccggccgtcagccgcccgcgccctcgggtgcggctgacgtgtgggacccacggcgccggccggtgtgagcccgagtgcacccggtccaccgtggaccatgaggctgccgcgtgggccccactcccgtggacccggtccgcgcgccccctcctctcggctgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtgtaagttgaagccgacgtttgggaaagcgagcaaggcaagtcacatcatccttgaacatattgaatcccagtttataaaattatgttgatttaaattattgcattatcgctttatttaaattcccgcgttatcactgttttatttagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatggttttaggttgggctcggggtgcatggttttgatagtagcacctcgg

SEQ ID NO: 34207 - DNA, 1501 bp, Oryza sativa
aatagttgtggttttcgcatagttttccctaattaactatgcactgtaagctttggtctcgttttctctttaaaataaaacaacttcttctttatgtaaaacgtcggcaacggcctgatcgttcgaagaaaaaaaaacttgctgccccatgcctctgatggtggccaggtctggtggcagtaccatgactgatgaagcctagcagatcaatgggctgggtaccgtggatcccttctgcgggttcatacggtatctaagtaattatattattagaaatatatagtaagtaattattgaaaaattcttactatttaccatactatttttttaaaaaaatatcgctcaatttttgaagtttaccattgagatgcgaattcattttgtcatcctatccattctacattcatgctatgcgtccgtgcaatatccatcggatgctgctgcctttgccattcgaagctgcctccaccgcgtcttccccgtaacccaccacctacattttcgtcgtgccttggctttgctctgcgtgcgtcgtcgggggctgaagttggtctccaccgttacacaaagaggaggccaccgcatcttcgaatctgttttggggagcttctagctcatgctattttctcctagaattagaagctctttcttttgcgaacgcgcagaagaattgcacgtcaatatattagaagaatagagtattgatacacgacacactcagccagaccggcttatgcctaggaaggaagaaaaacaaagataaaaaacaaagaaaggaaaggaaaaaaactcgaaacgacggtaactctactccaaacagcgggagggagcagagccactctacgctcccaacaattccccaaaggaagcgatggccgctaacgaccacagccggccctctgaaaggatggactctaggactactgcgaccgaagagagcacagagtcaaagaccctggagttacgttccttccacagttgccatgagactaggaggactagggagtcgaagctggcacagagatgatgtcacgaccggaattaacccaacgggcgttccttacgtgcgtgtattattccttatcccaggaggcaaggtacaccaaaagttgatacattttagagtttatcaagcggaagcgtaaatagttaatttattacatgggcggcgaaggcccatctccctccccctccctctcctctccccgcggcccatccggcctctcctcgcgcgcgcgccgttgacgggcgggtccacccgccaccctcgctgacgggtggggcccacccgtcatccccttcctcccgccgctcccgccgcctcgcccgcgccctagcgccgccgccgccgcgaatcccgccgcctcccgccgtccccgcgtgcaataaagagggggaaatcactccccgtgatcccctctcccttttcccccatttttccctctctctctcgcgttcaaacgggcggatttgcccccgcaaatctcgccggcgccattga

SEQ ID NO: 34208 - DNA, 1501 bp, Oryza sativa
cattgcaatgtgctgattgcatctgctaatattataatgtgtcttaattaagtttagcggtccttccgataggctcttacaattgttatcgtgcctttagcttctatgacctaggctatgtatgctcctgccctccatgcctttccttgatttcttccttgatgtctaatgaattgttcatgctttcacacatccatctacagctcaggccatgcatcaatggctgagaatagtaacaagaaccaattagttttgggtgggtgcatagtctgagcatcatgcctgagtgcagtccaatattatcgcaatctgcgtgctgagaggaatgatatcttgaactaattatgtgataattgcaagatgtaatacatctcaacatattgtacataatgtcttcttaaatttatactgtttgcacgaagaaatgatgtgcttatgtatttgttaggtctacacataagaaagtcagtggtctacattgcaaatggaaagctaatctttagaatcagccatatcatttattgagttcctatcaatacattagtagcttatatatggaattatttatcattgttgattcccgttctacactgtatttggtgtttatcatgcttcgctttgtcagttggcgacttgacatgattggaaatatttttgccttttgatttctctgtggatagaatgacattatttgtttatctgtttcttcaggaatcaagatttggcttaaatgggggaacgatataaattctttagtggaagtttcagctctaacactgacttggtatgatgttgctgtacttatctatttccctcgaagatcttccctggtcgcagcaagatccgcccaaatcccccaatctgtacaaggtatttggaagaaaattggactataagactcaacataaacttccaggtttaacaaattagttatgcctgttgttttttatcatggattataaaatgtagccgttctttcagattgctctgtacgtatgatgaggttggcatttaggattgttcttttatttgcttaatatactaacctcctaattagcaaatctgtaatagtaataaaaaggaaaccggtaaggatatgtgcttattctttctaggctgagcaacacatgtaacaaattagccgattggaatgagcttatatgtcgataacctgatggattagttagttgacctatgcagccaatgtgacgtcaactacagagcatccggtattgtgttgggagtatcgttgccatccactaaatgcatatgttaaccctgtaatttgacctcacaatttttagtgctcctgccgattagctcttcatgtggttaaccttcctggtaccttttacgcttacgcttttcctttcctccactcctttacttgctgtctctttagttattcatgctttcttaccatccatctaaatggtcaggtcatacaacaatggctaagaatagtgataacaaccagctgattttggatgggcgcattgga

SEQ ID NO: 34209 - DNA, 327 bp, Oryza sativa
tccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtga

SEQ ID NO: 34210 - DNA, 1024 bp, Oryza sativa
ctaagcagccgtccgtcgagaatgaagaaattcagactccggatcgtgccgcaattctgttcagggacgattttaacgaagactatggcaataccctgaactattttagcaagaagaaatcacttgttcctttgccacctcccgatcctatggaattgggcttcctaagggaaactgttcagagttaacatccataatgagtgacgaatggctaagggaggcagagcttttatccgaagtaattcggatatgccatctggaagggaacgacgtcagtattctctacagtccaactatcggggccaatctcgtctccgagtcttttgcattagcttatttatggcaattgtatttattaattaggattttaatgttggtttaaattaaagacatggtatgagtcctccatgtggtcttgtttgttgtttttatctttaggaaagtttgagtcatgtccataatagacaagttttgtactctaggtataaatataaacccaagatcattataaaacaggacgaacttccaataaatacaactttcggcgcatcgccacctttttctttaagtttttgacaagtttttgcttcgagtcggggcatcggttgtgatctctcgacaagaggtaacttgtctcgatggtttgcattaatggggctattgcgtcgctttagatgtaatggtctcatttttctagctatcgtttatcatatatcttacttaatctagtctagtatctcgatttagtatcggctgagactcgctttaggtttatactggtattggctaaattacctcgctagattagattagctaaggtatctaccatcctgaaaattagttaattacttgattgtttagactttaggtttctttacatactttgagatgcatcaaccctagtcttgtctagaaccctaaaaactaacctgtaattaatcataattagggatagtatcagagtttcagctgatcttatctaatatataatattgcatgctagagtaaattaactggtgctaca

SEQ ID NO: 34211 - DNA, 314 bp, Oryza sativa
caatcggctgaagcaggcgagaattcccgttcatcaaaggttgggcccggtaaatcaaaatgattacttggaggaagacgagaacgcgaagactcagtggtgtccttctggtatttttacaaagaatcagaaaagaagggttcaaaggttgaggagcagggagcgctttcaggaggtcgagcaagaaattggtcatcggctgaggaaagcaaagccaaggaaggagtggcgtgttaagaatcaagttcttggagccgatgatattgcagccgacgaagcaaagaggttggcaaaagggaaaagtattttaacgg

SEQ ID NO: 34212 - DNA, 515 bp, Oryza sativa
ctctgaatttcagaaaccaccatttgcatcatcataattaattattttgcttaccttctcaagaaagtgtgactgagaattggaaggaattttgattctcttagaaggtgatctaaagatggagacacaaataactgttgatgttctgttatttttcatggtgttgaatggcatgtttaggtagctttgctgaagatgtgaagtgttgagcctgtaatctgtagttattagtaacactataatttttagtaatgttgtaatccctggttagtagctgtaacctttggttagtaatttctaataaaattctgggattttcaagtctgctagtaggctgcatgtattgatgcatggtggtgttaggctgttttagctcacctgttttgcccctgcagcttctgcattcccctccgtgtggaggcaaaccagttcataatccatggattagctgtggtctgtgtcagagttacggataaggtataccatctatcctggatatacgatgagtaccgata

SEQ ID NO: 34213 - DNA, 1501 bp, Oryza sativa
ccgacctgccgcgagatcgctggctgggccgctcggcgtcacctcgtggctcctgggtacgaccacgacatctgtcgaggccatagcaggagacgcgctggaagtccctccggacccgtcttgcgccgctttcgcccgcgccgccctgtgaaaggctagaattgagacatgctgcaagagctcgatgaagtgataaaacctcaaagttcatccacttacttctcgccaagcgtcacaagccgctgccgtcatggaggcgggggagacgcatccgaggcctggagtataacgggcgtgatatgaggtggaagattcccgactacgcgatgaaggaccaggagaacttaccgagggggtgggcgtcctccgacgatgtccgatcacagaggagaattgccttcccttttacggaacgttgccgccactcgttgtggccgcagcggcaacaacatcagatgcctccttggcgactttctccttcagcgatgccgccacctgatggtccacgagcggcccgatgatatcagtcagagggagagcctacacttcatgaagtcacaatgcgatcttggaagaaaaatgcaaaagggctaccgagtacacttacattgatggcggtttcgcgttcggctgcccccttctcgcaaaggggacgggaacgttgctcgccgttgttgggccgctgatcatcaattggccgacgcagcactccacggtttcgctattcaaacctgtagatcgagaactagaattcgataagtcaggaggaacacgcacataaggaagtcaatttaaatacaagaaatataccctgaggagaaacccgggtcgcgtcctccgactcagaatagtcaaaggctgggtgggctcgagcctggagcggctggatccgcctaccaatgaagtcggcagcgacttcatacctcgacaaacctcatactcggaggtcatcgatggcatcgatgaaggattgaagagaaggggtcaagggaggttttgcggtccaagacgaaaatcttgtctggttgttcctcaggaacaatgaagactggatcagaattttctatctgaagatagaaccacctcacccgccatttgctacgagaagaagggcgctggaaggggatatagcgtgacttcaggccatcccggagtcggaaaccgaccaagaaacggctgtaccccaatgtagtcatcacaacgatgcgaaaaaatactgaggaaggcgatggaattggggttcaaatggagcaaggaaaggccgtagaaattcaagaccaagagaagaaattcagaaggcggagaagaaaaccacagagaatatagtcctcgatcgcaaccatgtgacccaggacaggctggggttcagtacctcctacttctctctccatggtcccgcgaccgggaagggcgccatccttctgtagcttcttcagcgacgcgctggtggaggtagacttgtcgagatccattgccgctggagatcgccggagaagggacc

SEQ ID NO: 34214 - DNA, 1501 bp, Oryza sativa
tcgtattaatgtttagggccaagatcattttagttgcaacaggaaaaaaaaggcaaccttaatctttaacaaagatggctttttatggtcgcgcaaacgcgcgactctaagtggctagtatatttgagatccgtacggttaagaatagtcacggtgatccaaagtgtaacaaaggtaaaattatctggttgaaaacaaaaatattggctaaagaatggttaaagagaaatatctaataaaagattgcgtaaagagaaatgtactctagctgtgttcggaggttggtgttgggaacccatctcccatgcacggaaacggagcggtctattagcgcgtgattaattaagtattagctaatttttttaaaaaaatggatcaatatgattttttaagcaactttcgtatagaaactttttgcaaaaaaacacaccgtttagtagtttgaaaaacgtgcgcgcggaaaacgagagaggagagttgggaagagtaccgaacacagctaggtaaaaattaaacaggccatcctcagccatatattactatcctaatttgatggatatggatgctctgcagtactgtatttgcagtagcagtgccggtttcacatgtcagcggctgctactacagctgtaacactgtagacaatccccactgtaatttgattagttccacgaagaattaaaatccatagagatgtttgaatgatttttttaacgaattttacgaaaactcatatgctgcagtgatccttaaacttatataaaagtaaaactggtcggtgcgccaacaaacatgctgattttctagttaatacttaatcacagaatttacagtcgcatttgttgcgcagcttgcgctcctaattataacagggaaaacttgcagccccatgcttctgatgatggtcagggctgctaagtaccaggttgggctctactgggctggatctcttccgcgggttcctcctacggtatggaataagttcaccttagatcccttaatttgtcgtcagtttaccccttaatttgttgcgctcctaattcactacggtagtttttcactttctgcggctcttgtcgctacggaatgcttttcttagacttttgctcaaaatattggtgcttgagaaagccaaccgttaaatgtattagtaaaaactaattaaaaaacgaagatagtagtaagtaatcattgtttactatttgtgtcttctggatatgggatatctctcatacttgtacttgtatattttggtatatttgtactcaaagtatgagtacgaggtatcctatattcagaccgataatttgtcatccaatttatagggttttaagaaattttcacccaattcacatgtctttatttcatattactctatctatccggccaaatagatattgcatctatttgcatctaccatacaagtttatgcatagtggttgttatcagggttataggtaaggtataccctctacccttcgatatacgtcacatatcgata

SEQ ID NO: 34215 - DNA, 491 bp, Oryza sativa
gtcgtgtagacgctgcagcttcggaagatccgctcttcgtggaagtcgaagccgtcgagtgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattattaccttgttcaccctagacaaacaaaacctcaactagtggacactctactcatggtatccctagtataattttaggtagatgcttcgcaatctaattaggtaaccttaggtggttttacaactatagactttgggaaatattcatatcacttggacactctggaattgttggattattgtggaattggcttcacaccgccccctctattcaaaaccccctaaaatggttttaggctgggctcggggtgca

SEQ ID NO: 34216 - DNA, 171 bp, Oryza sativa
  unsure (1)..(171): unsure at all n locations
cgaagtgagcatagctcatttagttaggttcctttgggagaatcaatctacccgatttcaaaatcctagacttgacacggatgctcgcatttatggttatttattttttcagtgataggcgacgtnnnnnnnnnnnnncggacattcatgataacttcatcaatctaaata

SEQ ID NO: 34217 - DNA, 1501 bp, Oryza sativa
caatgaaatcccatagccgtatgtagataatttctttgacatatgacaaattaaaatcatatggataaaagacttgatagtggttcaaggtatcacaaatgtcaaattattcggttcaaattaagtgaaaattagtttaaaggtgatgcaaagcgaacattgataataaagagtagcctaaagtgaaattcactcttacaaattatacttgattttaatttcaacaacttatttttcgttatttttgttaatacattttttttattttcaagcaatatataggacataatagacacaggtaaactacatgcctcaatttttgatgaaacctattacattttgtatttggatgaagaaccatcctagcaaaatccattgtatttgaaaaggctaaaaatcataatattccttgtttttctctctctttttacttctttaactttcatctcctcttctcttttgtatatacatttttaatctttacaaatttttttaagcttctttcatctgtaaaatgtaagtaacttatctatatcttatcacttctatattttagagtttgtctacattattttttccacccctcgtaaggtgggcagggaccaagcccgagggaagcttcacgcctgtgcttgccccgtttcggccgagcaacgtgccgtcgtgccctcgtgaaagcgccgtactcttatcctagcaaataaaaggcacactgttttttttaacaaaaatttgtgtgtacataactatcttttgataaaaatggacatatgagatttagccatatcattaagagtacattttttactaatgatttaatctgtgagtaaaatttttcattggctgcaccctcatacacaggaaccatatattgataaaaaaagtaaatttcagccacatcaatgcctcagaaaatttgacattttgatccaatctcaacttacactatagatggtaagtcatccagccgcaagtttccagcagtgatagataggggtggaaacgagcctagccaagcctagctcggctcggcttgcagtggctcgcaacaaactaggcttggcttggctcggcttggttagggaaacaagcttaaaacttgagctcggctcggctcgtttcctggctcgagccagctcgagctggcttgtaagacttcctgttaaaacacatcttcatatatattttgtaattattaaaaaaagcaagaacaaattattaacatgtaaaattaaaataaatttatggtaaatttgaagttgacaaataataacgccatataaaatgaaataatcgatataaacacaaaatggcctaggctcgcgagccaaaataagcggctcgcgagctagctcggtttggctcattttagcaacgagctgaaaaggaggcttgggcttggctcgtttggcttacaagccgagccaagccaaccaagctcgacccaagcccgagctgagctcacgagcctgagctttttttccacgactagtgatagata

SEQ ID NO: 34218 - DNA, 377 bp, Oryza sativa
ttagtacatatgaacaagacttattccccatataccctatttacatgttgttcgattaatccttttcacatggcaattggagggtattgggcaatcaattaatttcacatgagattaaggagattaatcccacaccccttcaatcgaataaacccttaagataggagggatgtgagctgggttggctaatcagattgtggtgttagccaatagaccctaggagaatcctatgaaaattctgttgagaacaagtagaattttggaagggattgattaaagaaattgaaggacttctacggtacaatacactagcaatatatatttttggcatatacaaagatacactaggaatttccatgtacaagttcgcgtgagca

SEQ ID NO: 34219 - DNA, 746 bp, Oryza sativa
tcagagtcaatctcttaattgattggagcgaccaagcccaaagtaagccttaatttgatcgtggagggatattgcaacaatacagtgatcaatgtacaacttgtcttatgggaatgtgatgactatatgtatgttgatgcatgttaatttattgaccagtgtgacgatctccatgcatgacacagatgattctcaataggtagtatactgccccgttagaatcagcttggctatttccttgattttcatgagcatatttttcaaaatgttaaatgacagacttcgtacaaaaaatttatgtataaaggttattttaaaaaagatagataaattttttatttttaaataattattactcaaattatatacaaatcacgtttctcgctttatgtgcagctaatgagttgtttttatccctggtttagaacacacccttagcttgttttcgcctagctaattaactagcacaactcgcgtaagagaaacatgcttgtaaatagttttactcttactctatataatatgtcggtattatctggtgctggttcgttaaaaaaaataattggccagtttaacgaagtgagcatagctcatttagttaggttcctttggtagaatcaatctacccgatttcaaaatcctagacttgacacggatgctcgcatttatggttatttattttttcagtgataggcgacgtacccgtcgatagcaagacattcatgataacttcatcaatctaaata

SEQ ID NO: 34220 - DNA, 211 bp, Oryza sativa
caattttcatgccagcttgacaatgttggcgatgcgccgatgccacgtttgtgccaaggcccattgtccccacaagagtttttcaaaccgccgataatcgcgcagttatagggtactaaggactcgtacaacggtttttattagtggtctttctatttctatacaagtaaatttaataacatagaaaaaagaaaaaagagtatggttgttg

SEQ ID NO: 34221 - DNA, 334 bp, Oryza sativa
ggcgaattgggtaccgggccccccctcgagttttttttttttttttttttttttttttttttttttttttttttttaccagggattcattgggtatttaacaacataggcatgcaatctggcaaatttgaaaaacttttaacatacaccccaaatccctgcccaaatttaaaaactaggggggacacagggcgtttttccatgtcgcattttctgtgatggggctaccatacgtgggagcaaaaaatggggagggtggagcgcatgccaaatgaggatctatcagcaatgggacggggcctccactttagcatttccaccctgctccttttaga

SEQ ID NO: 34222 - DNA, 157 bp, Oryza sativa
ggagtggggaaaatggcgagagttccggcggggaagacgaagcgtcgcttggatctcgggacttcttgttaagggtatcggaggtgcaaatgggcctaggcctgaacagtacctcagcccaatacttttaacagcgtggcccattgtgttccttagg

SEQ ID NO: 34223 - DNA, 1067 bp, Oryza sativa
ttctttactcccggttgtaactaccaaccgggactaaagatatctttagtcccggttgaagccacgaaccgggacaaaagattaccgggtataaatatccactgcatcggcttccctgcaccacacttagacttctccacgatcgatcttcttcctcccgcgccattaccgccccagacgtcgtcgccgcctccgccgtcatcgtcgtcgtgctcgccgcgctcatctgccctcgcgaacgcaaccggcagcgttgcctccctcaaggtgaggggcgcaaatcttgcgcctccgatctcgcattctctctctctcgatcgatcttgacacgcgccggccgaccggatcgacctcgccgtcatcttcgtcgccgactccaccgccggccgccgccgccgcgcgccgactccacctccaccgccgccgccgccgccgcgcaccgactccacctccgccgccgccaccgccgccaccgctgccgccgactccaccaccgccgccgccacgcgccgactccaccgccgccgccaccgccgccgccgccgtgcgccgactccaccgccgactccacggtggaacgtttgaacgagaacgttttagcgaacgatgacttagtgacttagcgacttagcgagaacgacgtcttagcaacttagcgacttaacgactttcacgaacgacgacttagcgacttagcgagaacgacgtcttagcgacttagcgacttagcgagaacgacgtattagtgactaaacgactttcacgaatgacgacttagcgactttgacagacaatgacttagcgacttagcgactttcacgaatgacgacttagcgactttcacgaacgacgacttagcgacttagcgactttcacgaacgacgacttagcgactttgacggacaacgacttagcgtcttagcgagttagtgacttagcgagaacgacgacttagcgacttaacgacttaacgagaacaacgacttagcgaattatacatgtatacttgtagggtttagacgtctgagctgtacatgttgatgtccatgacctcactgtcttttttt

SEQ ID NO: 34224 - DNA, 1501 bp, Oryza sativa
taggctattagactcattaattaccatgatttttttatcatgtttggtgaatcattttaagagtttcttactcggattcctatcaaatatgtctattcttggaccttttgagtgttcatcactcggcccttattgtattttttgtccttgatgtattcaagttgagaagcagtcggctgggtattttactaagtaccatgcgtgcttcgctataaaaccactcggttcttgactatatgtttagtttttcaactaatcacatagtcgggggctacacctaattaggtgcatctactcgatgcaccatgttttattttcgcccttcacagtcttttagcactcggcaagccggagcaagttgaattgaagcactcggattattgttttttgttttgagaagactattttggtcaactgcgaaggtctcgggggctactatggagattatggttaccccatatctacatggcggttatattccagccggatatacggtaccaaatatagatagaatatctttatgaggactcgggttagattctaaacttgtatgtcaagaaactacacgggatcctagtcggttacgattgtattttatctgtaatcccatattccgttaggatatggattgtactttgtattatggatcccttcccctatataaggaggggtccgggttcctctcgggacgattcttttttcccaatcatacaatcaataacatactcggcggaatcatccccggacaggagtagggtattacttcttgaataagaaggcctgaacctgtataaaattccttgtctccaaacccatccactttcctagcttgatagccacccccttttattattgccgaaatcttgtttcgatagaaaacttaaaaaaaactctttcaaacatgaagcagacacaaactcataaacgccaatacaagataaatagtacacaaataaattaggaagaaatgaacgacacaaatttggggacaaatacaacgcgtaaatttcccacaaaatacatacaaatgaaacatgtactataatttagaccaacaaattagcttagtactgcagttcaataaatcatctaacttgtcatcgacgtgattagctgatgaaccacgttgaatacatagggaccgtgacggcgtcctcggaggtctctgcggcggcggatgcggtgcctgagatcgatcgagttagcgaccaaaacaaacgaaattaaaatatgtatgtgtggccggcaattggggaagaaaggttcaagtggtcgtcaacggcaaagaggatacacaggacatgcagggacaacactcacacatgcacctacgtcgcatgggccactatccaaaggttagtgatggcacgagcaaaagcaaaacgctaaaattggcgcgccttaacatagcagttggcgccagttatattctcctactcctccagcctcccagatcatcccaccagtggcgaagagagaataaggagagaaacatctagag

SEQ ID NO: 34225 - DNA, 1501 bp, Oryza sativa
gagtttcaataactcgccgaatgccttgtcactcacaccatttttagccttccattgcaagaattctaggatggtactcaactttttgtagcccttctcgcaacctgggtacaacgttgttctgtggtccgctaacatgcgctccagtttctgcacctccttttcactttcgcagtcctcctgtaagtcccgcaatatttgaccaagttcatcagcaccggcattcccttcaacatccagctccgcctcgcccattgtgttttcttcaaatccgccatactgagcccagtctggaatgttctcatcttctacttcatcttcttccattgcaaccccaacctctccgtgcgaggtccaacaattgtagctacgcatgaacccccactgaaacaggtgggcatgaatagttcgtgtggtggaatactccttctggtttttgcacttgtcacatggacagcttataaaaccgttacgcttgttatcattagccccacccaaaaaataatgcacgccgtcaataaactctttcgaccaccaatccgcgtacatccattgccgatccatctatatgaaatacatataaatcgtaattatacaaaatccaagatttacaaggtaattacataataacacaataattgaatataattattcatacaattaatcattattattaaattcattgtacatatttttcatgttttaattacattataaacaaatatttaatatgtttttcttattttaatattaaattagcttagttttataatttcatacaaaattatatgtaattattcaaacaagtatttataatcttctttattccctacaaacactttctctctcatcatcttccatcacattttctagagggaaaaatatgtaaaaaaaaatagctccaaatgtagatgctaagcaaaacaaagagtaggatgaagttgctaaccttttgaagacctcaaatttgtatattaccaccaaaaaaatttacttaaaattttgacagcacctccctccctcaaagcttaattttgaagcaatggctcgggctggaggaggaagaaggggtatataaagctgtgcaactttagtcccggttggtaacaccaatcgggcataaagatctcaaatcactttagtcccggttggtaacacgaaccgagactaaagatcccaagccccccgacagaggtctgacatgccctgtcaggaggtgaaccgggactaaagatgatctttagtcctggttggtgttaccaaccgggactaaaaatcccttcgtcccgttgaagtaataaaccgggactaataagccactttagtcccggttcgttttggaaccgggactattgtggaaattggccgaccctccaaatacctcttctccagtagtgaatccaccatcggaaccactggtatacattgctaatagttgctattatgtcatgtatgctccatctagtttgagataatgtgattgaaagagtcttgaggattg

SEQ ID NO: 34226 - DNA, 1501 bp, Oryza sativa
ttatgagtttgtgtctgcttcatgtttgaaagagttttttttaagttttctatcgaaacaagatttcggcaataataaaagggggtggctatcaagctaggaaagtggatgggtttggagacaaggaattttatacaggttcaggccttcttattcaagaagtaataccctactcctgtccggggatgattccgccgagtatgttattgattgtatgattgggaaaaaagaatcgtcccgagaggaacccggacccctccttatataggggaagggatccataatacaaagtacaatccatatcctaacggaatatgggattacagataaaatacaatcgtaaccgactaggatcccgtgtagtttcttgacatacaagtttagaatctaacccgagtcctcataaagatattctatctatatttggtaccgtatatccggctggaatataaccgccatgtagatatggggtaaccataatctccatagtagcccccgagaccttcgcagttgaccaaaatagtcttctcaaaacaaaaaacaataatccgagtgcttcaattcaacttgctccggcttgccgagtgctaaaagactgtgaagggcgaaaataaaacatggtgcatcgagtagatgcacctaattaggtgtagcccccgactatgtgattagttgaaaaactaaacatatagtcaagaaccgagtggttttatagcgaagcacgcatggtacttagtaaaatacccagccgactgcttctcaacttgaatacatcaaggacaaaaaatacaataagggccgagtgatgaacactcaaaaggtccaagaatagacatatttgataggaatccgagtaagaaactcttaaaatgattcaccaaacatgataaaaaaatcatggtaattaatgagtctaatagcctaggctgtgacccttaccataactaaaagaagcatataacatgctaaaagaatgactatgaataaaccagtcatctcaaatcaacccaaacagcttttgcagcctaataaagcttacaaaaacggtataacacctttctgtcaggcaccttttgtttgcatcgtgttaattttaaagaattagcaaaccgcattaaaaaggatttaatcagcattgggccacaacattgtgagcacaaattgccaaagcaaaaagtgcctaagtccctaaggatcacaacaggccatgctggaaataaaattgggctgaagtactgtacaggcccaggcccattagcactcccgataccctaacaaaacaccgaagtctaagcgacgcttcgtcttccccgccgagactctcgccatttccccattcctcgctacagtacaagactgcaccgacggagctagggttcatcaatccgctccaatccaccctcaaaaacttcacgaaatttctccccgcgtccaccgctccgattccccattcctctccagccatatctcaaactaaatcaaatcatccagttcacattta

SEQ ID NO: 34227 - DNA, 620 bp, Oryza sativa
aagacgaagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaccccccgagggtgccaggccacgtgggcgattgtgtctgcctcaagcctctagtcatgatactcccggtcccatgtcaccgacaactgtgatgtctctctagtcaccgatccttgcgctgctccttgccctgaccagctaggctttcatccatcatctaggtgttgctcgtgcctcacctctctctggatctcttttaggcatgctccttgcttgatggcttaggtctttgttgttagaactgatggctctcttttggctggcttagcatctgatcttaagcacttccctgctgtcgcagttgttggaattccatccgtagggtccccccatctgccacttctctcttgtctagc

SEQ ID NO: 34228 - DNA, 608 bp, Oryza sativa
gatacaaagacctaacaatttctcaagacaggactgattgtgtatatagaggttctgaccattcttatactaccagagagaagtatttaggttgtgcttgcaaaaaaggactatgaagatgaccacacaactgaatgtactataagaatctcctagaaaaaagaatgtactacaaggcatacatgttccgttgtctaaatgaatatatcttcagccaacaatggaaaagtgattacgatagctcactaagaaagaaagaaatggatcacagcaagggttgcaattaaaccacaggatgaaggtacattgtttgataggtcaccattatgatggcctcaatgtcacttgaacaacttctacaagcatgagtgcatcaagctagaaagaaagtatgatcagcaaaacacctaaatggcatactgatcatatgtgtagtaaacacttatgtaaagcacacatgtcagtgttccccccaaagcaactaaacaactaaccatgcaagtaaaggaacaatgaaggcaatcttgccgaacaaaggatttaaacacaccaccaaccgctcagtccatgacaatgaaaacaatatgctttccataagctacagatca

SEQ ID NO: 34229 - DNA, 197 bp, Oryza sativa
  unsure (1)..(197): unsure at all n locations
cactagtaagagacaagtgtggaatgatcaaaccggtgttgnaatgtcttgagccattatgaatatcttaaacaaacttaatgattcacaactagatgcagtcacgtgagcatannttctaaaatccttttttgttgctcaatttagttctaagaaaaatcagatgtctgattgatcaatgcattatctcttgcagc

SEQ ID NO: 34230 - DNA, 222 bp, Oryza sativa
tttgaggaattttggaagttgaacggagtcaaacggatttacggttgggaagatattgaatttctaagattattggatttttggtctaaaggaaaaggatttaattaaatcctttttggaaaagaaaaagaaaagaaaaggaaagagggagggattatagacttttcctcgggcggcttagggcgcggcccaagggaaaaggagcggaccggccgagctaaa

SEQ ID NO: 34231 - DNA, 798 bp, Oryza sativa
accaatcggagagggagtcaatgcgcgggggccgccaaacagcgaaatcgaaaaggataggtggggaccgatgcgcgtggggctggcgccgtagcaagatgcggtagatgagagaagaggagctatgcggtaggaacggccgatctggatccaacggtgaggacaaaaagggtgacatggaagcaccaggaagcagagaattctaacagtgaggatgatttgtataggtatataggatatcatttattttactgtgacatattttattattaaagaagccttgcctgtgacttatatactttaggctaatttatcctaccgagaacgagagagaaagctgagagaaagagagagaggagatggagacttatacgtgatttatctcttctattcaattgtaaataaatattctaataagtgtggtgtccagcagtaaattttttatgatttctctcttctattaaattagaaataaatattttaatagatacggtgtccagcagcgaatttttgtattttgtatacaatgattaatgcgctaaccacagcacaagtaattgaagccccatttcatcaaactttcgtttgtggatttgcatcggagttgccccatgttcgttgggggtacttcagaaatgggctcaggcccattacatggccataaccattagcatcgcactttctctctgtttgctctcatctcgttccttttccttctttccagagcgaggctgtttgccgctgcagcgccggcggctcactaaaccccagaacccccttctctcgccgccgccccaa

SEQ ID NO: 34232 - DNA, 1501 bp, Oryza sativa
ttaatatatgtcatctaccaaataagatccaatcttttccggaggttgctttaatcctttatctccgttataaatcatttgtaaatgatttaattaatttggaatagtctccgtttaataggtttaattggaattaaatcttgtaaaattcataataaattcatatgaaatcagaatgaggccgttcaagtctcataattcatctaaaattatgatctacatgtttgtttactttttatgtattgtttatttggtttttattagtctttttcctcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggcctattcgcattgattactctattccttgataccttgggttattataattggactagttgagctttatatatattggttcaactagatattagatgtgattgcttagccatgcttagaaacattagcacactattgggataacttatgattcattattatttaatgatggtttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtataacatgattcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcatcattgtaaaagatgctttaattggtaataatttgcttagctcctggtttggagttagatctgtacagccgggtatggttgttcaggatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcatttgcatatttgctgtgtggcttgctgagtatgtcatatgctcaccttgcaataatcaatcaacctcagt

SEQ ID NO: 34233 - DNA, 987 bp, Oryza sativa
  unsure (1)..(987): unsure at all n locations
gtggcnattgatgtcgattcacagtagcgcancacctaactaatagatagaatgaaaccgagatgccgtggtctttacgaatcctccttgaatggtttcttctggatctgttttctattaccagattgcgtacttttgtgtgccagggtcattagaacatcttacctaatactagcattacaaccgttgctggcgtggttagagcaattctatgacccatcttgaggaatgctcaaacatgtcactcattttgttttaggggtgcacatgatataaaacatgtgacgtgtggggatgtccacaatgaagttatactgctatcttaaatttttttttgcaaacactgtcacatggtccataataagcttacatgcgatactaacggtagtaaaatccaattaaaaatagattttgatactgattgccaagtataatatggtcgtgttcattgaaagccagagtagtagcatatacatgaaaaatatgattgttaattggtaattttagtgcttgccctgtccagtacatggcttaaaaaaatgtaggtcaatacgatttccaatttgaaaaacaaacaatccatattgttatgtatttgataagatttgcaccatctaacgaagatgggtgaattatttgagcaatttacaagatgactgactaaactgcacccacctcgtaagttgtgataccaacgctgcattttactcaggggattatcaaacccgattacagtattttagggtgcctctaatacccatctatacatatagatacgctgctagtataagataagaggatagaagaaaagatttttttacacgcttagtttcctaatgtgttcgatgtgggtaacaccgtaacaaccttaatactgtaggatcgcacaagaccaaacaaacctaccagaggggggagtgaatggtaagaaaaaccaaaaacccaaaatcttttgtggaattaaagattacccttgaacgaagtcga

SEQ ID NO: 34234 - DNA, 1501 bp, Oryza sativa
aagaaatgagagaagaccacaatctcgtgtgtatcgggggtcgaaaaaatctcaccacacgctggccgccacccgatgatctccttggcagggagaacgccgtgcgccaccatctccttcaggttctcttccgttacgtcggacggcgcccattggccttcaaagctttctttctcttccgccatcgattttccccgaatgcgctgatctgattcgagggatggcttgggagaggtaaggaattgaggcggtggatcacgggaaggattttgatcacttttcgaaggtggatttgagtggaatggtgaaccctagtttgccggcgcagttctttactgtagcagggagtggggaaaatggcgagagttccggcggggaagacgaagcgtcgcttggatctcgggacttcttgttaagggtatcggaggtgcaaatgggcctaggcctgaacagtacctcagcccaatacttttaacagcgtggcccattgtgttccttagggacttaggcatattttgctttggcaatattatgcgcacaatagtgttgcccaatgctgataaaatcctttttatgcggtcatataattctttggaattattgcaatgcaaattaaaaggtgcccgacagaaaggtgttatactgctttttgttagctttattaggctacaaaagctgtctgggttaatttggaatgacttgtttttatcatagtcacttccttggtatgctatatacctattttcattatggtaaatagtcatggcccaggctattagacttattcattaccataatttttataatacttggtgggtaatctttagagttttatattcggatgcctgtccagtgtgttcattcgtgaaccttttagagtgtaaaccactcggactcttttcattatggctaaaaagcagtcggctagcatgcctatctaggcgccgtgtatgcttttgtcatatgatgcacaattgtgttattattttgtttctcaactatatgtttagttcgttaactaatcacatagttgggggctacacctaattaggtgcatctattcgatgcaccatatttttatcttttcgccctttacagtcttcgtcttcgctactcggcaggccttggcatgataagttttgaagcactcggattattatctttgagaaggctctgatggttgactgcaaaggtctcgggggctactgtggagattatggatatcccatatctacacggcgatgatatttggactgaatataggataccgaatatagatagaatatcttatgtgtatcctgggtttgtttcttaacttgttcatcaaggaaacaccttgagacttagtcggtcacgactgtattttatctgtatttacatattccgttagggatatagattatcttttgtaacacggactctttcccatatataaggggggtccgggtgcctctaggggcggatgttggattttctccaaatcatacaatcaataacacac

SEQ ID NO: 34235 - DNA, 1501 bp, Oryza sativa
gtcgtgtcgtggtttcttcttgccttgcttacctacctgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgagtgtgttattgattgtatgatttggagaaaatccaacatccgcccctagaggcacccggaccccccttatatatgggaaagagtccgtgttacaaaagataatctatatccctaacggaatatgtaaatacagataaaatacagtcgtgaccgactaagtctcaaggtgtttccttgatgaacaagttaagaaacaaacccaggatacacataagatattctatctatattcggtatcctatattcagtccaaatatcatcgccgtgtagatatgggatatccataatctccacagtagcccccgagacctttgcagtcaaccatcagagccttctcaaagataataatccgagtgcttcaaaacttatcatgccaaggcctgccgagtagcgaagacgaagactgtaaagggcgaaaagataaaaatatggtgcatcgaatagatgcacctaattaggtgtagcccccaactatgtgattagttaacgaactaaacatatagttgagaaacaaaataataacacaattgtgcatcatatgacaaaagcatacacggcgcctagataggcatgctagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctgggccatgactatttaccataatgaaaataggtatatagcataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaggtactgttcaggcctaggcccatttgcacctccgatacccttaacaagaagtcccgagatccaagcgacgcttcgtcttccccgccggaactctcgccattttccccactccctgctacagtaaagaactgcgccggcaaactagggttcaccattccactcaaatccaccttcgaaaagtgatcaaaatccttcccgtgatccaccgcctcaattccttacctctcccaagccatccctcgaatcagatcagcgcattcggggaaaatcga

SEQ ID NO: 34236 - DNA, 1501 bp, Oryza sativa
gaatttgtctagcgaaaaattggcaaccttcgcacgtgcgcacaatcttgtcggcgtcggacactgcagtaggccagaaaaaaccctgccggtaagctttgccgacaatggtgcgtgcagcggcatggtttccgcatatcccagaatgtatgtcctgcagcaattgtctcccttcctctaaagatacgcagcgttgcagaattcctgaagggcttttcttgtataactcagcttcatgcataacataaagtttgctccgccttgaaatccgctcggcttcatctttgtcttgagggagttcttgagaagtcaaaaatcgtatgaggggttttcgccagtcggtttcaaccatagcgacgtcatgagtgcccgcaacttgagtggtatctttgtgaggtactgtcggcgtataaaggtgttcgacgaaaacatcagagggcgccacctcgcgcttggatccaaagttgacaagtctatcggcgtcttcattattatgtcgaagaacatgactgagctcgagtccatcgaacttatcttccaatttgcgtacctcttgtcgatatgccatcatgttgtcgtcaaggcaggaccactccttcataacttggttgacaaccagctgtgaatcgcctcgaactattagacgctttatccctagggaaattgcaatccgcagtccatgaaggagggcctcatattcggcgacgttgtgggacgccgaaaaatgtatccaaagcacgtagctcaatctttctccagttggggaaatcaaaaccactcctgctccagtgcccgaaagtcgtttagatccgtcaaaatgcatggtccagtgctccatgttctccgcgggggcatcctcctggcactcggtccattcggcgacaaaatcagctaacgcttgggacttgattgaaattcggggcttgaatgatatgtccaaagacatcaactccaaagcccacttagcaatacgtccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggtcgttggactttctggacatggccttcttcgtcgcgttcaacgaccaagactgtgctcacaacctgggaggtggctgatacatacagcaacaacggctcctgcgggtgtggtgaggctaagactggtggctcagtgaggagtttcttgaaatcttcgaaggccttctgtgcttcgggtccccactggaagttatctgttttcttcagcagcttaaagaagggcatccccctgtggagattatgggtaccccatacccacacggcatggttatccgactagttataggggataacttatatatatggaatatgtaacagatcatgacttgggtattacgtttcctt

SEQ ID NO: 34237 - DNA, 1501 bp, Oryza sativa
ttactaccactgacatcttccgttacttctgatgagcaatttcgtcttcatgttggtcatttcatctccatgccgactgcgtcagctattgccaatagacaattttgactatgacagaaagacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatatattttggagtatctcataagggataatcactcagatcagaagctattcatatgagctacacctggtctatatcacccggaagatttattactcgagagcatgttacatgcgtcatcctttaaagggtgtcgaaggcatattttttggtctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttacccggattttataccacatatgccatatatttccaggtgtggtggaaccatgtgtcttctagggacttaagcacatctgttaaagcagtgtgcgcatggcgtatgcccaatactttggaaatttctttattcacagcattcaagcttctttatagctattttgctatatcactcatcatgttttgcaaagcagttggtatatcactcggatcatgttatttggagaatcacaccgcatatgctatatattgatatcaagtcacttggttgattacgattatcaaaaccactcggttggttggattatttattccttgactacatgcttggtttgttcaattaaccacattgtcgggggctacacctattaggtgcatctagtcggtgcacctgactttatttccagccctccacagtcttcagatttggtaaaagtactcgggagaccatgacaaagatgattgaagcactcagctttggagtaatctggttcgagagaagattatcttttcgactgcgaaggtctcaggggctactgtggagattatgggtaccccatacccacacggcatggttatccgactagttataggggataacttatatatatggaatatgtaacagatcatgacttgggtattacgtttcctt

SEQ ID NO: 34238 - DNA, 1501 bp, Oryza sativa
  unsure (1)..(1501): unsure at all n locations
tatcatttataggattaattgcggtttctttgttttatttcttgttgattgcaggatcaaatcaactggcacgctcatacatccgaaggcgagttttggacctgcactggagttaagcagatctcccaggcctcgtgttttctgtcaatagtcgtctgcgccgtttatcttatttttccgctgcttagatctttattgattgagaggaactatctatctctgtaatgacattttattcgcttattaattagagtaataattgtactctattatcaatttgttattgtgtgcctcggctgattcctggacgagggttcgcacacatgtaagcgtttggaattttggatagaaattccgggcgtgacaagtttaggattaatagaatactcatatcaacaagttgcaacttcttttccagaagccgatctccaaagaactccagggttaagcgtgcttggcctggagcaatttgggatgggtgaccgaccggaaaattcttcccgggtacgcacgagtgaggacaaagtgtgtagaaaagacatgtgttggtctgtgagggcagtctatgacctatgaaagctgccagatgtaagcgggcccgcctgcctggggtagatcgacgggggcgtcgatctctcttaagggggtgaggatgtaacaacccggcctagggcttaataggattaatagaatgctcatattaacaagttgcaacttcttttccggaagccgatctccaaagaactccagggttaagcgtgcttggcttggagcaattggggatgggtgacggaccgganaattctccccggggcgcacggagtgaggatgtaagcgggcccggcctaggagaggcgggtcgttacaagaatctagctagtctagaagatatactatatggtacactattcgtattttttttggcacttattatgtctaataaaatattgaagaactagcgatgttatgataggtgcatccactcgcgtagagccatagaccagagagaggtgagagcaaggtccgcagtggcaactagtagaggcaaggcaacgtagctttgtgtttgtgagtgtattagagcagaggggaaggctttggaatgggggtaaaaacactaagacctatgggccttgggtggggcacgaagttttagctcctactaaaaaaaatgcattgctccattgcccagaccacagtttaaacaacagttaaatggtctatactcattttgctgttgtctaattgtgcagtctagataatctaggaccttctttgaccgactagacggtgaaacagtgtaattcatggtttaggccctaaactagatgataatccatcgtctagtgtctagacatggtccagacaatccagactacgctctatgcgaacactgttagggtgtaatttggatttttttccctttcaataatacttcttatatagccctttatgtagtttgacaagatacaggaggttttattattatctatactaatat

SEQ ID NO: 34239 - DNA, 183 bp, Oryza sativa
aaaagaagggttcaaaggttgaggagcagggagcgctttcaggaggtcgagcaagaaattggtatcggctgaggaaagcaaagccaaggaaggagtggcgtgttaagaatcaagttcttggagccgatgatattgcagccgacgaagcaaagaggttggcaaaagggaaaagtattttaacgg

SEQ ID NO: 34240 - DNA, 1501 bp, Oryza sativa
  unsure (1)..(1501): unsure at all n locations
tacttttatattttatattagtatagataataataaaacctcctgtatcttgtcaaactacataaagggctatataagaagtattattgaaagggaaaaaaatccaaattacaccctaacagtgttcgcatagagcgtagtctggattgtctggaccatgtctagacactagacgatggattatcatctagtttagggcctaaaccatgaattacactgtttcaccgtctagtcggtcaaagaaggtcctagattatctagactgcacaattagacaacagcaaaatgagtatagaccatttaactgttgtttaaactgtggtctgggcaatggagcaatgcattttttttagtaggagctaaaacttcgtgccccacccaaggcccataggtcttagtgtttttacccccattccaaagccttcccctctgctctaatacactcacaaacacaaagctacgttgccttgcctctactagttgccactgcggaccttgctctcacctctctctggtctatggctctacgcgagtggatgcacctatcataacatcgctagttcttcaatattttattagacataataagtgccaaaaaaaatacgaatagtgtaccatatagtatatcttctagactagctagattcttgtaacgacccgcctctcctaggccgggcccgcttacatcctcactccgtgcgccccggggagaattntccggtccgtcacccatccccaattgctccaagccaagcacgcttaaccctggagttctttggagatcggcttccggaaaagaagttgcaacttgttaatatgagcattctattaatcctattaagccctaggccgggttgttacatcctcacccccttaagagagatcgacgcccccgtcgatctaccccaggcaggcgggcccgcttacatctggcagctttcataggtcatagactgccctcacagaccaacacatgtcttttctacacactttgtcctcactcgtgcgtacccgggaagaattttccggtcggtcacccatcccaaattgctccaggccaagcacgcttaaccctggagttctttggagatcggcttctggaaaagaagttgcaacttgttgatatgagtattctattaatcctaaacttgtcacgcccggaatttctatccaaaattccaaacgcttacatgtgtgcgaaccctcgtccaggaatcagccgaggcacacaataacaaattgataatagagtacaattattactctaattaataagcgaataaaatgtcattacagagatagatagttcctctcaatcaataaagatctaagcagcggaaaaataagataaacggcgcagacgactattgacagaaaacacgaggcctgggagatctgcttaactccagtgcaggtccaaaactcgccttcggatgtatgagcgtgccagttgatttgatcctgcaatcaacaagaaataaaacaaagaaaccgcaattaa

SEQ ID NO: 34241 - DNA, 1501 bp, Oryza sativa; identical to SEQ ID NO: 23185

SEQ ID NO: 34242 - DNA, 1501 bp, Oryza sativa
gcatgctcctcctgtacttgctgtgttggtacaactatgatcttaatagcttttgtacaactggattgatcatgacgttttttgtatacgaagatctgtaaaatctctcgatcacttatttatgggatcatatatgcctctcgctacatagtacaattgtagcaaaggccaagattctattccattatctaagaaacattgtacaactgtacaagaagaaaacaaattgaaaacggtagtgctgttttgatgtttctaattgccagtgctaattatgaacttgagaattataagcatctctacgtgtgtatcattgtcttccattctttttttccccataaaaaaacatgaaaagaatatctggcattcattacataaaatggagagcacatgcgctataattattcctcttaacctgggtagtaggtaaatagcgttaataccaccaggccatttgcccatttacctttttcttttctctcgtgagctttcagctgctaggatcaaaaacatttgcccatttttgcccacttgcccactatatatattcagctgctaggataaaaaacatgagagatacactgaatggcatcaaacaaataattaataaggcctaatttgctgcccatttaccattcgtgattgaatcaatgccgcttatatatggattccttccttgagattagctgaattattgtgggattgggaggcaccaggatgttcactgcttagggtaccggcttgaggccgaagcggcaacagatatgtttcatgttgagctgctctgctgggatatgaaaggtaggtctattcagctgtgtgtgaccgtcctggcttgtgttgagctcggatgtgctcagcctggccagatctagtgttttggtgagctgtgagtacctttctagcaatctatgccgcaccacgcgatatgtttgtgcatgcgccttcactactccgtgccaatttactattttatagttcgtgtataaattagaataacctatattatcacatgtgtagttttaggccttgttcggttaatcactctccgacataactgaggggatttagatgggattaactgaggggagtttttcaatccttttctcataaagattaactgaataattaagccataaggagaaagggtcgtaaatcaatttgcattggcctccaatttgctctaccatagatgcagagataagcgggggatgataaattgccctatgtactatagtagctaggggttaaaactccaaggctaagctatttaatcatttataggatttgaggtgtttatacttcacatgaagaaactataactcgtacgcgagagagatattcatgtaaattcttaagagaatcatggctccggctgcctggtaataagactaaagttatagaactggcagataatgtgatcttatgatatgctgtttttgaaccctgtattagctttgattttttttattttttgaacttttttatttttttaatttta

SEQ ID NO: 34243 - DNA, 1501 bp, Oryza sativa; identical to SEQ ID NO: 23178

SEQ ID NO: 34244 - DNA, 224 bp, Oryza sativa
ataaggtagagagagggttgagggaggtggttgaggtacaagagataaagaaagagataaggtagagagagagggggagtggttaccagggaataaagggaaaaatgaagagggagaggaaaaatttaaagtgagtagagggaaaggagggaggaatatcccgtgcggttggattaggacgcccgcacggggaaatcgatttttccgtgcgggcgacacctagc

SEQ ID NO: 34245 - DNA, 1501 bp, Oryza sativa
ttatgtaaccctgtaaaagtcccctttcataagggcaactatgtaaattcctcagtacaacctagaccctagaagtaaaaatctgtaacggggctatcaatagccccctagggccatgtaatacaggggagaaaattcaagaaatcaatatacttcgtttctttccaaccactgttaagtaaccacgtctttcgacgtatgcggttgtcgtttcgataacagctggcgccgaccgtggggacctccgagcgaaaccactgagagcgaatgccaccgaagaaggtcgtgaaggagaaggttacaaggcgaaaggaaagcgacgccggggcggacatggccgccgaagaaggagcggaaccttcggcatcaatcgccgaagtgggaggagccccgtccgcttcggcaccggcaccgtctgcttcggcgctgatcacagcattgctgccttcggcccctgccacctctgagcaggcgccaagggtggatgaagtggcgaaggcggctgcagcggcaagggcgcttcagaccagggcggagatcctttcggcaggacagctgctggtgccccctgccgctccgtcgcagccaacagtggcccaagccgcactccctgccgtgcaagttcaagtcaactccgaccctgaaacacaagccgaagccgatatggaaactattaggcagaacatggcacgactccaagacatgcttcgccaaatgcaagaacagcaacaagcgtacgaggcggcgaggcggtccagggtcccttcggcaccaatcctccaatattcggcagggtatgtcccgcctcaagtctgtccacaagtgcagtcccagcccgttccgccgcaagtctcacaggcatcggtgcacttcgccgggcagccggcagccgcagcagtgcaccaggccccctatggacaagctcagcagatcgcggcccaagtgtagcctcaaccacttggccaggtgtcgcaaaccgtagcggaaggggcttcggctctgcaggcgcaattccaagctttccttcagcaactcaatcagccccacaacatttcgagtacagctccctcgactcgtccagaggggagtacaggtcaaggtgcacctagttggttgccgccgaaccagccgaatctgggggcttcgccatggagtcagacacctcagtacgacttcgtcaatgccgcccaggcgcaaactgttcggccgcaaggaccgacaccaggctttggaacaagccaagcaccagcccaagtcgccatgacatggtcgcagccagttttcgacccatccatggcgacccagcaagtattaccaatcgcaaccgggcagccgagcaccatggctcaaactcacgcgcaagccgtaatttcacctttcgccacgccgtacccgcagcaaggtgcagcaaacagagcggggggcgagaaggggctgccgctgagtgggggaattaagaaccgcccaattccaccccagttcaaattcccacccgtcccac

SEQ ID NO: 34246 - DNA, 1501 bp, Oryza sativa
agttgtattgatcgaaagatgtcctgcaatggccctaggtgtacatatttatacccgtaggccgttaagagtcctaatcggacactaaacacactttcctaaagaaaaaaaaggaaaattacaagtcctgatcgaatactagataaacacttcctaaagataaaaggaaaattattgaatcttgcctaactaatagatagaattaaactgtcatgccgtggtcttcacgattcctccttgaatggtttcttctggataagttttctatcagcagattgcgttcttttctcaaccaaatccactaaaatatcttaccaaattctagcattagtaccgtaacttgcgaggtaggtgcaatttaatcacccatcttgtagaatgctcaaacaagtcactcatcttgttttaggggtgcaaatgatataaaacatgtgtcgtgtggggatgtccacaatgaagttatatgctatcttaatttttttttttgcaaacacggtcacatggtccataataagctaacatgcaatactaacggtagtaaaatccaattaaaaatagattttgttactgattgccaagtataatatggtcgtgttcattgaaagccagagtagtagcatatacatgaaaaatatgattgttaatttgtagttttagtgcttgccctgtccagtacatggcttaaaaaaatgtaggtcaatacgatttccaatttgaaaaacaaacaatccatattgttatgtatttgataagatttgcaccattgtcacgcccggaaattcactagtaatttccaaactgatttgtgcataaaatcctcgtccaggaatcagccgaggtacacaaactgacaatttaatatacaaatccatcataataactaaaccgataaatacttacttaagaggcacttagtcctcaccaagaagaaaactgcagcggaaaaataaaatctagcgaagctccggctccactcccacaggcagctcaactggggtataagccaaacgtcttctccttctggatcctttttcttcaactgaggttgattgattattgcaagaatgagcatatgacatactcaacaagccacacagcaagtatgcaagtgcacaaggataccaaaggatggcataatataggctcatttgcgaaagcagcatttagcaaagagttaagagtagtaaaacagtagagtaattaatcagaaattttaatcaacactgaacaacacacccatgctgcacaggcccaaccatcctgaacaaccatacccggctgaacagatctaactccaaaccaggagctaagcaaattattaccaggtataacatccataattattgtgagagatgtgagactaatcacgaaaaacattgctcaactcgcccataaccgcgggcacggctattcgaatagttttactctggccagaggtgtaccactgtacccacaagacacgattccacacatgttgccatgccccgaaataccaccacgg

SEQ ID NO: 34247 - DNA, 1501 bp, Oryza sativa
gatgatcaacaaagagccgacgtcgatgtcagccgatgttgatagggttttgaacaatcggctatatatccaatgtatattctgatacttgagtaaacaatgatataaagacaatcgagtggtgataatgtgataagacaagaatataaatcagtagaaaccaatcggctaataatgatatgatggaataagtgttgatccgaaggttaaaacatacatcggctagaggtccgatgtcattaaatccaaaagattaaataattaataaaacatttgttgtcatcggctaaatccaacttatatgtaatccttgtgagccgatgcaaagcctagatagctcattgactaaaaccccgatgaaactcttattggcaatcaaaaaacaggctagacattatggttgtaaacatgacttagtaggccaaaaccaattgatgcagcaaagtatgaaaagaaacataatatctaaacaattaagcctttgactctttttaagggtgatagatacctttgctaatctagatcgatgaaacaataactaataccaacaaaaccctagaaaagatctggccaatacaggtaaattgaaacatcaacttaaattacctaaagtatatgataaataggtgttaatatcgacaagccaagagtattgagaccataaccccgccgatacaaacaaccataacaagccttacccctcatcgaagatcgaagccgatgtagcccaactcgaagcgagaactcgttgagaaagacaaataaaaagagtagcgatgcgccgaagttgtattgatcgaaagatgtcctgcaatggccctaggtgtacatatttatacccgtaggccgttaagagtcctaatcggacactaaacacactttcctaaagaaaaaaaaggaaaattacaagtcctgatcgaatactagataaacacttcctaaagataaaaggaaaattattgaatcttgcctaactaatagatagaattaaactgtcatgccgtggtcttcacgattcctccttgaatggtttcttctggataagttttctatcagcagattgcgttcttttctcaaccaaatccactaaaatatcttaccaaattctagcattagtaccgtaacttgcgaggtaggtgcaatttaatcacccatcttgtagaatgctcaaacaagtcactcatcttgttttaggggtgcaaatgatataaaacatgtgtcgtgtggggatgtccacaatgaagttatatgctatcttaatttttttttttgcaaacacggtcacatggtccataataagctaacatgcaatactaacggtagtaaaatccaattaaaaatagattttgttactgattgccaagtataatatggtcgtgttcattgaaagccagagtagtagcatatacatgaaaaatatgattgttaatttgtagttttagtgcttgccctgtccagtacatggcttaaaaaaatgtaggtcaatacgatttccaatttg

SEQ ID NO: 34248 - DNA, 1501 bp, Oryza sativa
cgctctcctcctcgatcgtggcgggcagccaggaagcgcgaccaccgcgcaaacgtcgtgcctcttccattcaccgcgccgcttgctttgctgattttatggcgactctcctcctcccagcgctgttgtgcgtagtagttgagggatcacgacctcctgtggttcgctccccattcacccagatcccttcgtttacacttcgatctccttcctctcacatctgtatatcattggcaataagcataaaagccatcgaatccgtttcctccgactatcaaatcgtcgcccatcttctcaaacttcccctccactttcatctccctcacatgtatgtatgtcggggcaccaggttgagtccagctgcacatcgcctactcctcttcgggctaaagaacgcacttttttttatcaagggtggcccttgctgtgcccagcgccatggaggtaagcaccaccaccgcctttctaatccatgaaggtaagcaccatcatcgtcaattttgcagcccaaatacagaacagaaggaggtcgctggcactgggcaaaattgctcaacttgccgattatccgattattcagagctgaaggagcacgccaatagcaggatgatgccttctgattcatcactatatctatgtgaccaggtctgaccgtctgaggcattgtccaactttcatatgtaatttttgcatactacaaatggattcagaattgaagacactattcctaacacaaaggtaaccatatcttccagcgtttaaacacttatttacatggatgcttctgttaagaaaaaaataccataggtacaaattcaattgctggttgattccaaaaatatatcatggaaaaaacattctcttccataaaattttcaggctgcaaaactgcaatgctaatcttctctttgtaactcatgacacatgaacaacctaccaacaacggttcttctcctcctagattgtaacccatgtgtttatcctccagatgtgttccctttcatattattgaccctttatatgaccatcatgttatcccttctcctaacacaaaagttgcactaccgcatctggaggatcctaacataaaacatcatgacactaacaaccaaatttagtatcctcatactattaattgccaattttgtttgatttatgaaaaaatatcctcatagacatagcactcttgaaacaacatagaagttttttaatcatattcaagttattacaatttatctgatttagctattacaatgttccgcagcaacgcagcggggtatcatcagtttatataaacacccttccccttcccactatctgccaggtacgaccgcacgagcataccaacgactagcaccgcttcctcttcctccttgttgcatctcgcccagtgcctattaggaatactttgccatatatgtacagattgtattgtattgtttctttccttgtattctcctctaattgaggatcctgtacatgtgcttcctatattaataca

SEQ ID NO: 34249 - DNA, 298 bp, Oryza sativa
cggtatgcaccatgttaacagggaaaggattaccatcaaccttcatcggctttttggaatcatcaaacttaatcttccctccttcaatggctacttgaatttgctgtctaaaaaccttgcaatcattagtagaatgagatctagaattatgccatttgcaatacctccttttgcctagttcctcagccgatggaattacatgaccagcggggagttgaatttgcttctcccggagtagcagatcaaaaatcttgtcagctttggtaatatcaaaatcatatttctcctcttttccaga

SEQ ID NO: 34250 - DNA, 552 bp, Oryza sativa
taaattattcatgaaatgcaattccatttattaaaaatacttccttggctcaaataaatcccagaaaaatctaggaactatagaatcaagtgaagtatttaataaaattttatctggcccacttttatattggaatttattatttaaaaattagatcttttcttctagacttttaaaatcatttataataattccaattaaacaacaatttatatatttaggattttttgggtgtgaaaattctagaccaagggtcacggtccgtctagcatttagcatctaggtgaacattgcccactaactattgtggtagtcagatttaccctctccccaaaactatacaatgctagacatttcctgtcaactcttcaaacctgacgagtattccccgaactcaatccaaaatgtttttgatctttggtgatacatacagggtagtccaggcagccaaaaacggcggggctcacctatcagtgcttcctttcctttcacctcctttcctttccctcgatccccattccccaatcgtacggaggtgggcaacagcctcca

SEQ ID NO: 34251 - DNA, 1501 bp, Oryza sativa
tacttgttcttgcttgttcttcgattgcttgcaggacgagtgcccttgtggccaggttgacgcgcaccacaagttcgcggtgaccattggagacggtgtatcggttgctaaggcgcagcgtctttggacggttgtagtcgggccgtgaatgtcatcttcatccaatcgagttatcccttacctctcatcgaaagatcgggccacaaaccctagcgggttcgcatcatgtggtattagagcgtggttcttcggtgagagaatttacccttcccttcgtcattaattttttttcctatagtccagaaaagaccaacaaaaaaaatagtagattagttttcccgtgatcctatagaccattgtgcctttttactagtactgcttagttaaggcttgttgagtttttgattgcatcggttgtgttaatttgctggtcttagtgttaggcgattagagtttcgagttcttgccaccaccgcacatcgccaccttcatcaattttgccatcatcaccaccgtcaccgccgtcgcagtcacccaccaaatcactttctatttgtgtttgatctgttgccgatagcttttgtgagttgccttgtatcctgccgccactagaaaggaaatagaaccctgattcgagtgaccttccttaaaacagtcatatttttctcatacggactcgaaattaggcttataatatatccacggacatctacaaaaaaagttacatccgattctcccccgctttgccgggttcggcaaatttaaaatcgccaaattccacttgcaaaattctgtttttgtggcgagaagcttcgggacctattcgcatagaactttgaaaaaattctataagcttcatactttgtccgtttgagacaagattttctgtggttggttccagtgtgctcctggttgtgaaaaaaatatcaataaaataaaataaaaataataaaaaaaaaagttgtctctcctcagcactagagagagcaagcaaaaaaaaaaggaagaagaggatccagcgagcacaccccaccattccccctttgtcaccaccttgcaccaccgtttcttgttttcgttgctgtttgggtttgtgttttgtggcgtcctttgtggttagactcgtgtctctacttcgactagcctaggaccagcactgtacactatacccttgagcgattattcaatttgctttggctaatgtggtttctagttttctcttgagcattgctttcagccaccaacagctccaccacaaacccgactacagcttgacaggtcttgttgctacagcaccgatacaccttgttccacggttgctaacttgtgggttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaacccatggcaggtc

SEQ ID NO: 34252 - DNA, 158 bp, Oryza sativa
aaaaagaaaggaaaggagaaatgtgggcccacactattttctctcacttacatgtgggccccacatatttatttaaatttttttgctgactaggatgcacgtcagcgaaacagggtggctatactgcctcgggaccttttttgacggttttacatagt

SEQ ID NO: 34253 - DNA, 593 bp, Oryza sativa
tcggaaaaaaaccaattatacagtttacatgtaaatcacgagaagaatcttttgagcctaattacatcatgatttgacaatgtggtgctacagtaaatatttgctaataatgaattaattagatttaataaatttgttttgcagtttacagacaaaatctataatttattttattattaatctacgttcgatttaatatgtgtccgtatactttaaaaaatattttggaccaggaactaaacaaagcataagagagattctggaacattccttgtggagtgttgcttgggctgtcgcggtcgggccggcccaggaaataccaggcgacgtggcggaggccacggccctgggcgccctatccgtgggccgataaggcgcgcgtgggcgcgcggccatacaaagccgcgtggccctccacctccgcacgggtcgctctcccctctcttcccccttcctccgcggttggtggtggctgcgccgctgcccgcatcatcaccacctcacctcacctcagctcgcgagctccgctctcaccaaccgcagcgcgcgacgaaggggattggattgggttgggttggattggagagagagaa

SEQ ID NO: 34254 - DNA, 208 bp, Oryza sativa
aaatgtgttccaaaataatgcaactcatatcttcttacctatcatcgatgaataaatcgggggagggctttcaatatcccatcaccgtacctactaatataactttcctattaatttggggcattttggctctttgtctcctttcttaactccaccataggaagctaaaatttgagtttttttggggagtatgttttttttccctaga

SEQ ID NO: 34255 - DNA, 1501 bp, Oryza sativa
gtagactactccatcccgcttgtcggcgtgcaccggcgatcgggagagcaggtctccggaacctctaccttcgacgtcctgcaccgggagaaggcggcaataaggtttttaggaagcgcttcgtgcgactgctccctgttcgtccacgacagcttgtattcctgttcgctcgcgtgctgcgtgctttcgtcaacgcccggaacggcgagtaattcctgctgagcaaccggtctttcagcaacctcagtaagtgctcaatatgttacgcatatttgatctattcatgttatattgtgttgtttacaagtgtagatctattgatgcgttcatgctagtttacatcttgttaacagtgaaatttggtaagctcggagtagtcatcggcttagagtcagcatcggcttcgaagtcctgagattagccgatgagagttgtcaagtcgtcagttgtcggattcttgcatcggtgttcgatctccggctaaggggtaagtccaatattccaccggcctaggcaattgtatcgtttacgtcggcgtcgttcaaggctgcatcagtacattcgacatgttggattgctctggtttggatgatatatttgcctacctatttatcatatgtctctgttaatctagtcttagcatatcaatttagctctatcggctgcttctcgttttagggtttctgccggtatcggctaaatcgcgttgctagattagattagcttcgacatctaccaccctgaaaattcagtcaacagcttgattgtctagatattatgtttcttttcatacttaatgttgcatcagttaagtttgatctactaagtcgtgcttagaaccataatctctagcctaattcttgattgccaataagggtttcatcggggtttcagccggtgagttatctggacgttgcatcggcttataaggattgcatatacatataagttggatttagccgatgacaacaaaggtttcactgtttaatctaatcttgtggatttcatgacatcagacctccagccgatgtgtgctttaaccttcggatctatgcttatttatcatatcattatttgccgattggtttatactggattatattgttattttattacatcatcatcagccaattgcctttatatcattatctacattggacatatagccgattgcttaaaccctatcgctatcggctggtatcggcatcggctattatcggctatcggcgggaactactccatcggcttgtcatccgatcggctgttttgatctactatttgcatatcttgtcagttgcaggatcaaactgactggcacgcccgcatctcatcaagatttagacctgcacaggagctaagcagatctcccaggccagtgtgttcgatttttttgtccaacacatatgcgatgtcgtgatttatttatgggataaattaaatcattatgtgcttataatttcaacaatccaaaaatcttattataggcactgtggttttacta

SEQ ID NO: 34256 - DNA, 422 bp, Oryza sativa
agaaacggggtgagagaagtggttaatctgtatcacttgggttccagcacgaagcttactgtggaatggaaatttattgaagaacgtgttcatgttaggatattgtttactgcaactctttgatttaagagtattcttttatttatgataccttgtagtcttgtggtgctagtacattttctttatgcaccaggaagtcatctcatgtgtttttaaatctgtcctggtttttgacttgtgcttccaccttctggtgccataggttgtggtgttatgaaccacacagtgcatcttaactgatgtattgttctgttgtgttaaatttgcttgattcttttgttgtcattgtatagttttttatgtacttattgctgtatattatcgtgacatatggcatactgaagtacaagtttatttttttc

SEQ ID NO: 34257 - DNA, 1501 bp, Oryza sativa; identical to SEQ ID NO: 31446

SEQ ID NO: 34258 - DNA, 1501 bp, Oryza sativa
gggagaacaccacacacccaatgggaggggtggccatgtattaatataggaagcacatgtacaggatcctcaattagaggagaatacaaggaaagaaacaatacaatacaatctgtacatatatggcaaagtattcctaataggcactgggcgagatgcaacaaggaggaagaggaagcggtgctagtcgttggtatgctcgtgcggtcgtacctggcagatagtgggaaggggaagggtgtttatataaactgatgataccccgctgcgttgctgcggaacattgtaatagctaaatcagataaattgtaataacttgaatatgattaaaaaacttctatgttgtttcaagagtgctatgtctatgaggatattttttcataaatcaaacaaaattggcaattaatagtatgaggatactaaatttggttgttagtgtcatgatgttttatgttaggatcctccagatgcggtagtgcaacttttgtgttaggagaagggataacatgatggtcatataaagggtcaataatatgaaagggaacacatctggaggataaacacatgggttacaatctaggaggagaagaaccgttgttggtaggttgttcatgtgtcatgagttacaaagagaagattagcattgcagttttgcagcctgaaaattttatggaagagaatgttttttccatgatatatttttggaatcaaccagcaattgaatttgtacctatggtatttttttcttaacagaagcatccatgtaaataagtgtttaaacgctggaagatatggttacctttgtgttaggaatagtgtcttcaattctgaatccatttgtagtatgcaaaaattacatatgaaagttggacaatgcctcagacggtcagacctggtcacatagatatagtgatgaatcagaaggcatcatcctgctattggcgtgctccttcagctctgaataatcggataatcggcaagttgagcaattttgcccagtgccagcgacctccttctgttctgtatttgggctgcaaaattgacgatgatggtgcttaccttcatggattagaaaggcggtggtggtgcttacctccatggcgctgggcacagcaagggccacccttgataaaaaaaagtgcgttctttagcccgaagaggagtaggcgatgtgcagctggactcaacctggtgccccgacatacatacatgtgagggagatgaaagtggaggggaagtttgagaagatgggcgacgatttgatagtcggaggaaacggattcgatggcttttatgcttattgccaatgatatacagatgtgagaggaaggagatcgaagtgtaaacgaagggatctgggtgaatggggagcgaaccacaggaggtcgtgatccctcaactactacgcacaacagcgctgggaggaggagagtcgccataaaatcagcaaagcaagcggcgcggtgaatggaagaggcacgacgtttgcgcggtggtcgcg

SEQ ID NO: 34259 - DNA, 1501 bp, Oryza sativa
attaacctattatggtttggtataatatttaagacatgtttagattgctactttcttaaaatttgataacagtaaaacctggtaaatataaaaatgatggtgaagtgaataagcacttacggtccatgatcatgtgcacttgaagtgacgtgatatttttatttaatatatgtgggctcaacaaaatatggatccacatgttaataataagattgtgacttcgaagtctgaggagcctaaccactattccgatggtagtaatatctgcttcaattagctttgcagcaatgactttcatatgtaacatctggttgggatgcaagtaaatagtcatttattattttcttttacgggaaaatagtagaagaggctcatactgtaaatatattaacatgagaggtttaattacatgagagtttatagagggaggaggtatgccctatacaaaattagccatttactaatttgcaaatataaaaggcatgccatatacaagatgagttgatgaacatgttatagatactaacttttttccttgtgtcatttaaccgttttatgaatattacgagcatcgtgataaaaagaacacgacacaactctaaagtctaaactgcaacaattcattaatatgtgaactttagtaatgatgacactacataaatagaaatgcctgcaaacatcgttatatgtaggttttttttctcaaaacaaggtagaatacaaaatctatcaaacaataaaacagagacactacttacatgtcttggaattttgtagtagttacgagaattcaaacaccactacaaagaccgaccaactccagcacccagcactacaaaagcatatagacgagtatttagtcaacaaacaattattatatcttctacacaagctagacaagaccataacacaatttaaattgttcgtttataacaatataaatgttactcacaatacacacttctcgtgttgtctatctttccctacttaaaaaaagacaagctatttatctatgaaaaaaggcacaaaactaacacatggttaatatgcattttgcatggatataattttttttatttatgtatctaaatttagtatcaccagaaccgatagaaaaaacggaagacgtgtagagaaaatgctactaataaaattatagataaggtttctttaagttgcaccacaaaacgatggaacatgtgactgctagaagtagagtgccaagatttgtgcagaattctgccaagaatttccccccgttggcacgggcctcccattaattgcaacccccgcactccaaaacggcaaacagccgggcagccagccagccatccggatctatcccaaaaacaaaacaacgcacacgcgcccgcacactatccgggccaccgcatcgagggggaaaaaaacgagagaggaaaaaaaaaagaaaaaaaacaaggggagaaaaaaaccctccccgtgttctccgatcggcggcgaggcgaggcgagggcggcgg

SEQ ID NO: 34260 - DNA, 350 bp, Oryza sativa
tgggatttgaaaaccgagttgcagatctccatcagcttattgccaatgatatacagatgtgagaggaaggagatcgaagtgtaaacgaagggatctgggtgaatggggagcgaaccacaggaggtcgtgatccctcaactactacgcacaacagcgctgggaggaggagagtcaccataaaatcagcaaagcaagcggcgcggtgaatggaagaggcacgacgtttgcgcggaggtcgcgcttactggctgcccgccacgatcgaagaggagagcgatgcgggagaggggagtcgatgcgcgtggggccggcgaagcagcgagatgccagagaggagaggtggggagcga

SEQ ID NO: 34261 - DNA, 1501 bp, Oryza sativa
gctgctgctgggtcgcggcatgtcagcgcgcgcctgagggcaggttgatttcgcgagcctatcgtgcgtccgcgtcatcgctggttcttttgcagggaggtcctcttctttatggctatcttgttatgcgtccccgccgtgcttttttgggctcaggaatatttgcgtttagtgtgatgcggaggagacagagatgggaaaaaggcccacgccacgccctggattgttgacagggaaaacgactcaaaaaccaacttaacttaaattcgtctctagtcagacggaagccactaacaagattcctatcgatagtagggacatgctgtacgttcttcagctgcacgatctttcccgaagtaaacttcagatctaccgtgccaacaccatgaacagaagcatgtgacccattctccattaggacggtggaaccctgtgcgacctgataagaagaaaataatgagatgtcagcacaaacatgtatattggccccagtattaacccaccagttaatagactgattaactgaaaaaacagtaggtaaataccatacccgctttcatctacagtgttgccaatagtcatatttgtagacttagaagtctgccctgcaggtgccttcatccccttgcgttgtggacacttcttcgccagatgaccaggtaggccacacacaaagcaagtcatcttatcctggttaggattgttgtttatattcttcttcttgaagttggtggtctgctgagctttgtattttcctttgctcttgttttgggccttgtgcacaacattggcactggactgcccaccatcgcccttagacgcggcatccttttcccgagctttctcctcaacatcaagagacgctatcaacccctcaacggagtattccagtatcttgtgtttgagtgcagtaccgaaacctctccaagatggaggtagtttcacaataatgcacccggctacaaatttgtcgggtaagacacacttaaggagttcgagttccttagccatagtctgtatctcatgagcctgctcaactacaaaaaggttgtcagccatcctttagtcatgaaactgatccatgatgtacagatcattgctagcatcagtagcaccgaatttagtattcagtgcatcctacaactccttagcgtcggtcatatgcatatacaccttgaccagacgatcgccaaggacgctaagaatgcatcccacaaagagagtagtagcctcatcgaattctttctactggtcagcagcaagaactaccataggtttgctagcactcatccataagcatttcatagttgtcagccacagagtgaccctgatctgccatctcttaaagtgcacaccggcgaatttatccgacctcaatgcatcggcaaaaccagccatagtaaaaccacagtgcctataataagatttttggattgttgaaattataagcacataatgatttaatttatcccataaataaatcacgacatcgcatatgtgt

SEQ ID NO: 34262 - DNA, 1501 bp, Oryza sativa
agtaacatttatattgttataaacgaacaatttaaattgtgttatggtcttgtctagcttgtgtagaagatataataattgtttgttgactaaatactcgtctatatgcttttgtagtgctgggtgctggagttggtcggtctttgtagtggtgtttgaattctcgtaactactacaaaattccaagacatgtaagtagtgtctctgttttattgtttgatagattttgtattctaccttgttttgagaaaaaaaacctacatataacgatgtttgcaggcatttctatttatgtagtgtcatcattactaaagttcacatattaatgaattgttgcagtttagactttagagttgtgtcgtgttctttttatcacgatgctcgtaatattcataaaacggttaaatgacacaaggaaaaaagttagtatctataacatgttcatcaactcatcttgtatatggcatgccttttatatttgcaaattagtaaatggctaattttgtatagggcatacctcctccctctataaactctcatgtaattaaacctctcatgttaatatatttacagtatgagcctcttctactattttcccgtaaaagaaaataataaatgactatttacttgcatcccaaccagatgttacatatgaaagtcattgctgcaaagctaattgaagcagatattactaccatcggaatagtggttaggctcctcagacttcgaagtcacaatcttattattaacatgtggatccatattttgttgagcccacatatattaaataaaaatatcacgtcacttcaagtgcacatgatcatggaccgtaagtgcttattcacttcaccatcatttttatatttaccaggttttactgttatcaaattttaagaaagtagcaatctaaacatgtcttaaatattataccaaaccataataggttaatttttgttgtatttaatgaacacaccctaagaacccacggtcctcaattggctacttcctccgtttcacaataagtcattctagcatttctcatatttatattgatgttaattaatctagacattcattaatatcaatataaatgtggaaaatgctagaataacttacagtgtgaaagaaacggagggagtagttggcttcatcgcacaaggcgtccaggcgatgaagcccgctaacgtcgtttgcaatattgggccaggcccaaaacgcaacaagcacggagtggacgggctccttgtgtagtaggccaacaccttgggctccttacacgaggaacggctggcccagcgaaggtacgggttgcgttagcgtggcaacaaacacaacaccggacgtggccacgtgggaggattcatggatcatcacgaataacccccctccatcctcccgaaaattacagatagcaccatgcggttgaatttcgtccaaaaattcctgtcttgttatactacctgaagaaatagatgctaagaacaagggtgtaactgaaaaa

SEQ ID NO: 34263 - DNA, 156 bp, Oryza sativa
cccacagctcccttctacctccgtctctccgccgcctcgctcccttctcccacggtctctgcttcttcgtcccttcttcactgtcaccagctaccgttgcgatcactgccaatgccaccactgtcgtcggcttccgtcgccaccaccgctgctagc

SEQ ID NO: 34264 - DNA, 347 bp, Oryza sativa
tggcattgttatgatgtgatgctttgtacagataagcgtccgccctgtagtattggatttggtttcttgctgcgcggcataaacgaggattttgaccaagagtattatatttgaactgtattagatttggtttcttgctgtgcggcatcacgaggattttgatcaagagtagttagcacttaccaggctgatatattgttgtctatggaattatcaatggttcttggatttattttctttctgtgcaacaacaacaaggttgccaaagaatatttatctagtatgaaattctgaactagtggtacttatgcttgtcatgccaataactgtgaggctaccgttattct

SEQ ID NO: 34265 - DNA, 954 bp, Oryza sativa
cattcactgcagattagtgctggtgccaaaacgtgaggttactgcgagtgcagcaaaaggatgtaccgtggatttctcgtacattttgcttgaatgattttttactgaattacagggcctgaaaaaggtgaaaggtactgaaataacagcccagcggcaaaatcattgcacatgggtaaagaagcaaatcttccagtgagctgcctggatctcatcgacctgagtaggtcagatcctttatttatgtagtctagtgtcgtatgagattggcaagacaatgttttcacacggtgttgaacgagtgtacgtatgttggagacaaccagatgatgagttgatgatggaaaagaacggacgaatttggtatagtataccacaatttgaagatgcatctgggttgtcaccgaaacttgatagaaaatttattgagacggttcatttagttatggttcttgggcgaagaatggagccaaacagttcggattctttaatgattaaaactcaggtccacacattaaggcgataatttcaataattaaccccatacatcaaatttttttagctcggctattgcatttctagaagacatcacggtaaatttaacctggcacataattcacctccataaaactgaaaaaaggttcattattcccataactatttcatcaaacaacaaccttcatgctttcttcatactagcaggacggatcacacaatgcagcctcctcgattaggacttgtcggttaatttttcatgagggtattggatagaatcgaggggaatcaattccacaactattaaggtgtgaaatcaattccttctaatcacgctgaatccatgcataggaattagccgaacatgccagtttatatttcctttgtctaatatagaaggaacattattaacaactcaaactatttgtcaacttcaggtaggagtggaggtagatttta

SEQ ID NO: 34266 - DNA, 153 bp, Oryza sativa
atcctttgagtacacaattgagatgtttgtttgtatttcaagggatgatcctggtgcgagagctaggagcagtcctattagggctgatgcaagtttaacaaaagtggatggcaacaatggtgctgatactgcagaggctggtatatctagagc

SEQ ID NO: 34267 - DNA, 1012 bp, Oryza sativa
caaagcaatgtgggggtcttgggatacagaacctagaactacaaaacaaatgcatgttaagcaaatggttatataacttttgaaatgaagagagagtttggcaaaacttgttaagaaggaaatacctatctaagaaaactttgactcatgtagagaaaaaccaagggattctcatttctggtcaggactcatgatggttaagaacatctccctttcttgtggatcattaaaagtgcacaatgggactcaggtcagattctaggaggataaatggaacgggaatactccctttgctgctcgttacctggccttatacaaccttgtgataaacaagaatgaatcagtggcagtggttatgagtaaaagacctctaaaagtgtcctttaggagggctattgtgggtcatatttaaaagcttggttggaagtggtctcaaaggttatatcaataaaattgaccgagcagaatggtacctttttgtgggagatacaaaagaatgggcgtttctcagttaactcaatgtacaaagcaatcatgtacagggaagtcgttcctaaaaaggacatgatttggaaactcagaataccactaaaaattaaaattttcttgtggtacttaaagaatggagtaattttaacaaaggataatttagccaaaaggaagtggaaaggtaatgttaagtgttgtttttgtgattctaacgaatcaattcaacaccttttcttagattgtattttagcaagattcatgtggaatgcagtctatatatcttttggaattcacccgtctaggaatgttgctagtatgttcggcaattggctaaagggggtttaacccaagctaagagctcaaatccttgtggggatttcagctttgtgttgggcggtttggttatgccggaataatgtagtctttaatggctccaatactaattttctgttgcaggtgattttcagggggactttttgggcaagacaatggtctttgctacttaagcaagaacatggccaaa

SEQ ID NO: 34268 - DNA, 1501 bp, Oryza sativa; identical to SEQ ID NO: 31444

SEQ ID NO: 34269 - DNA, 266 bp, Oryza sativa
tgataagcggaaacagtttataaaacaaagcttcctaggctttgcaacacccagtgcaaatttccaactctactgacagtggcggatctaacatgggacattgggggttcagttgaaccccccaaaccttcttaggaaccatcaaacagttactagtattaaggttaaggcaaatttctagagcagaagctagggttaacgcaaattcgagaaaaaaagtgcgtgggtagagagagagagatgggaaagaggatgtgcgtaacgga

SEQ ID NO: 34270 - DNA, 1501 bp, Oryza sativa; identical to SEQ ID NO: 31443

SEQ ID NO: 34271 - DNA, 276 bp, Oryza sativa
ttcgtgaaattgttattctcttcccctttttacgacttaaatcaacctaacgctcttaattcggacatgagctctgccagctacctcatgtgctagagctctgcaattcagccctaagcctaagccagaaagatcattttggtttttaagcatagtaagttagtaacacaaaagtcacacatacaagtcgacttcctttaaacaggaagcaataagcaaacttaacatttcgcatactgcatgctaatttcttttagtaagacacaaggaaaaaga

SEQ ID NO: 34272 - DNA, 1501 bp, Oryza sativa
gaatcatatattgaccattggaatttttcccccatgtgggattgtgggcactcctacttccatattggcttataactgatcgcattcttctttagttaggatgcaaattcatttttcctgaaacaatgttgtggtgcacgcatatatgttgtactcataattaattatgtgattacctgtccatatagccattgtttctctccatcagcttgataaaaaaaataaacttattttccatgctgttgcaatcaaactttgtagtcattcttccataatcatgaatccttgttaacctgtttacagtgataattatgtgcatcttgcagaactgtgcatattggagatttccgatatttgtaataacgaccatctgattaaaattcatttatttctttactaatttctcattcctggttatataagcaattacattgtgagtttttttctgtgtatatgggcataggtagcttactttcaactacagagattgagcagatcaatgatgggtttgcattctattgctgtcccaaaaggtttctgatgcacatcgtggtgttacagttgtcttaatttccaagttcttaatgtatgggacaaactgaaaagtgatctgtgcccatgccagatcctaacaggtgacaaatgaagtgcagtgttaaagttgcaatgccatttcaataaaaacattcatcttcgattttctgattggggctcacgttgtgcccacctccatcctcctggctgctagcacccagccattgagttcctgctggacaactgtgggtgaagcggcaaaatgcctcacgaaggccagcggcggctggagattgacgatgaagaagcggtcattggaatttctcttctccatagccacttagcctctcctttcaagataactttgtaagcttgatgcccctctaataatagcttaggatttttggaggcattgatagctgcaatcagtgctcatgtcatcattcaatgacctgtaacaatttcaaaagcattatgttgggcaccagatgaacccaggcagatgttctttggatcggtttttgtacacaaggttctatctgcaggaaatttaacaaaaaaaaaaactggccgtgcatcttactatattcgctatgcaatggagtttatggtgaaagttcagttgctttttgttctatgtaatatcctcgaattatagtctgaaaccaacttcttaatataatgagcaaagctccaacctttacttcagaaaaagagaaaaagtcaccttctcctaacttacccactgtgttgttttttccattcacatgcgtttgcagcttggcaactagaggagctgatttctagattgatctctcttattttccaacaatgagcatttgttacaggcaatgagcttgtacagcaaaaaaaaggctcaaatatgaaaccatctgttacagcttatatgtgtatacattgaattagcaagtacaacaaagaaggctcaaatttcccttttgacagt

SEQ ID NO: 34273 - DNA, 361 bp, Oryza sativa
  unsure (1)..(361): unsure at all n locations
atgaactgcctatcgtttgacagnngctncataaatggagagttttgcatcctagtgaagtgtgtacaaagcaaggagcatctctctcatacagtactgctcagcatgctagttcaaggtggctgctgcaatttttgttctgtcatgtgaggttttatcttacgttcataatgtaaagtccctttctgagattggtgagctgtgcaatatgtaactttcttggattccatccattgcacaggggctagtaaaagtaaatcatagactggatatctggtcaatcagttgtttctggctatatcactatttgcttatgtagttaactttgttggtttagttatcaatccaaataatacttgtc

SEQ ID NO: 34274 - DNA, 477 bp, Oryza sativa
tcctcccgggccaagtggcccgcagccgagccgccgctcgcgcgtggggtccgcccgctgacaggtggggcccacctgtcaaggcagtcgtcttccttgcgccgtcgcctggccgaaccctagcggagccgcgccgccgtctccttccaaaatcggccgcgcctttccttttccggtgaaatcaatagaggggaaatgatccccgggatcccctctatcttttctcttttggaatcgtcggctaaaatcgtttggaaagcggtggattcgatctcgaatcggattcctctctctctctcgaaccctaacctttcctttccgtcgccggttgccttgggcctccatcgctgcccctagccactataaaaagacccccgggacctcctctatccgtcgccaccctcgccttagctcgccgccgcctgtagcgccctagcctcgtgagccgtgcgccgccgttgccgccgcttgtctagc

SEQ ID NO: 34275 - DNA, 330 bp, Oryza sativa
atatatatatatatatatagtatgcaatattatatattagataagatcagctgaaactccgatactatccctaattatgattaattacaggttagtttttagggttctagacaagactagggttgatgcatctcaaagtatgtaaagaaacctaaagtccaaacaatcaagtaattaactaattttcaggatggtagattccttagctaacctaatctagcgaggtaatttagccaataccagtataaacctaaagcgagtctcagccgatactaaatcgagatactagactagattaagtaagatatatgataaactatgctacaaaaa

SEQ ID NO: 34276 - DNA, 1501 bp, Oryza sativa
gaaattcgtaataaaaaataaagactattgaaaaagagaccatatagaacacatgacaagattaattaaaattcgaaataaaaaataaaataaattccaaaaatagaaaaataactataagagtccaagtaggaatacaattttttaaaaatatcatggtgaaagatgtggaattttttttttaaaaaagtccatctcgaacacaacaatgacaaatgaggggagaagcaatagggctgtaaaggagtagagtggtggcggttgatgggacatctaaagttataagaaaaaccccaaatagaatctcaacgacgattaagaggagggataattggtaggccattaacagcacagtcacagtggttgacgggtcttatagaaagtaaaaaataaaccttaatgataatcataaatctcaatgacaatagatagggggaggttgtgggcccgcccgtaaaaggagtacagtgggtaaagtcgctgacagtttgacgggacttttagaaaataaaaaatgaacccaaatgatagttatagttatgttcgatttttaaaaccccggtgacaataaagagaggacgcaacgggcgggccgtagaggagtactgttatggtgtttgacggaatttttaataattataaaaatgacaaccaatgagacaatgaactctaaaaactacaaggtccaatttttaaaggtttcaaggaggatgaataaaaacagtggtagatcgacaaataaataaaggggtgacaatggaacaagcggtagcgattggcgtgagttataaaaatataaaattagaaacaattggatgataaagttcagtctttcaaagtactaagataacgagttatctatttaacaaaatttaagtaaaatcatatatagaaagtagataattttgtatgggttgctagccgcgcaattgcgcgggccacccaactagctatattattaagctagcatgaaaagtaagcatcacattctctctagaggctagaagttcacacattaattggatataaaaagagaaacgagagtttaagtagtaagacaatttactaacaaaaattagttcatatagaacacaatacgaggttaattacaattaaaattttatgctagaataatttaataattctgcatcgtaacataattttgcttcgatgctagccatacatttgcacggaccaccttgctatgctagttgaatgaagcctgtagcaaaactctagtaattatgtatgtgcgccatttgggaaacaaaaagaggttaagtgttgtcaacgtctcaacgacaaagaagagatcatgcgcctagctacaggacatgcatggacagacacaccgtccagaggttagcgatggcgcgaggaaatgcaaacgctaaaattggcgcgccttaacatagcagttggcggcaccatatattctcctactcctcccagatcatcccaccagtggctaagagaggaagaaggagagaaacatctagag

SEQ ID NO: 34277 - DNA, 1408 bp, Oryza sativa
catatatatttatgtccatggatcataccaaatgagatcgatgcatgtctctatcatcaatacatgttgtgtagatgcatgcatacgttggggaggatcttgcagatgtatttcttggcacaggtgttcttgctccagacggcggcgccctggccgtcgatcttgcccttgccgctgaattcgaggttatcgacgcgcttgatctccatccagttcaccttgaacaaggcgaggtcggtggagccgagcaggttgccgtcgagctggatgacgatgtcacccttacatggcccggtgaagttgaagggacccgtcacgaagtcgcccttggggaagacgatcgtctgcttgccggtgccagcgcacgccgccttccacgcctcgtcgaccgccttggtgctgtccgtctttccgtcgcccttgccgcccagcttcatgtgagatgattcaagatgaaaggaattttcgcaacttttgttatgactcttgggaatttgttttcaaaataaaattgttttaaaagctcaatcctccaattgatttcattttatacccaccaaggccatatgcaagtgtacctttgataaaccttattatgcatataactgcttaacattatattgagctttgtcaaatttatatgactcgtgttagatatctttcatactcacatgatcaaggggtcatttccattttaatttttttccacatatataattaagctaagcttctacactgaaagttggctttccacaaaagttccattcaaataactcctacattagactatgctttcttctcctagaaaaaaattcttggcaaaaagagaaataaaaaaaaaggaggaaaggcatggctataaaaaaaagagagagggaaataaagcttgcgcccaaaacattgagcaaagttggaaagaaaatatagccatgcctcttccatattcatgccaagagaacaaaatagaggagaaagtataggaaaaggggagaatcatttctttattccaccattccacaaaatattttttttcctttcccattttctaccacaaataaagacccttgatctaggagtatgactgatgatcttcttgagtcaatatttttggctttgcaatatatatgatgtaggtatgtcaccatttatccctaccaagctccacatttcagccttagaataggggtaaattctggaacactttgccttggtaaggatccaaaaagaaaatatatatccttgagagaaagtcaatatgaggaaaagagcttgtttgcgaaaatttataaaaatctcatgagtctgacagagaagcaaaaaggactggaatcgagattgttccatctatcaattactcaagatggtaagatagccactgataaagttcataagtacggatatggttgtg

SEQ ID NO: 34278 - DNA, 1501 bp, Oryza sativa
aattcttccgacttcttctactctactctcttcctattctagtatacaatatagtacaatagagcctcttataattcagctcaagcttggaagtgtgtaagtgaagtgagggagtgatgtctttatatagcggtaggtatgacggttggcgaaggggaaatgtccaaagtgccctccaaccgccatcagggagtgatctggagcatccatgccaaaacctgggatcaacggtgatcaccagggttcggccgaaccagggctaagcccatctggcctagcctttggcccatgtcctcccccgatcctcctatgtttatttctcaggatttttgtttgattctcgggtattttgacaaagttcacaacccatccttgcatggatacatatttctcctcactttagtctagatttcctcccaacatcgggttttatccctgcatacaaatatacaccaacacttgtagaaaacgtgagattaagcacctattactatgttggatgttttattatctgaaatttatgcagatgttggcggtataaaatcgacatttaacagccgccaacaaaaccccccacacttagccctttgcttgtccctgagtaaaggttagtgtagaatgaattccttcaagatatgaaccaagcatataaaccattcacaaccatatccgtacttatgaactttatcagtggctatcttaccatcttgagtaattgatagatggaacaatctcgattccagtcctttttgcttctctgtcagactcatgagatttttataaattttcgcaaacaagctcttttcctcatattgactttctctcaaggatatatattttctttttggatccttaccaaggcaaagtgttccagaatttacccctattctaaggctgaaatgtggagcttggtagggataaatggtgacatacctacatcatatatattgcaaagccaaaaatattgactcaagaagatcatcagtcatactcctagatcaagggtctttatttgtggtagaaaatgggaaaggaaaaaaaatattttgtggaatggtggaataaagaaatgattctccccttttcctatactttctcctctattttgttctcttggcatgaatatggaagaggcatggctatattttctttccaactttgctcaatgttttgggcgcaagctttatttccctctctcttttttttatagccatgcctttcctcctttttttttatttctctttttgccaagaatttttttctaggagaagaaagcatagtctaatgtaggagttatttgaatggaacttttgtggaaagccaactttcagtgtagaagcttagcttaattatatatgtggaaaaaaattaaaatggaaatgaccccttgatcatgtgagtatgaaagatatctaacacgagtcatataaatttgacaaagctcaatataatgttaagcagttatatgcataataaggtttatcaaaggtacacttgcata

SEQ ID NO: 34279 - DNA, 1501 bp, Oryza sativa
tgatctattctcttcatgctggtcgcatagaacacagcggatggggtgggggagcccccaacggagtagacgatcagcaatccatcatctattcatcatattttcagttcatatagatgcatgaaccccaagagatgtactttgagtgcggagcaaatttgtttagagccagaaagcataataatgccagcaaagcactgctgttaaacaaaagtctgccatttaatttaccattttttcacatgtgttgatctaattaaaaactgcgttaattcctttaactgagcatgaaactctattactgaaatgtgtgcactgaccaagtaaccatgaagaaatgaaatgctcaatttagtaattgctatgggatatgtttattcttatggctaaataaaatataccagtctcctaaatttttagatgtatcaaatctacatgatgaaaggttaaatcaatattagcattgttagaatctgcaaatgttcagactacgcatcttctgaaatgtagcagttaacaactactccctccgtcccaaaaaaaagacaaaccctgggtttccgtgtccaacgtttgaccgtccgtcttatttgaaaaaattatgaaaaaaattaaaaggataagtcacgcataaagtattaatcatgttttatcatctaacaacaatgaaaatactaattataaaaaaatttcatataagacggacagtcaaacgttggacacgtagatccagggtttgtttttttaggacggatggagtataatagttgggatgtagaagcccaaattgaactagctaatcaaatcaatcttgatcaatcatgtaatcccgcacaatgctaggaagaagcaagccgtggagaaattgggagaagctgccgttgtgcaggaagtctaaggttatatttagtaaagctccaactactaaacccagctccaccctacagtttattttgtaagagagtttcactcagctccattcctattttagataaaactgactctacatatcgtaagacgagcagcttaattgccgctattgggaccgactggccgaggacccgcgcgaggtaataggccctcagcggcagcaggttggggtggcgtatctcgcagctcgatcgccatggaggcatcgatgcctatctgcacaccctgcaactggtgaacatataattaaccatgcatatataatactagtacatagcatttggccatttgcaaatgcaatcagcaagagacaattagcttgatcatttatgtatgtcttaatgaaaatgcttattgataatttgagtgcaagaaagcagcagcattatgatcaagagatctgagcctatgagccgagacgggcttggtagccgagtcgcgagcgaggctcatacgtgtcctatttgcaatgggcctggagccaaaacgagcgagacgtactccaatgacaagattgattaacttgaggtatattacttcacaatcatatagatttaaattcgagttacaa

SEQ ID NO: 34280 - DNA, 630 bp, Oryza sativa
ggccctctctgtttcgatcttgcaaggaataggccaaagacagtgaaggacctgcaaggaataggaaagttttgtaagaggagaagaagatgagttgagggtgcaagcagaagaagctgcattgttgggaaagtagcagacgaagaacaagcaagtttctttaggagaagaacaaaaagcagaaaacactgcaaaaccatggaaaaattcgattataagtaagatcagaaaaaacaagtgaacttcattggagatggctcaaataatggagaaggaaaagggaaaagacaatgagaaaacactcgtggaggaagaaataactgggggcaatctggaagaggccgaggacaatggtggaattctggcagaggtagaggatgatggttgaataatgatagaagcggaggaaaagagtatcagcctaatcatagcaagttttgtcaagcacatggtctaggtggtcattctacggaagaatgctatagcaagttttgccaaatccatggtctatgaggccattccactgaagaatgtaagcacatggcttacttagtggaaaagcatgtcggtcgatatgagaacaagcattagggggcttgagatcagcgagggaaaaatgccatagaagca

SEQ ID NO: 34281 - DNA, 1161 bp, Oryza sativa
ttgtagtaacacttatacttttatacagtaacaactatatggttagcatgtgaggctttaacccatatatttttgctttaattcctagtttaacaagtgagatatagtctagtggttgttcttatgttgatttagttgaaggtcttgtgttcaaatcctattgattgcaaatttttattttattttttcactctaaaagaatagtcttatatatatatatatatatatatatatatatatatatatatatatatatatatattaaaaaatgccctgtctaacaatttaggaagcgtgcacgcaggacctttcgacgacaaagagacagcgtgagtgcaattcggagagacggcggcagtggcgcttgcgtgagtgcaattcggagagacggcggcagtggcgcttcaggcagccgcacgttgctggaggggcaaggcggagggatggcagcgtgatctctttgaaacaaggggcgcttccggttgtgtgcgtgcttcaaacaactttgtcttctccatattaccacatctatagagtctaattttctatgaggaactactgagttcaaatgcgaagacggtataataatacgctatgatgacaatgcaacggatatcattagtaaaaaggaaatccaaatggaacttgcgtttttggcgcgatcgtcgagtaattgagagaattgaattttactaaaatagtttctagcttatgaagtattaactgtcaaaagggaaatttgagccttctttgttgtacttgctaattcaatgtatacacatataagctgtaacagatggtttcatatttgagccttttttttgctgtacaagctcattgcctgtaacaaatgctcattgttggaaaataagagagatcaatctagaaatcagctcctctagttgccaagctgcaaacgcatgtgaatggaaaaaacaacacagtgggtaagttaggagaaggtgactttttctctttttctgaagtaaaggttggagctttgctcattatattaagaagttggtttcagactataattcgaggatattacatagaacaaaaagcaactgaactttcaccataaactccattgcatagcgaatatagtaagatgcacggccagtttttttttttgttaaatttcctgcagatagaaccttg

SEQ ID NO: 34282 - DNA, 304 bp, Oryza sativa
cattgtactaggaaatgttccatctaatagtaggttggttttttttgggacggagggagcagttgttaactcgctcaatgtttgccgttgtgctagtgatatgagccagtgactgtggcttactatgtgcggtgccagagccatacatcattgtcctagccagcagctggctagggctagctccttgcttgaaccagccccatgtgtaaacctacgttcggcgccactgatctccaccaatgtttttgtcagggttacgggtaaagtataccctcgaccattcgatatacgtcacgtatcgata

SEQ ID NO: 34283 - DNA, 1501 bp, Oryza sativa
aagaagcgacggtggccgtggatggcctcgctgggaagcgacgacggcgagtgacgcgagctgcgtgcccgaggtcgagatgaaaggggaacggcggcgccgtcgcaggccatgacgcggtggagagaatgggggattttaactatttgccactcgtaagccactcgtatgatttgccactagttccatatgttataacacatgagaatccacatgttatagatacgatgtggcaaatcgttaattactatgtcacaagagtgacaaatacttaaatttcccggagagaatggggaatcagcgggttcacagcgccccatttttttcctcctctgcctgtcgtgagcgattgggtggtgggctcaattggcctggcccgatacaatgcaaacacgtggctgggaaagagattggacgcgactgattttggggcgacgtggccgcgtggacgaatgaacagtgtacatcaggattggaatggttaggatatggattgaacctaaaccgttttaagtgagttcgttgatccatggtttaatagggtcgatctactataagtctattatattaataggttatccatagatatccaaatggatcggctactcttattacatgtgggtaaaactcggatccaaaatttttaaactcgcgttcacactataaaaacttatcgaattcagtgtacaatgtactgtacactgtgtacaatacccatcggcaagtttatactccctccgtcccaaaatataagcattcttagttatgaatctggatacttctgcagattcatagctaaaaatagctatgaatcttacttgtgtgttcagatttatagctaaaaatagctatattttaggatggaggtagtacgattttatatgatactagttacatgcccgcgcgttgcgatgggaaatgctatgcattaatttcatattacaccggatgaaaagatgttaaataatcattgagtgaaaattatctcgagagattacaactgaatgttacttttttaaatcaaggatagaaactgaatttatatgatcaaatacagtccattagttaaagacataaatgaatgagtaaatttatggacaatcatttagtgttaagtgctgaaagtaatcacttaaaagcttcggaactctcaatacactgagttgccttttgcatacataaatagtgatatataagatacatgaatgattcaccactcatcaggtaacataccaagttaatcctctaattttagtttctattgctgtcctctaattaaacgtgtaaaacttcaaaagtgacaacaatgttcacccctgacattaatgcagctaaaattagaggatcctagtcctggtgataggttccataggaaggctcaatagaattgccattaatatcttcaattctcagatcctttattctccaatctgcattaagatgaacaaaacaatcatcttttcactattcaaaatttctgctagtagactttttaacaaga

SEQ ID NO: 34284 - DNA, 1501 bp, Oryza sativa
ttcctatagtaattggaaattctatgctaccaaaacttggtagcgccaacagttgcaaggtaattttgttaggccaaaaattttgaacctaacaaacccttacctcttttttacctctcttaccattagactttctccatgattgctcgtcttaagtccaacatgcattcgaggatgcactggtttgggcctatttgacctaatatttagccatggaagcctcgataattagtacgaaaatgcaagaggtaaagcgctgattgccatcactagaggagaggggaaggggacatatggtggtacgcatggatgtgggacctgtgggtacggggcaaggggtaaacaccaatggagtgttccatgcaagctaaaggagtgcggcggccttgacattcagaatctagaattacagagcaagtgtttgctaagaaaacggttatttaggttatgtcatgaaggaggagtatggcaagatcttctactgaaaaaattatgcccacgggctcacttgtcaatctctctttctctggctcgccggcatctctctttctctggctcgccggctggaacacgccgtcctcgccgagccaccgctccggcctgtactccaagcagtcctcgctcgatggcgtatgcgctgtacgtcacggaccaaccggcgcggacgagcgtgccgtcggggagtgtgtcgtccgccgcgcacgactgacgccggcgggtacaaccgcatcgactccgtgagtgcggcatggaggtagtgcatctcccagagcgcatcgaaccgaaacggctcgccgaggcgtgtgtcggtcggcttcctcaccgcgcggacctcgtcggcgatgcgcgccacgacgtccggccgggacgacaagagacagaagaaccagctcagccccgacgccgtcgtgtcacggccgacgatgaggaagctgaggacgatgtcgcggaggacctcgtcactgtgctcgtcactcgccacaaacctcgacaggacgtcgtctctgtcttgcacggacgcgctctggcgccgggcgcggacgatgtccatggcgaaggtgtggacgtcggcgatggccttcctcagacggcgtatggtgccgacgttgagccacttcttgatcttccaggagacctcgatgagatcaaagaagcgtccgacgacaaggttctgcgcctcgccgaaggagtgcatgaaatccgacctggcatcctccatgaccccgccgtcggcgaggcagggcaggtcgtgcccgaacgccaccatacagatggtatgaaacccgaatcgctggagcacgtcctgcaagtcgaggacgtcaacatcatcgctatcgctcgtcgacggcgactttgacatcaccatcaactggtccggcggcattcaccacccctccgcggcaccctcgatttgaggcacgcgccaccgtatccctgccgggccagtcgccattgcgccgccgccgagctccctgagagctcggtgccaccgtgcatcgcc

SEQ ID NO: 34285 - DNA, 1501 bp, Oryza sativa
tatggttcaaattatctctcttattttattctttcactaagccatatcatctcaatttttttagaccttatatgtatgatctaaattatattccttcttttgttctctcgtaaagccacatcatcttacttttacatttaaatcatcattttatatactatttaaatttaaatcatatcaatttatgtaagcttatgtttatgtaagcatgtgttgtttaagctatcataaacattatttttactgataacacctggttagtaaatataatcgcgtcctttttccttcttgctgtggattagtggataggttcatatgtaaaatttgaaattttgtggcacgaaagatcctattttagtttatttcccatgaccttctccaccattggaggaccatcccaagggttactagttggtgcagctacactagcgaagcaagtcgcacaccaccatgcatcccttgccggttttggttcagcttcacgtggtattttaaaaaatcacaaaactttcatttaaaatataagaaaacatttatctcaaaattaatcacaaaattttcaatttaaatctgaaattttcatctcaataatcgcaaaaactttcaattcaaatctaaaactttcatctcaaaatcacaaaaacttacgattgaaaaatccaaaaactttcatgtaatatgtaaaataaaggtttttgattattattctgtaacgaacaattggcatcggagattattggttttgatatttggaatttattcacgaagtagttttggagatgattggatttcacaggtgaatctacaggtactgctggattgggtccggtcagaccgggcaggtgttgccgatcagaccagcggtatatgcgcggtcagaccggcgcagcccgcggtctgactggctaacgctgtgtcggtttcggtttcaggttgtttgtttggatatccgtgattgtttcattgttatggcttctagatggatactatacatatgtaatactgttgtttactactaatgagtcaagttggagatagcttggtctcggaatatggtttctttgtttatttcatatgtaggtgactcgatgcctcgggagagtatttgcggtgatggaccgggagtcggcttggggataagataacgtctgtggtggtcagagatcatacgggatacttaggctagagttgatgcacgtggttgatggagattccatatggcatacgatggaggtattgtatgcgtatgggatgcggagtcgaatttggaaggagtccaaatttagtatgattggttatgtaaagtttgtttcttatactagagggtttcctaaggtgtttaagactcctagtatgagtttggttcgtggctttaggttgcctacctcgggtataaatagagggggagtgtgaggcttcccggtatcgcttttgaaagcaattgagttgagttttgagttagggtttcgaatttagtcgaaatttttgtaagaagtgatgt

SEQ ID NO: 34286 - DNA, 1501 bp, Oryza sativa
tcggctaccaggatcacggttaggtcgatgtcatagtgcagcctttgcacctatccctaattccctatacacacttccagccaaggatcactgtgtgtaccaaaccgatgatatcctagcacgctcaaagccaacccagttctagccgaggatcatgataaattggtttgcccagcctaggacaagccgatcaaatcggtgagagtgataggagaggcaaacatcaggtgttttctgtaaattatatccccaaacaaccatacggcgtgcaagatggtatgtcatccgtgcgccacgccgtatcattttgctagcatagatcgttttggattaaattagcacggattagccaagttattatattaaaacaagcaatttacaaaatgttgtacctacttgcacccaccacacaagtttatgtaccgtgattgtagtttactcagacaatttttaatgaattagaaattacggaaaagatgaaactccggatgtgacaaccatcctgaaaaataatcaaaagcttgattgtttagactttatgcttctctgcatactttgcgatgcatcatccctagcggtgcttataatcataaaaactaacaaacatgcttttggtcataataaagggtaaaatctcgttgcagtcatctaacataatcatgctttacactatattctcctcttatatgagtagattattatatataaatatatttagtccttaattgaatatatttatataaattggcctacaggtataagatcatatcggagtagtagccaatacgttatcatttcctttattttattctattttctactccctccgtcccacaatacaaatgattttaagtttttgatggcaacgtttaaccactcgtcttatttaatttttttttgcaaatataaaaaactaaaagttgtgcttaaagtactgtagataataaagtaagtcaaaaataaaataaataataatttcaaaaaattttgaataagacgagttgtcaaacgttgcaagtaaaaactcaaaatcccttatattatgggacggagggagtacctaacagcccattttcctcaacggtatcggcatgtaaagactatatgtcatcggcccaccagccgatcggctatcgtttacaagattaattattttattttccttgttggttgcaatatcaaaccaactagtacgcccttgaagaaagcgagattttggacttgcactagagttatgtagatctcttaggccactgtgtgttcttttgcatcaacagtagttaagtgtcgagatacgtggttaaagagatgagtacgatttagattcgacgacgagttaagacagtcaaagcggacttaatccgatttttaataaagatggactgggctggccaaaaacaaaaccagtcttcggctcacatcgcaataccaacacaccgcatcgcatatttttcctcacctttgctcaaaactccggaaagaaaccagacgaaaccctaag

SEQ ID NO: 34287 - DNA, 1501 bp, Oryza sativa
gcgagcgaggcgccgaggccatgttgatgggcgttgagtggagtgaggaggaatccaggaatcactggtgaggtggatgcgactttgtttatagtataactgggctttggacggctcggattccccgatgcgaagtagagtgttccctgttctcaataggtttgaccccttgattgcaagttaatgacttagacttagttcaaatgtgctcggtagtccataaaacgagacaagccattagagtatgattaattgagtattaattattacaaactaaaaaaatagatttatttagattatctaaagaaactcttatataaaaagtttttcaaataacaccacatttaataatctgagaagcatgctgataggaaataataatcttgcaacagcaaaacaagaaaagaacggggccttaaatgatgaaaacgatattatttctacgaaaatgattgtggatcgatcggagctctttatatatttatcaatttaactaggtagtgatgattgcactataattccgaaagaaattagaaaaattaagaattttatacagtaagatggaaacgtgaaaaacgatgatgctgccaccgttttcaacgagagaggcagagcgcgagcgaaagtgcgaaaccggtggaaaaatccaacgtgagatggtcgtcgtgcaaggaagctgcggacgccgcggtggaccagtccactacccgcatcggcctggctgggccgcggcctctctgcctggccgaggagctgcacgggttgggctaggccccgtgcgccgtgggctgatcgggagcaggagcaagccagcgacaatgctgcagtgcatgtgagcagtgacgcgcacgcgctgatgccctgcgtctacctgatcgggtggatgggaggcgtggttcgcgtgcgtgcgtgcgtgctaacgtgctcgcgcggcgcacgacgcgcagtcgctcgtcccggctgccaaccgaccaaccagtcctgccgtgtgggatgaaaactcgaaaaaggaacgtcctagtagtagcagcagtagtaaacgcgacgcaggcacaaaaacgctcgctttaatcactcacaagacgcgacgttactaacgaatgacccaaggattttttctaccgattcttgaacgacacaaggattattcgacatgattagagcaacaaggctgtgtgacccacccgtggccgtgtatactcatggtcatactccctccaaatgcaccacgacattgttcgaaaaccaacggctatgccaacggttacccgtcctgtcgtccagcctcggcaaccataaagcaacagatccacactctcttttagattctcaccaacaatctcaacgtctcctcctcctctcctattcttagcaacatctatataaacagcgacagcgacaaccaaatctaacgcaccataaataaataaaaataaaaacagcaacaataacgcagtcttgcgtcttgccttggcaacgtcaattccgatggcgacaagag

SEQ ID NO: 34288 - DNA, 617 bp, Oryza sativa
ctagtctccagtaggcgaggcaccaaaaagcgactaggtgaacactattacttgtgtcttaggtgttctgcaatagtcatttacattttcaatgtataatttgtatggtgtacattccatttgaaaaggaagtaaaaccatttggagcttaatagcagttctatttttcctcatgttcctcccaaaggtttatgtcccactttaatcagctattcagaagtttattttatgctttaaataaaattactgaaatttgacatcttgacaacaacatgattgccagtctgggaatgttattcatccttttagttatgtacttctctgaagtcctctgtgatgattgtgaattgttgctggtcctctctttatagaatgatcccagtccaactcttagaaaaagccacaaacacttccacaaatcttcatgtgctccaggggagaaatgtggaatggacaaataaagtaacttctttattgtggaatacttacaccatgccattttgatgattttagtttcatattggtcatctttgatcccctgactgatttgcctaagtcacctgtcactgcagcaactataggtcaagcaaataaatcagctcatcttacagcaacta

SEQ ID NO: 34289 - DNA, 1501 bp, Oryza sativa
gtttaatgcaggcttcaaggaaaggctgttgtttttgcaattgattttatttaaactcttttctgaaacaactaagtgagtgcttctcaaacgacacggatgagacagtgcgtctcgtccggtcggagtatgtgcaaggtatcagtcttttgaattgatcaaggttggcacccggccaacggtttttaaacggccacccgggcctggctgatcccatcagccgcagattttccaaacatcaatcccaaaccacatcagcaaatttcacaagcagtagtcaaacaaaactatgctaggaatcaccttacatccgcccatgaccgtgggcacggctgttcgaacagtttaataacctctgcagagggggtacactttacccacacgtcattactaacccggatcatccagcccgtgcagaacggccacgactagagaccttaaggctttcatgacaaggcatttcgaaagccgacacaggttcaccatatgccaatgagaggggttccagaccaacaccagattaggtcccagaccatactgtgccaggaaacccgggggtcctccccgacaccaccccgttgaatccacatgtctcttgacatcatggctcccccgattagctagttactcagccaggggtgtcccattccacccatgtggtcgtacttgtcttatgttcggatgaaattccaaggaaacggtccttaagtgcaagagcgggaaaccgtacacccggtacgttacccggtccgcgattttggaaattcatttaggttcgcaagcaccgacccaggtgtcgggttttccaagtcttttgtaaaacccaagttttacccaagatgtttctcagattttaagtttgaaggcgatcgtcgatactcgtgtagagtgcacgattaccgaggcgcaactaggtggttacaagggaacatggtataacaattacaaggcaagggtcaaatgcaacaagttaggtaggtccgccaatctgccttgcagatgggacaaacagattaagtgcaatcctatcaatgcataatattttttaagcaacataattaagttcaaatataggctcaagatgttcaaaggtggcttgccttgctcgagatcttgatcttggtcctcgaaatcctcgcactgcgggtcttcgggctccgaaactacacgcgaaatgggacaactcagcaaacggcgaaaataaagccctattattgacctctaagcgtgcctttagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagggaggtaaattagactttcctcgggcggctacggcgcggcccgagagaaaaggggcggctcggccgagcttaatgggccggccggcccaagaaggcgtcccaaagc

SEQ ID NO: 34290 - DNA, 1501 bp, Oryza sativa
accatttgcatttttgcttttttttttgggaggggggcagcgagtagaagtgaccgggacgacgggtctatctccacctccatagtggtgtctcatccttgttgtcgcctccttatccccaccgccgtcttgtcctccttccgctgccaccgcctctcagcgaggtctccggcgccatgcacccggtcctcccctgactcaccctctccctctctctctctcttcatagccacagccaagggcatttcgagtataaaaatggttaaaactcctcaaagtaatatttcatctggtaggcaacgtattgagtggtattttatacgatgcattccattgagtgatattttattgaaatcctatgtatatagtgggatattatatgttttcttcctctcaaacacactattctaagactgtctgtattttattattttcacttgaccaacaattttttttatgagtcacttgaccagcattgattagagtatttgacattgaaggtgtcttgggcactgaagtgtgaattcacctaacacctctttcacattttcttccaagttttaaacacccaacttggactattggaacatgcatggaacccattacccaagaaacaattgaagaatcatgtacactgtcgcgactaggtctatatatgtgtcgtattgtttgggcccaacgtaacaaacacatggcatatatgcaagtaaacaatatcaaaaatcgtcgaacaaaacatgaattaagctacgagcctatgaataatatatatcactataatctatgttccctcttgactttcgtcacaattattctcgcgcttgtggctattgatcatcaaaattatttgggctggccgacaacttcgatgtatacaaggatggagctaaatagattatgaaactctgtaaaacatagtgataataaagtttgttgtggtccatatcagtatatatctgacgagaagattcaatccacgcgggtgaagatattagagagaaaaagtgtacacccaaatactataaacacatgcaaaataaacgtagctcaactgattgaattggtgaagtcaactcactcaagttcaaatcttaaacgtaacacgacgcctttacggctaattagtctttcagtggtagttgacgtacttatctagtgagatgtatgtggtgacttcttgaattttaaaatatgttgatcctagtcttctgaaggtattcatacaaatagattttacgtgtgcatgttataaacatctacgtttatcctatgttttttcataaaaaagtagggccatgtttagattctaacttttttcttcaaacttcaaacttttcgtcacattaaacttttttatactcacgaacttctaattttttcgttacatcgttccaatttctttaaacttttaattttaacgtggaactaaacacaggctagaacaacatattcgtttccctaaaaaatattctcgattacacactcgcatcaccatcccaca

SEQ ID NO: 34291 - DNA, 240 bp, Oryza sativa
aagcaatgcacttgactcttggctaattgaccctctaacacactagatggatgaacacaaagctcaagtgggtgtgagagaggtgcaaggggtgtatgcaattgaaatgggtgccaagagagtccccttgctgctggagggggagtatttatactcccaccaaccaaaactagccgttgagggcgaaatcccccaactctgtgctctgccggtctgaccggaggtatgtggccggtcaga

SEQ ID NO: 34292 - DNA, 1501 bp, Oryza sativa
aaacgttatatgatgctttatatcaacgctttaaaaaggggccgagctctccgtcatcaaaagattccgactgcgggacacctggagatccccaaattctttgggatcgtctctggtcttacccaaaaatcgcatgcacatcgttatccacaccaattgcgcaaataattctaactccagaaattcctttgggtagtcaccagctgcgttttaatcaatcattatcgccagttcattgcttagcatgcaatatttgggttggacggcccatgcgtgtatgattacaccaccaggtgtaccaatttatcgtactcagtggtcacgccattaagcaacgtcgtcacaactatcagacgtgtgtactctagatattacattaaacaaaatttgtcaaataaagagttaaattcttcgactcctcatactcttggcgactagggcatgaaatgataattatacgagtatacaaatgacgaattaagtatttgtaaaataggaaaaaaataaaatacttatataagaaattcacatatagaagcttttattataatattgtaccgtttaagagtttagggatcgggatcatgcccataattcattgccaatccattgccacaaaatgaacataggctgtgtttagatcaaaagtttgaattcaaacctcagttcttttccatcacattaacctgtcatacacacaaaacttttcagtcacatcatctctaatttcaatcaaaatctaaactttgcgctgaactaaacacaaccatagaattgcacgaacattctgtcatgaaatgccagctagttgtcgtaccgaaaaatataatctcaccttccacagaattgccaatttgacgtgaaatgtttagatgatctcttgccagtagacactagcaaaacaaaatatacggaaatataccctatcccagtaaggtgcacaaccactcgtgtacgtacgttaaggtgcagcacacctaaatacaggtcggacacacaccctcacaaacgatccgtccatccatccagcgcgcgtcggcccgtccatctcctgtcctgtcggtgctctcgactcctcacctcacccacacacccccacgcgctgagtcctcccctctcactgccatccgtggcccaccacgcctcggccccacccgacagcgactcccagacttccacctcacccctaccccgaccgtgcaccaacccccccgcggccgcaccacacgcgagtacgcgacgagcgccaccaccaccaacccagccgaaagcccacgcgagcccatcccctgcagtagaagaggaggcggcgagcgagcgagacgccgagccgagcagcgccgcggaggcgtcgtcgtctccggtgggttgcaggaggcgaatgcgatggggtccaagacgaaggggtgctgcgggtggctgatcgtggcgctggtggcgtcgctggtggcgacggcggcggtggtggccatcatgaagaagaaggtcggcggggggagcg

SEQ ID NO: 34293 - DNA, 490 bp, Oryza sativa
caccatcagaactcaaaattagacttgatagatttcactatgataatcatgataaaccctcatgcatctatagctccgactgctccgagcgaataacccttcgaaggttttcagtggttaagggagtcggttacctgcaagtcagaactacgtttgtaaactctcagaaagaaacatctgtaaggtttcatgaacaataataatgtaaatagcatgcttgcagtataaatgcatgactgtgttttcttggacaaaacatatgtgcagattttgctggaagtgttgtaacaccatttttacatttttttataaaacggacgggttcaggggcacaatgtgatctccaattctccatatattcttttgaactaaatgccagcatgctgcaatggaattcaataacctacaccataatttgtaaacttgaacaaaatcttaaaactcgaatacatgatttgcatcagaccaaccagccacttgcatataaaca

SEQ ID NO: 34294 - DNA, 1501 bp, Oryza sativa
ctttgtgatttgattttgttcttgacattttgaaacggtaagaaataaaatatgtcatatgctcttagtgacaaactattattgttccatcagtgcaaagtgcaagctaaaatgttcataatctgactataccctttcaactagagaatcataaatggattgttcctcgctcgtatcaatggtccgacattgctcttttgcacaggaatgtttttctaaaccatagacttcatttctcggaggcaatggattaaaatttaatctttggtcttgggggtcactgaaaagaaataatatagctatgtttaagggggcttgagattataaaaagcagttggtgaaaatttagaaaaagttgtgattctcaacttttggcaatctagctttccattcactatttagattccacaactaccaaacctcaaaagttgggtgagaagttagataatttcagtctcagagggttaaagatttgtagagaaactgtaattgtcaaagttctccaaaagctcaaaatttgggtgaaaagatatattgtataggagaggtaggccctgtttctttcagcttgatattattataatccagattattgagagtaagctgaaataaacagacaaattattaaagtagcttattataatctgaagcccagcttattataatctgataagctcatttaggtaacaatctagcttatagtaatctggcttaataatctaaattataataatcttaagctgaaagaaatagggcgttaaagattttgagaaaaggggtaactgtcataatctcttcaaagaagatcagatatctataaaaaaaatcttgatttataacattcaaacgttatagaaattagttgatttctagcctcttacttactcttgggttacaagtcgtgaaaatttatccatttagtatcacttattcatcacgtaacaatactatttttctattaataagaatcacattgttctttttttaccaccgataaattttattagaaacctagaatgaatagggatcaagtggattgaaatactatgcagtcgactgcatcatgcttttatcactgacatatgggtccaatgatatccgagcacacatattagtgataaaggcgcggtacaattgactacaggggatcctggtctggatcaagtctttgtgggacttacgagcaattacaagctcaatgcttacacgtattcagatcttacgggatcaggagaggagaatatttacgatccacatgaaacgagaaaagctcattagcatatgattaattagatattaattattgtaaacatgaaaaattgatttatttaattcttttaaacaacttctatatacaaattttctgtaaaaaattgtagaaacgtagtaacggaaaacaacaaaattgaattttagatttggagtatagaactgaaccttagactttgactacacagtgagcaaccactgcagtcggggcccacctgatacactaaaggcc
